United States Patent 7,745,391 (HUMAN THROMBOSPONDIN POLYPEPTIDE) - sequence listing, part 297

SEQ ID NO: 1011957 - protein, 242 aa, Homo sapiens
MTEQSMEAPDYEVLSVREQLFHERDPAELYYINLLFGNSCTVLLLTCLPEPAFKEACVEFTDSGMMKMPIGQQDVRSSLCSFTRGNVVLGACPDSCPFSIISQVKAACIVPTVRRLSFTVLVASHGLPSSMAVWNRCLTLLQPVRVMFLMPFAYFFTESEGFAWLQQRVSWAGSYETVVMLNGSVTLLVLGMVCGGISHEWTENMAMQRVTHMTVREYYLHLSSTHAFSFLGVLAAPGVYSD

SEQ ID NO: 1011958 - protein, 112 aa, Homo sapiens
MDWDPFVEKRNNHHVGGRLDGHKPSDVFRLPVLRTERINTVPWRVSGPHSKTEGVLIAPSFEGRYSEGKPWDQKRVIHTWKEMFGSAQENSQGTAKGGAGCEFISRLGRRGL

SEQ ID NO: 1011959 - protein, 141 aa, Homo sapiens
THTTLIHSQANLAACSLQSSRHCGSEGRGTGAGDGARGVLVAPPATVHAISCSTVYSTLMPCLQYVQQGGSPARGCCTGIQNLLAEANNSPDRRTICGCLKNVANGASGGPYITRAAALPSKCNVALPYKISPSVDCNSIH

SEQ ID NO: 1011960 - protein, 149 aa, Homo sapiens
CLPLSFPATPNSVACRFPLPAPASPPFLPRPYPAPVCPFRLAPPCPLFLLTRLSAAPNLLCRHPAGTESGTPRDTEPALPPTPSLEGPSTTRGGARRGLTPTKLEFPRGEAGDKLPILGYDTYQHVCARPVHGTTYCFLLAQEGSRTGE

SEQ ID NO: 1011961 - protein, 102 aa, Homo sapiens
TNIHKPKHISEIGMAHFQEVDYCSEEVRAVGYPVRRGCGGVQEHIVKETFVQEFDTAGRRHGHHGRGSGHFEVRESRLEEDINTRTGEFHERKENFVVRADD

SEQ ID NO: 1011962 - protein, 126 aa, Homo sapiens
LGAGLSAVAGRRCAAAAGERGQKWRLLTPGNSPKGGAPPNPPEVDLPEALHSLNPDDHGHVALVNTTRKGIRTSGMHIREYIQREKNIEAIEAMRMQRANNIERTVRTGNDPSSPGDIRNRPMERK

SEQ ID NO: 1011963 - protein, 108 aa, Homo sapiens
MWADRAGWRCEDPNPGLGGGGGCCDRRGLETHRTNAMRALWVLGLCCVLLTCRVGHELTSEVDSGVVQVQKRIWVRSREGSRTDDEVVQREEEAIQLDGLNASQSKRT

SEQ ID NO: 1011964 - protein, 178 aa, Homo sapiens
FPYEPGKQVRSAVRIKNVGKSHVAFKFQTTAPKSCFMRPPGGILAPGETIIATVFKFVEHPENNEKPLDQKCKVKFKIVSLKVKGPVEYVPECSDEQKDQVAVEQILRVIFLDAERPSAQLDRLKRQLAEAEAALEARKKPPEDTSPPIVGEGLVIDEWKERRERYLARQQVEEVDSV

SEQ ID NO: 1011965 - protein, 209 aa, Homo sapiens
NGTLTSSVGLYYTYIHIYIYIYKIAYCVSHKTEYTVATMYRGVHSLSETPYLSLSLEGAGTYISQSRFPPQLPPTLAPLFVAGCHRRLSLDDRLILIIDVDPLASCYSYLLLIDVDEMMWGVDRPILPLLIAPRTRDEAEENERHTPHSIVAPAERTMCSRSRIATKDEKVLSPTNELPLTVVVLWVVVLLGDYCAGDSNNDDWTNRIE

SEQ ID NO: 1011966 - protein, 87 aa, Homo sapiens
RTHCCGTETVKLSRILPVWVGGSPVVLHTPYGPLPPCPDRVPLPSEPILDLSAEDRPGSCPSACCGQRTDGHWAAMTSEKASDTVAA

SEQ ID NO: 1011967 - protein, 228 aa, Homo sapiens
VSRHRRRDGPQLTGAPPSVPSPSPSAAAWPPGYGLAAIPDELLAEIFVRLPTPTDLVRASAACVSFRRVVADRSFLRQFRKLHAPPLLGFLGPHTGFDPAERPHPSASAATAVALAADFSFSFLPAPDPAHRWVVWDVRDGRVLLRGMPLENSHGVVFTETVVCDPLHRRYLMLPSIPDDLAASVEGLRPRSCEIFLVPEGGDESTTAEETSFRVIWVGHYEDKLITV

SEQ ID NO: 1011968 - protein, 59 aa, Homo sapiens
MRLRYAEGPSRLCFLSAPRSCPWRVRARMACEVLADVLLLPDITRPNIVEALLHGVPAH

SEQ ID NO: 1011969 - protein, 67 aa, Homo sapiens
REKWGLRSAAVQPARRRLRCSGALSPVWPSSGDPVTELSSASSPEPCSWLELLPFLSKTKHIKNTTI

SEQ ID NO: 1011970 - protein, 77 aa, Homo sapiens
MLAVSSARCLAAADEQRAEAAPMETVGGAAVVADLDIDFDFTVDDIDFGDFFLRLEDGDALPDLEVDPADIFTDLEA

SEQ ID NO: 1011971 - protein, 243 aa, Homo sapiens
MGGDSSTWPPYAPWISYSRLDSGIVLPGQSAEKGDSENVVAPMMLPYGIAAVENLVSREGLSKAFQGIAPMEAYCCTCAWTHRDSNGIHALRAMEVQVVQTGIDRGETVVSLSMGVLENIGLRNSFNAETLVEKARRCRNQFAHVAPGYSSPNPFTVSHFVRARLGLACTSTVMAASNRLRNCQNIIPVRHVDSWPFGRACLRLVYFDSVGTVIVSWGYWPEGWYDQWVQRRNGRASLGKKPL

SEQ ID NO: 1011972 - protein, 36 aa, Homo sapiens
KGMAAQALQDLLGRMCNVKSQADEEGHESFGYKREL

SEQ ID NO: 1011973 - protein, 254 aa, Homo sapiens
EVALAAAVSVPVAAGCQDPGRRRRMPGALVAPRCRRPATPTQRPDPAPPVLTPLSQSSASPLPLPTRRRVPLLVPLSTDSALPSRCPLPEPLSRANWVTSGREKRATRPEKNREKRKTKGKQKETPKEEEAKRQKTQQKRKRQHNTEKKKKTKKQTEQRPNKKNKEEKKKTTGEKNKEKNEKKKAKQPHSRKKQNQKGTKKKQKKKPGTKKTKTTKKTTQKKRAKIHKEGEKHKKEKQNKNKSNREKDDHRRQQ

SEQ ID NO: 1011974 - protein, 220 aa, Homo sapiens
SGGTLPEVKQRERTQARLGSGVMTIAQVEMVRPKPWRPFALGISSLASQSSAGNMRSPTRNQEDGSYMLKQPPQVSVTSFMQYSEESRLRCQLSYGNMCSAGLHRSFKPSMNNPGGPTCGACRTISIERPCGRNLREWNGHVNIYLYVFISYVVGKHHVIGKSSLRRVYPNKQLAPLYPKLNGCIHDLQLLYPVYIFQNEVKDGKPYRQEFVLGSYILYE

SEQ ID NO: 1011975 - protein, 81 aa, Homo sapiens
MGFLPKQLICGAELGPKNWPLGQRWAFYFHFPVCIFNSNERVGVVAYTVIKPKLSNGKPPGGAPFVVPRLSLPKCKKVGPP

SEQ ID NO: 1011976 - protein, 253 aa, Homo sapiens
SRHPARPTDADACPVMGRLNGAGVPLRGDAPHPDIGCSDRRWPSAWGPSSSLMFGCGSVAQCCASAWGTHGVFPHHRTWPLALLSLWASSSLDQVSGAHREPCRDLWHVLPGLSEPSVIKAAHRTPLAQTLGAFYGCMEIDNTGWYHDESGNFAQTEPDIYDIRGPKWSQPGILATYPSGHLDMINGSFDQFIGTDSLIVCVLAIVDPYNNPSYERGLKAFKVGKRKNLCHGNSYGYQIRICQTNLTRELRTQ

SEQ ID NO: 1011977 - protein, 157 aa, Homo sapiens
MPYLVGVSCSLEGSHTVAYGTHRSCRVSRPGHGLLTPVSGDRDGPDGADEESKVGSRLTARYVMSRSRLPGKALTVDVIGKAGVASGLRENRWREDRGCVTLKLVIYRTRKNRHLEENSRNQGETFVRCAEDENWYREVKVSISNVEDPRRRGKLST

SEQ ID NO: 1011978 - protein, 68 aa, Homo sapiens
MVDSHRLYQCACSDARQRIVDPFKLSFSTRAAAQAQDPVPDKTSHVHSMLPAEVMLCAWRTRSAEGPQ

SEQ ID NO: 1011979 - protein, 284 aa, Homo sapiens
RCARGAPGGGTRIRRRGADTDTKGIRVPPPPKPCGPPMVNWLQRSSVAPLVHGPISWTRLEILTDDSGDRASSLRPSGLLRSPFPRRHTPSHPRQVSVPVPSVPSLPAAAMLHTEGHSSSSGGGSGKATLGPVCFWSEAAYVNELVMPQGETAANGKPVRARYDDPQNKARLVRLIFLVAEGCGPQISQTGLTGALALIATALQPGRWGCSPTGCSIACFLITHQTQRHPCLGPRDSTAGDDLKSLGSTGPIGTPTGGDQLNDRFWRTSIGLDDVPIATGHTRG

SEQ ID NO: 1011980 - protein, 420 aa, Homo sapiens
DGWTWGHPRRASWVVEESPVAATACASCSDRCSPASPACCLCCFSRMLGSRCAWVDIRVKVVCQSDRLHLKLKNMLTFTGWKKALLSQQCSPSGGWAQYTDRMIADCIVRMEFESRSRHVVNSNNGFVVAVTLLVIGQRSLAVVRPARPGINAQQSHLITSLPGLTAYSFTRGPFPVLTHHFSPELYKRPKSGGLLLHRGTLVQDRMHLVSPMTFSAGGMASVGAQVPLGAGTCSSLYSIHGPPMRPCPDSTSGDWCLLNPRARILSQRFNPHGQGSRSGQNSTPFATSCDSWLARTSLPRSAFGEPVLVWQPHAGPAHSLASTNHTTQPPQRQQYTPGGLTHLGLARMGHNPLKTTHAKRQNKEAPPTPAHVHRQHTQAQRATPPKQSENSSTNHKPDNPRNPKNRTQPEATTHTEHRP

SEQ ID NO: 1011981 - protein, 335 aa, Homo sapiens
QRCRSLGAVAAAAAAALGSVDAVRALREALVPAAAALLRAPWGCGAPGPGPCPGISLVSTEPLCPWCPCCPGLVENLLLSVLVASPCGSLPPGAIDRVVPCVGCCCCEFGERQRQARTWRPERGRVLLWVRAGIACRCAGMPCRTANHAGGSPGGPLNSRTRGWSPALGAAVCPAPSRPGSWCHFGVVGTKTFSPAAFPEAPFRPGGRVCWPQGLPHWLGLPAGPWRRWWLWTPQLWSSPSYELTPWRSSPWKVPRHAMFLEGRSSILALGPPLPSKYTAIRQPSTGKVRSHLDPGWQKAGPDRADLSEEKPNFALKAFRKNQDHHPAQQTQRIL

SEQ ID NO: 1011982 - protein, 217 aa, Homo sapiens
MACINTLQSCSMFKGAKSKARRGRASGGTFECRASTFMDGSGLRLGLDENPDAIISGEWPENFSLLSYDDLRAYLQSQQQQQQQQPSHAGDQQRGPLLREAMSTPVLMVTAEQALVEVEGHFQLVSGLPVVDSARRCVGVVVKSDHVRASHGPKTKIADVMTSPAITLSCDKTVTDAAALMLRKKIHRLPIVNQDNQVIGIVTRDDVLRALEAMLKF

SEQ ID NO: 1011983 - protein, 120 aa, Homo sapiens
MASPGGGYADRPAPPLDGMITVDGGGEQDAAAGGAAEAARFRGLMQQPSRLASGVRQFASRVSMKVPEVVPGIRPGGGRMTRMQSSAQMGLKGLRFLDKTSGSKEGWKAVERRFDEMSKA

SEQ ID NO: 1011984 - protein, 187 aa, Homo sapiens
MNRNSTAIGRVMASRVIFIFRIDGAGWWTVESVWGDEKIFLHLQTHSSRGCKQRLVYEPHSFPHSRQWCVTVVSPAGSVTSFQPSLSSWSCTWFSSNTLEKKSATALRAMGTPYTWRKVKRHKGPYLRDTVVDLCHQRAVPAVGRGRLHVCLLSDLPWRTAMVRLVKCDVSALTQQHVDCFVSRATE

SEQ ID NO: 1011985 - protein, 215 aa, Homo sapiens
MVLKNRRGGRAHVDLIRLEETSKNWYNILTEIHKELLADHSRGCTDEIAEVADEVEKLVDPRKERRNNECHEDTRQDSHGQASNSPMDPNIGESKFYNMRTNSLKIHSVKDIAPVCLYKGERGSSRQSTRPSYLGERDEFEYPGYFSAFVELHEYSVILISSRHYGKYDLWSFRITGEGQKIDRMMEAYAQRYGQCINGTWFQGPRDTLGTVIVP

SEQ ID NO: 1011986 - protein, 131 aa, Homo sapiens
MALTSAPAMYLLSNCRGFLVNSGLAANWAQALALLAPLASYEAPFGEGRMSDRLVRIALPSCCSVATGLRITYADPAVSWTVVCRGSVAASLLYSAPICTLSSRYRAVSLPRHSSGAYVSAYDSCLASASY

SEQ ID NO: 1011987 - protein, 32 aa, Homo sapiens
VSGARLQTRRMTLRAAVFDLDGVLALPAVFGV

SEQ ID NO: 1011988 - protein, 332 aa, Homo sapiens
PPARLRSQPAAKRRRGHQIEMRPTVSYTDMRERRIEKRLFVSTRLRPRWIEKDIHVYFFRELDIVLCCDVDMERFILYNLKSKKWPRMFDAIERPAGNHTISQTQTKDNKTKRGAGRSQKLSPSRRAPRLNYTRSPTVTPVIPTGPPYRRTRYYLRPSMHARPIMLYNKQVAVSTVRAGHNPCRPTHLREHPLSVSNGHPLAPRVLCYHTYVAQLSFPLRRTFHTPLTRPTVTTCFNKTRYTRVYKTTFPRPMIPAPTRSKTLPPTTTYLPSPKLLFLHPATTLTITCPQHTLLHITTTTITPQPRNTKHNTTLHPPTHPYHSHYLTPSSLI

SEQ ID NO: 1011989 - protein, 112 aa, Homo sapiens
MCVNPCPPVHHTICPPQWTIGNVSAVPKMCDPAMGLRCESVTAPGAENRLCVAAALGQLLHRSSDGDHLLPVAALNATSSPRPKGCQKGRHRKVKKPLSQECPPGTLLSQMG

SEQ ID NO: 1011990 - protein, 392 aa, Homo sapiens
RKSQFTKIEQSCELLALERFVWHVEPRRAMWGLKSRQQRSAGLPSASRFGSRWIPRFLPVSCADVALRRDATLPPALRNFREFGHSRCNSHMVQQDETTLQRLTALSRRGFCKSSAFKCRCLRGGRRKAVNDDAYGLDSKWFGRTSRRDLELGLNRLECDTGLPGKPEHSRGILTAATGKTAETYGSHDKDKLDSMLKIRAFSSEDALQSRYSPKAAGPDKSACAGLNQRTFHCKATNGPPNECRTQLDLILCRTQLVPIVLILGRLQGQNCRSKKTPCESAITKGACPLGRKALHRKVLHAKAAVASVEEDDYRGQANGVANNGQGFPFRKRAVSKGYEKGPTILDMETLALGEQDINLSSTKNAAFPYTGAIEPCAIFVPFVWGEGNLIK

SEQ ID NO: 1011991 - protein, 88 aa, Homo sapiens
MEAVGSKIPHEPVCRDRDEGHPGVSAREPPKNEQNKSLKENQKEDAGKTCWRTEGKSEVTKPEREVTEEETSEQGYTERDWAEITTES

SEQ ID NO: 1011992 - protein, 70 aa, Homo sapiens
QIKVSADLVSSEASLLGLQIDFYRLEDLSSHGGVLTWSFLCACTCLCANLLIKTNEKLAVCMVRVFSLLP

SEQ ID NO: 1011993 - protein, 66 aa, Homo sapiens
AGFCKADVRWSSVLLTQCPASLIPGVAAVVVPPPSTDVADMLCGVMVCIYDSYPDIPGSEARIWSD

SEQ ID NO: 1011994 - protein, 64 aa, Homo sapiens
MSLSAISLYTAPPGAAYSSSSSEFDLGSLRLDAVQHRGAAPPAAPTAVRRRRRLGPLLLFSSPG

SEQ ID NO: 1011995 - protein, 84 aa, Homo sapiens
SGGTAGSSSCGMSASLLLWEEEEKEEEEEEEEGEEEETGAGDGKLYAESCHSKKVLPTSLPLTHTLKVHNRKRKDTDDRSCKTE

SEQ ID NO: 1011996 - protein, 158 aa, Homo sapiens
PRGLSLASVSVWTEQDPGTLFQTSERPPMSSPVGSSGTIFSAISCFWDLPVTGCVGGLVSLRCARANRDELHSIRSEVIPLERGGMPVNSPWSNCQYLQAVRTHYLSSWVFYCRPVCMMASGKRVESMLHCARTWTEVEAVEGHSKAVVLKIAKTSRC

SEQ ID NO: 1011997 - protein, 177 aa, Homo sapiens
AENPAGSEQTSVPIPAPAYPQHAATPACLDRQLCGDSCLQTPRHYLVRPWISVPKNPMPQLVVYATEITQRSAREMSNTHTYTTEHVDLRCYAEQTTVETKKMVRRQLRRMDRHGATKCTSNTKKSDQHIQHRASSETIPREKKQEIEIHRDAWEQNKKPTDRANGQKPMEHPKAAK

SEQ ID NO: 1011998 - protein, 107 aa, Homo sapiens
MSRSPRGQSVKSFQLENTLSTTSHSNEGDFLCRVQPYGGLAGVLPVLQRQEIVRNKDTRQTDKEKTAGPRDHYHQDMETASGSERLAALIFIEYKTRGQATDGESSK

SEQ ID NO: 1011999 - protein, 237 aa, Homo sapiens
AEQSMSRPGPGRRPMCQWLALGVLCSPRLPLPPRSFSRMAGDSTATSRRLGVCSGTATAPGIFSLAGCPPASATVSVVWAGGPEPLGRVSGWWACGVHQGNGVAPMSENAGAQGWLDCFEDHYAASTVACALPGLALFPMADLMGSPRVRGYASGYLHVREVTRTSLRGSVIAAVLPASNSCGTNVGSLVGAAAGRGRFWKPCASRFVAAWASETRRLSAVPGPGGPLRLLGEMAIP

SEQ ID NO: 1012000 - protein, 301 aa, Homo sapiens
MDRYGPGLAPRCRRRVAPASCAAVAGCWGLLLGSASRAPGQVAAWMPPSPQEILIKGAGVCEAGDAGAPVARGLSGCVWEPDSAGSWHQQTQRGCGHPCPSVIALGTLGAGHWLPALGFLHRKSCALGRVDQGLPFVLRLSRPLPCSLERPGPRSSSCEGPLVPHFFLRALPVAPLPGPLVAMFQRRACRPALSAPTYRPGSWPSPYRLGQAPEQRKLRGFSPAFPWGTLMASQLRAHGFLGLELELPREVLLNRLQLADKVNGDQKGAGYSVPPIQLYLAVPYGKLCLQGVAQDSSLQID

SEQ ID NO: 1012001 - protein, 195 aa, Homo sapiens
MHPNLRSTSIFVDGMFLMTYSGYSTKALAKEGEPGLLAVERRAWYKHDVSNAPWMRNARALNAWCRIDSCGGLPRHEISPKDRVGVPARLTSGGALPSLFGGQSESDRGHDPSLNARCVGLWTVCAGVRTTFRMVHCRGSGRDDWGHSRAGVRARLGDGLTVGHFGGFVLARTVMGGSPPVRTLLAWDAWEPVPS

SEQ ID NO: 1012002 - protein, 117 aa, Homo sapiens
MSGSCLALLAVLLCSAPAHGLWCHDCTLTTNLQPLHPKAVPAADTVCASVRITDPSSSRKDHSVNKMCAPSFNLLKSDTYSHDYLMGFINSGILKVDVDCLRQGFVQWVRPGAVHSP

SEQ ID NO: 1012003 - protein, 242 aa, Homo sapiens
MESAVNTDTGSSQLSILTIASAPEHVPAVAVCMSGPVSQVRIPVCGSPCIQLPSHHHSSPEFTMTAASRIAIDMILSCSLGAWMLDLSWNTLEEKGAQGGPSALMQEGAIADVARQEGPGSGAEQGMPVRGAWVYGKLQPQDGAALHTGARHMPTLYSPRTGGCAATCDSSPLSALCDPQSLASHACARSSCSLYVKVLLLPGTIAHHSGLWPCSLVTPLPGPAAAGTPWSRLGAFSHCARP

SEQ ID NO: 1012004 - protein, 66 aa, Homo sapiens
AVYHIGSVSDSIQACKLAQENGWGVVDESSLHEMTDDTFIADLCGGAVEQATSTLVPRCRSLNDLG

SEQ ID NO: 1012005 - protein, 135 aa, Homo sapiens
MRLYPTTTHAVQTTDKCHKTDTNDNTKYEDTIKLHHISRELQTANDIGDHPFSKETNPEQRTDTTVRQKQQHTHPTQDQRIHAHEAREQLKTHGKEQYTPDQQPHTDDSTTKKDQQRTPNTQATTKQRTAENRKQ

SEQ ID NO: 1012006 - protein, 226 aa, Homo sapiens
MTKQRDPWRWQALHYVDIVQGQFEDAEEISAEPRSAKTLRGRGLPVFKEAICQASVTCSESVGTDKRRCMDQTPSRQLIRYEESRGGGSACETVRGIRRVSDDVLKATYEEEPEPAQDRAGQFQKRDRRRMFCKALDLGDTKSTWRLAVLQAGRPLEQPGEESSLDVKCPAKDRDGDMLEEAADRFSGLDNAKVSLDCGRRLCDLGDNAQGRTSMVMREDGQRDSN

SEQ ID NO: 1012007 - protein, 346 aa, Homo sapiens
RERGVQGDGGDAAEGFSSGSGLQPVMPGIVELPTLEELKVDEVKTSSAVLKAAAHHYGAQCDKPNKEFMLCRWEENRSEAAFRGRQTGQQVCFWTLFSATTKHVTCCTTPFTRNYLDSCIDSTTGPAAYLSLTVAQQHGKASDELCSLAQTAAGCGLTLASNCQKVTKADNSIAPLPENPYSLKTKTEIPALRIARRSARLPHMAAASHFWTKYHDGSVAHTRLMCSDNALTQHRPLPARFRLTRWCPHPRTHQTLNPHQLTFCDSDSQSYTQLPCHHKIPKAHDPRHKRPHSSVNPPNRACTSTQRTPRHQPNDPRKTTATPDHAEHARRAPRHSHPPQAHRAPT

SEQ ID NO: 1012008 - protein, 187 aa, Homo sapiens
MERFSVQKGSQESQDVTHAMSELGALMPSALSTAVPYEGPLRHQVPSLLGLTSGIETIHQSRLREGRRIEDRVIELQASVVGMATSWTGNINRVSQTTASSESQSGARQGLSMLETGEGQEDSRRTMLEISKLIVGNVDQRNGGVQNMKADRSSTPQAFGDPNQQLKTAWEPIEEVQSIEAGTEKVP

SEQ ID NO: 1012009 - protein, 130 aa, Homo sapiens
SESSTASGVDSHLKPHSNDGGPVLSQKTSISNVILSSQPSWQLPEPLPYRWSPGLCRPCRDCEPSSRGGSRGGWTCRPGTCTWRGRLLCTLTQAHTHLLTHTLNSCSHMPVRLTLTLAHPCTDTHTRPAS

SEQ ID NO: 1012010 - protein, 227 aa, Homo sapiens
MGVELGRSSHGVSLSRLCRPGPGVTGWSGARSSLTCGLFSYDTGSGPVWYKERQADQSAGGTWSVAAGGLGAPWPVDEKVYHTTQPILPVRELVGAMSFYSSDRTSIRTIYTSLHNELKKVVTGRGALVGLFLTCEELLSHLSEQLCFFVKARMEIADFYEKMYTLSTQKFINAEELVGLLDAIMKKYSSRFHHPILSPLESSFQLEVDVLCHLLKAQAQVSEWKFL

SEQ ID NO: 1012011 - protein, 294 aa, Homo sapiens
MADHKPDSDSTPRTLLLTACVGYSGPSARLGRPRSARAWSPEEPCVETASAQEVEWPRHTVADSHVVAFPMVRQCLLARVGPIFRPCGRRWQGYMTTVWTADVREASVLSCAQKSSILNAVRSVREGQMPAPSGRSNPTGAEMMQIAGSPVSHANLACSSQPLATIPGLRGRAGPLAGRITEAEDCQCFSSGGGTRVTVVCSPRSLKGMLDAVFPHQIPQPDLCQTSSATVSAEAWLWPADLQSAELETWVPFCGICEILRRGSSKHCVGGHPCRSLRPWVGRPNVYPFPCLEA

SEQ ID NO: 1012012 - protein, 158 aa, Homo sapiens
SGGGAPPPRLKAGFLANQRLESSFKSVLAARRAHRYICCAAVKLDLDIWPGTERQMNVACNTVDVRNKDFPVFLDGSCEHVAGDYLSRCSSASRHLPCSAPAVGRCPVGLMCMLCVRRCIGGMVAQVAAVRAFVYAGTRHVVRRRARAPQGVWAPVAQ

SEQ ID NO: 1012013 - protein, 107 aa, Homo sapiens
ARDDLWRTEHCLQMPQVLTMTVYFSLRSVSSLWEVTVHKFCLNVRALQQWLLTALVVHCLSMTGECLFCHKPVLRPPMYRTQMVSSWLPSGPCPVDLAGSGLWALVR

SEQ ID NO: 1012014 - protein, 219 aa, Homo sapiens
EHPGNISLKGVFKAMKGLGTRDNTLIRIMVLPDNEVDVLAQCVGIFRSKYDKSLYSMIKERHLWLIDTTKTLLKLVWGGDDDCCCVRYFPEAAQVAYHDVGTYEMHVGRVRAERELCAQPMTSILTQMRKLLRKAMKGTSGVDDMTTSHRVSSGTGSNVQTVSRIAADALLGLTVGRELEVTELKSEDLCEDLCKELSSWVLMNANLGRLRCRKQPERR

SEQ ID NO: 1012015 - protein, 175 aa, Homo sapiens
MRGRRSPGRTAADRDGAPETARGGADGSSAESKTSIPGGVMTRIEAYQEQWARLNKTQKSHMQHCWHKRVKHQDAIRQYVTRAIHDEGKMDIIASQIEAVWSERALEKQDNKKLEFDGGHMRKISGGPKRVSTESQYKHVIQQHRQSPPRHKRRTPTNRNQRERHQEIQIGTEYE

SEQ ID NO: 1012016 - protein, 62 aa, Homo sapiens
MPHYTHGYVTTLNPRVRFGYPPKIVPLRGTYTPVCDNLPLYEMEEPYHSSVGHTPFRKGTAS

SEQ ID NO: 1012017 - protein, 185 aa, Homo sapiens
MLQLAVGHRGYTPSGVTCSGEDYERLGQIDVHMFNAVSLRWTKLAPVKSAIRGQAPVVAYMRYGALECVPLSTTQCSCWGGRNDIQKGSCNVLYAFDVSGLFFQVTCSKLDTSDHDMDSYLCKGQACTLEGLPLRHNAGKSHVCRWGPCRSFGHAIPTMRLLNRIRVYDTELRLGWTVPDSVLLE

SEQ ID NO: 1012018 - protein, 101 aa, Homo sapiens
MADVEYRCFAAASPWATDDQSLQNAFSKYGDVIDSKIITDRETGRSRGFGFVTFASDEAMRQAIEAMNGQDLDVRNITVNEAQSRRSGGGGGGCSRRRRRA

SEQ ID NO: 1012019 - protein, 42 aa, Homo sapiens
GIPVKPSALTTTDRHDARRDPGPRSRITTPKKDMKSVSTEQE

SEQ ID NO: 1012020 - protein, 259 aa, Homo sapiens
TAAANWCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGTTTSSPASSRHGSSKSS

SEQ ID NO: 1012021 - protein, 260 aa, Homo sapiens
SCSTPGPSALKPRKPHVTLSHSLLPGLRQQPLANDSLSWKLCPQGIPGANLVSCRYRTVPISSAPGREAGSSPPQLGPHPLLTYPRPALLCPPLPSLPQLYLLAQNCALSACFSAPVNVQMPLQLFPAHTELPTFLTSLRGPVGPRVLLSPSSLSQTPVPRLPSLPCQPCAKPLQRLLGFPAGSGDMHFSLISATSIPPGLLVASLIHFCLPCPSNAPEENTIVVPHAEAVRWRLLFSRGRAVTSNMPSKAHWASQLHSA

SEQ ID NO: 1012022 - protein, 45 aa, Homo sapiens
TDVVSLRVCVSSSRLRSRHMAYRGSSAAEHWLAAGRDQALSGTPA

SEQ ID NO: 1012023 - protein, 493 aa, Homo sapiens
DDTEGCSASLYARCKGNISSLTLKKKQSHTQTLHQKLHTTVRPPPSCCPSLSPASPFRRQVSLTSGHPGAVPTQHLAHKLLSNARRENDRNQSVRNPRVCIYLCVALVSLYIITTKDSDDRTMRRKNRNIHNITTRRRTHKHTHTEIQLTKEVARDRNERSVSAPGVAPNSKCWLLTHCWGVPRGTRKGLLTIRVTQQFERESHSSRVVAQGSFLKRPEKGCVRKNKGNSHGFVEATFVVRRACNTFFLPPRGVGAPPQILFLGGVGPSFKHQRKNSFFKDLPRKLEVAPLCIQLIFFAPFGDRLGAPHKFNGLPFILPFGAASFPYKDLWFSLSHTTRYYFHSYNNIKGFFLPTQRWLARFVFSSLPPHPLPPWDKLKRLRDGMEGGKKEGQKPNQQAEYTDWVGEEVVETSLYSTGLLHHKNDRRGPTTTHRGSAAPTKRARTEQLDSSYESSQEQPATLQSDAPPPHSTPPRARTNRTQPTRTPTADPTQ

SEQ ID NO: 1012024 - protein, 192 aa, Homo sapiens
AAQGQPHSRRKGRSEAGPGAVKGIKHPKACKLLLSAFFPPPPASRGGGVGGGGGGGRKQRFLWRRMQTRMQNFNHLLLTGPSFLSRVWAQAWRRGSLGRERPEQPMPVLGDAGKPSLLCTSIQNRGPRSTCSRGGRVGGRRGLVLSEAAPHGTSRYPEQHACLLACSWVLNMVSRSPVGDPSPVPGEGLSSH

SEQ ID NO: 1012025 - protein, 138 aa, Homo sapiens
MAPVSDCLSRCEPRARMLPCPGSGYSTPGLAAPWAHLHVPRWLASARPWLAGSAAGSRGGGWQGPVAEPLCRPLRGESGSGALGGSRGNWGRERRGPNLLSLNLSSGGSRQLNLGKGKDRTECGAKHFLRDRVFRRAP

SEQ ID NO: 1012026 - protein, 117 aa, Homo sapiens
MAALLLLPLLLLLPLLLLKLHLWCRSCAGFRRTCAFAGASSVLAKWALRARCPVPRLSAAGRVPSPSLAHVGSAQRALVLAPEFLESLEPDLPDLRAMGLQHVGLQAQEPNTCWNKR

SEQ ID NO: 1012027 - protein, 188 aa, Homo sapiens
MSGRTGIPSRIRDISGLLAFLQRSLLKTYLKCNIKNLLAGGLSRLPSAAAPSEGETGKKIKSVELRGSSRQAQKVLGWPQAGRRGKGAPIPQTLYFYLAAFSKILSGLSSRELPADDLPDRGAGSADHASRTCPGGPGALISADPRARARHNVPWKGSLEGAENSSNAASKSKCSDKIDLKQESPSFA

SEQ ID NO: 1012028 - protein, 154 aa, Homo sapiens
RAPQPRIRFLDRQDQINQKMMQATVALSAVLTVAVRGRPAARRRSATVAAGGRRMPGGAVRASAAAAPEADYSSSVSVFPMEACDLVGGEACDAQMYPETKLGAGAGGPAAAVARAPEVEREYLSYDEPKTVFPDEACDDLGGEFCEAPYQTSK

SEQ ID NO: 1012029 - protein, 260 aa, Homo sapiens
MDGQLLLAYLTTEMVDVDEGASSLYPGPEELYLKIGMNTGGRTRNRDIPGKETDWQIESPTWRDVRTGLTHPDWLGCVGDRPCHGGTQTGSPKSRKKALCMDPSISPGASSRLKGSTLCTLDVEETYSGRCMWRNQHLRQAGGPPAWLEEKVMSYIKLDLSSFNSVTDKQVPLTANFIFHRADEPRIPLYNFVATPRTRHTATGSEEIHGKTLQEGDQIPTGMKGKLVGHASKKEGMEKDRGVGQGRVAHYLYNMKHRIY

SEQ ID NO: 1012030 - protein, 153 aa, Homo sapiens
TRARHTLQHQQAGGKQRKHNNQMATISAAAATTVVARAAIARPSGPRSAPAEDEEREGEGSYSKDAKEATPAAAVRGAGASLLAAAGAVTASAGPALALVDERMSTEGTGLSLGLSNNLLGWILLGVFGLIWSLYTVYTSGLDEDEESGGLSL

SEQ ID NO: 1012031 - protein, 159 aa, Homo sapiens
HSYSNGSSRLVAAGSLRPHRHSDDGAGHASKMDAVIDQAVKAAAAAEPAGEAKPAAAAASPAPKKILKKKPVYSMKKGQIVRVEKEKYLNSINYLSVGHPPFYKGLDYIYEDRGEVLDIRIFEETGEYALIAWVGIPTPPAWLPTYMLIKSDKLDYERI

SEQ ID NO: 1012032 - protein, 71 aa, Homo sapiens
NKPTKEGNQSASHSGFHPSIHPFLSLLGSKILILCCRPAMDGGKKGGRDRKPAQERSDRKSGTGMSGDAKK

SEQ ID NO: 1012033 - protein, 223 aa, Homo sapiens
AGPGPARCRLLGRTVGRRRSGPPLCSPSAPAQPAVRAPVAGPTPAFRPVSVRRAPCTLGEPSLCLSVLVPRWPAALGALLAVAEGKAAGLAGDGRPGLRRGAPVEAPSLLLLALVVAGIPAGRLTTSTPQRPVHFQGPADSFFGYAVLEHFHDNTRWVLVGAPKADSKYSPSVKSPGAVFKCRVHTNPDRRCTETVHGSRGRIGGTSLRKDLAGKTAMMSGCR

SEQ ID NO: 1012034 - protein, 85 aa, Homo sapiens
RCFPEAEARGLPAGALLDECVSSCSAQGSVEENNKLMTKMNVSADATDVQPQENGEKGELPQVWVNAKYYVFYDANCRGSVTGCY

SEQ ID NO: 1012035 - protein, 71 aa, Homo sapiens
MAPGRKFSPACNLGALGGMALLSVGIPSPFLPSWSGSPGRVRVRPRVAQCLWPSLFLTLGTRCADNYPCAP

SEQ ID NO: 1012036 - protein, 92 aa, Homo sapiens
MIAHCLALRYLLRTRGSSWGRTNQGVAVIANPKGVCACHTVGSRCYNNTCQLAGCAGGYMVAPVDGAGTARFPCPCRKGGRYVAPGLRFRAS

SEQ ID NO: 1012037 - protein, 31 aa, Homo sapiens
SSAAEGEQRGTLTLTTSRSDLQGLRRWRLPF

SEQ ID NO: 1012038 - protein, 33 aa, Homo sapiens
MHTEIDDELIEKYDTVVTDGDGKIVPMKLRTNP

SEQ ID NO: 1012039 - protein, 129 aa, Homo sapiens
QLPQRQVDLTEEKKGEARKMSGRGKGGKGLGKGGAKRHRKVLRDNIQAITKPAIRRLARRGGVKRISGLIYEETRGVLKIFLENVIRDAVTYTEHARRKTVTAMDVVYALKRQDAPSTDSEARPPSPPD

SEQ ID NO: 1012040 - protein, 52 aa, Homo sapiens
GTQNILGTKRKNQSPAAPRFPPSVFGVPGSELIHCSCDVAGRRSGAPLLAAG

SEQ ID NO: 1012041 - protein, 120 aa, Homo sapiens
MAHNTYTMDFTQQISRSYRMKGPSWTVSMDMPLNSGRNQHAAAHRKNHPSTVQGGTHAKARLKGAANPESQCVLPGKKVASEEFRRIMSLNSQEKFGNKPGDRGHLLEGEVRLRGKRCER

SEQ ID NO: 1012042 - protein, 260 aa, Homo sapiens
RELEAKAGELARAQEALSHTEQSKSELSSRLDTLSAEKDALSGAVRQREADLLAGQILCAADDMRLALMPGAAAQLPGAWAELQGRLAERESQEQGLRQRLLDEQFAVVAGRCCRRPVGILQDALSKLERAPATCGLYRAPQNYLGDAGPRRPWDCREAPWREGATPSTLNLLGRRSPALVAALTRFFPAGCGYHHSIGRCHLRNLGSHRTLAYPGFIEHLAGELLGPVGSGSSLAEGVKGAWKGFWGPLQDHACGGTAP

SEQ ID NO: 1012043 - protein, 58 aa, Homo sapiens
PVKRKEDKRNKYGLGEEESAAAAESERGRRKEPPSSSEMTGKAKPKKHTAKEIAAKID

SEQ ID NO: 1012044 - protein, 108 aa, Homo sapiens
EILNGALRASEERCRGCKKHAYVRLIDGTSSDGLKTRKASIDILPEEDEKMFMIISDDDMYLQKHRSSDVHLAEPRSTYRKSEQRRCPEILTTLLIGVQVARHCVNQV

SEQ ID NO: 1012045 - protein, 180 aa, Homo sapiens
PCPLPCSPSSLSFPSVFYSVHTRFLPDSLPPCFLTSMSLPFGQLPIPHLSPSVSLRHCSLSFLGHPLAPLRPPCLPPGQALLSSMSRPMPCGWLQAAICTSIAIFIRPRSLENVLEYGPGGLPFAPPNTVSLGLTRRLRSNYSLQKPGQRFQQDPEGDPWNTKRMWRGIGSIHPSSPDLA

SEQ ID NO: 1012046 - protein, 254 aa, Homo sapiens
TSELAQLLPSLGCDDRLAGQHVSPLQGSLRPPGRAPNQSWDSPFVRLSGTFFQVKADRDEEAEMPCIQAQYGTPAPSPGPRDHLAKQIALTSCRFYQAPTMDLVSPEARPRVVPLPDFGTEDAGDVQQFYRNCISVFSGASSAKWAEKIPGFADACRPADLGPCCCESAFLAALFILRLAYGSLALARASSSSALCRGATAVAVLPVVSGTGLTGILGLAHRSLGSLLCPMSPGFSWPLLPLVSSPIGGGLLDP

SEQ ID NO: 1012047 - protein, 184 aa, Homo sapiens
DSSLDVRRIASRAGQVVPAAGRRPPASVRLLGVAGQYCLWVLGLPVRGVYCCRGMWSLMVRGAACSPSPLWWAVYLGEEELLHDPMGQDRAAEEANAVLGLDMQGDHMVMLSVIPGEAEDKVSSEPRRRHLWCWRSGGFKVQRPREPFLSGWRLQQHFPDRVRGVLHRASKWRNLYADPTRGLQ

SEQ ID NO: 1012048 - protein, 230 aa, Homo sapiens
MLVLRENRRTVFSSLVRRSSAHEYTWVVEDEASGFLHVRPTRWTLGLLWFGEEEGSLVSTSRVLPEPARSSVRRLVAHLPMRHYAELTEPVSVSRLSGSLYVAGRGSPGLLGAMWCGTPEEQQPVSYALLEVTYKGSSAGMKQNQEKELDGSYRFFQNLPSCYKQITVKGPRDTWEACIIRSLQHRRNSKHLKSILSKDGVLIVLKLRAGQVSVQRRSNGMAKFRGSDCC

SEQ ID NO: 1012049 - protein, 197 aa, Homo sapiens
LRGRGAAAAVVAAACGVWRRSWPGWMSWRGGVLAVCAGGVPAARGPVRSPAWSRAACWHGWLQLCGVWPVVGRLVGMAWGPAGPRYDKIRTPARTTRRCRLEPLSPRTWWQAPWQGILEALRDVTPFDCVKTRMQSLQPDPACPLSQCVGGPLEDYKEPEGLLEAHEGLLNVTANRRKGLAHALYFACYEKVKKDIE

SEQ ID NO: 1012050 - protein, 253 aa, Homo sapiens
VKTPGRPLHSSPFTWVPLGHPHHPLQQPSGASTLRPHPPSTPHSSHDGEHPQLAQSCEGVSQCVALMSCFPSHGAPIRSPSARIAKDSDATYGMMCSHCRKTFSSRKNYTKHMFIHSGAEAAPVRRVLAILLSTRLPAQDTWSRTPALRAFQCAVCAKRFTEKSSLNVHMRTHRPERAALRPPAAKVFSHRALLERQLAGAPCALMALGPGSPTVDPGPPAHVGHARCGTRGSPTLDPLPPELQVLSLPSPFL

SEQ ID NO: 1012051 - protein, 266 aa, Homo sapiens
CVAERAALVGRLYGEQAGAMAFTPTSVSATLPPSAPPPPAATKGTPRRAPWNAAPLAAAAASSTAALMDATPVAHAAAFSKEDVAGSFTKVVDTVDAVIGVGGKVAEQSFVVLRALSEAVKPALPVLQSAGEQALKLASPVVSDASRQATEALQGAGVDLAPFQSAFKTVADAAQPAFGAAKPIASETVQTIGSLEGTDYVVAAEPRFLAYLLLPPAWSLLSYGLRGTKVTWAQLKLWTWSPLKGYLIIDVRTENDKAKAGVPESP

SEQ ID NO: 1012052 - protein, 55 aa, Homo sapiens
EEPHRHPIHFISERGLEAVKHKCSKSCEKEERAAMARHSLLAVLLVGLVAASGFS

SEQ ID NO: 1012053 - protein, 245 aa, Homo sapiens
MAQQREKVHSDLLLLHPEKLDLAVTQQSSQYLAEWRVATGSTSRTHAAPDTHNERNRLHCFPSHRAYLAHSNAYTIEPSAINRPQNPLLPCSMQASDLGSPRILPPYQYLRLGLGGHPHRRSVLRLPSPRPRFSLPAAPTTLHVPVTAAMLNTAIPIGTTLSRDTHPPAHRNTNPHNRNHPPHDHNPHTHHHHPASHNIPSTPTHHPPHLHHNTHNTTSSTTKTHPHTDHPIRTDPPATHTTHPP

SEQ ID NO: 1012054 - protein, 77 aa, Homo sapiens
AGSVGCGGSCTLVCGGGFGVGRSMVHMRGAWCPLNALRVEGVACGSRSWLLCYSRDNVELGLDRGSGPGRSGYRLTP

SEQ ID NO: 1012055 - protein, 158 aa, Homo sapiens
STPQPTQTQLDLTTTVRSSGGRRRPYRTMAMEGYDREFWQFGDQLRLQTATFSGLSLGDSIWSPRRGRAQSARKRGRPESRRGRPRGPKEERRRIDDARMNEQAIIRGAAFIRAHGRSCVRYGAQQTPGRGRNGDGQTIQAPRRTAGEQRTEDKDNGL

SEQ ID NO: 1012056 - protein, 272 aa, Homo sapiens
MRSVAVSAQLWGGGRGPCADVPTPDRSTAGDRRAVEEERDSSSHRISIETQATLGQGQTNPEGEQEQEEALEDPQRDLGHLHTTRHQVLHERDHQETHARRQGTVRDQTGHPEKGIIEEALAIELRPQGANPQGLGPPRKATMGVRRCAQERRSVATQLRKPRGARKWGPPIIEPLYPEDHHRTTEPYGTNGTTEAPCQEAEDGIEASREPKGEHSTTTIHAKLPGDRRAALAEETAGETWRNDCHEARVTARARETGLNRRTHSHIPELIT

SEQ ID NO: 1012057 - protein, 182 aa, Homo sapiens
SGTIPPRPRAHTSAVSSPPGLRRRSGQMALDPSFAIPGGASRREREGSKSCAENTRRLDIHRERCYARMTQARATCRACIRGDTTQCTTSSKQASVPSRPPKILLKPRRVSHRTPMAPSGLEFHVQIPGHNTSQSDCATQTGQASHRDIITYACPEADHYVQRKRYQAAYPAGEGPKPQKKP

SEQ ID NO: 1012058 - protein, 132 aa, Homo sapiens
MADHDPELEAIRQRRVQELMGQRGGAASPQNAGQQKAQEDAKQEAEERRQMMLSQILSSEARERLSRIALVKPDKARGVEDVLLRADKLVEYLKKVSDRTGLSHFWSKSTATQANKTKVTIQRRRNVLDDDD

SEQ ID NO: 1012059 - protein, 227 aa, Homo sapiens
AARLAAALRPGCIAALPCPREPRCRVRPAAGRPEAAQFLLAWAPGGAPSWGSVAEALKPALPPCWCPSVPLPVRLARPAAMARPARAVRQALPGHYVLAAWLRRARVPTQSATVVNPVPWCQSRSCFPTFLVEPRRMCPSVKQPRPVLLVLQGRARQRTIFFRCNGEWVRQGGPRDRGAAQNGTSVSLPHHGGSALMSSRQQVEKVSGLGGHTWCQCVGTGAPSGRP

SEQ ID NO: 1012060 - protein, 183 aa, Homo sapiens
MKRRRRYSNVSAEMMGVDARQRLEMVLSNMKRVQEIFLKFQMTCESRFPRCRSARVLTAGSRGTPAGRCASVSCARPSLRVREEEEGPSVCGGQAALDPTKAKRVTGRLEPRSPRPRGPGGPSRQEARGDSRTHQRAVPGKKPAARSPGRPQGSPRKMCARTSRAVQGPRKETASQGGIQVGA

SEQ ID NO: 1012061 - protein, 210 aa, Homo sapiens
MLAGGPSFTKRFAGPRFLCLLIPRAEACPVHSVWRLAPGGSCSCGPLRRKANRGGDMVGPQFPYSPFVRRTMALPRGGCSSPWPFATVGRCGAHWPTFPFLPTAAPLEAFALRSLCPAISHVACSPPGFLRIPQGMVRAWGDWGPIWQGVVQAQPGKRGFSFLPFWGAPFAHSASVSGTPVRAVTAGILGAPPTVALIPFPEIPLATTSL

SEQ ID NO: 1012062 - protein, 101 aa, Homo sapiens
MVSFPHGHELYPYPVGGPIPRTWVSSECWPGRGVPVLISPVQRYVGRLVKQMDVSVVEAMDGKTALRWCMYLRKWVGSHKIGGFPMWGFAPGLVGTFSEQG

SEQ ID NO: 1012063 - protein, 279 aa, Homo sapiens
SSKSLARPPYGPRSSTHGIHDHGRRSRAVVAKTPFLSGQAAPPAPPPLRDIAAAATAESPWATTCGTARTASMYLGPFSAQTPSYLNGEFPGDYGWDTAGLSADPEAFARNRALEVIHGRWAMLGALGCVFPEVLQKWVGVEFKGCPSGSRPGSQIFSEGGLDYLGNPNLVHAQSILVLLGFQVLLMGLVEGFRINGLDGVGEGNDLYPGGSTSTRFALPRTLSPSLELKVKAHPEWPSRHVSNVGVFVQAIVTGTGPFGEPVRPPREPVANHCMGFRN

SEQ ID NO: 1012064 - protein, 267 aa, Homo sapiens
AGSDRTDSTAPQPGAMLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRQARGAQPARAPCCSSTTATQCGLRLLCAPQYALGAPGATFSGYLVYADADLLTRLRAGRRPPRAALGFSGRARRRLVGSDAGPGPRHQPLAFDTEFVNIGRATSTRRPAVSRLPSARAPTSSPSPLASLPRKNAVRFKAVT

SEQ ID NO: 1012065 - protein, 130 aa, Homo sapiens
EQVRLDSTELKEGTKTSVNSATLSRILLAVAGGFQPVKLRGCCLDPVPSRITDLGYKRRRATQMGRSNAAWSTIRDPKDYPFLHLLLLPLTRNLQGFFLGERLPHSWKIPRNLSKHEDSNVPLRRYCTMC

SEQ ID NO: 1012066 - protein, 181 aa, Homo sapiens
MAQSAPVEAALPPRAPDRCWDPRRESGRHFGASRVRRTPGSAPAGLEGGLSEAPFRALLLSRSFGTLPRAWSRARHRVLPHSGCLVCPSRPAQLLALGALPFSGSRVLRSGRPRNAATVSPGWAPPRRPRAPSQATRNVQIEASANGKAHSHRPPLEGALTQYSYGESRKPTRAEAQWQRR

SEQ ID NO: 1012067 - protein, 76 aa, Homo sapiens
GIAHVPEAHADRRRRIRARLAGPVTRLHVGPSPEEPDRCGNLLCPPRDPGQEGETIQNFLTGVAVQIVGKEKRVPF

SEQ ID NO: 1012068 - protein, 309 aa, Homo sapiens
MSEQEAQAPGGLGAVPLDMLAEQVELWWSQQSAAARRLCFVVACGPRGSACGAGRRGTCLSNHLAAAQVNGRLSTRGNCALFAGSAGSGEPGLMSSGCARDLELASGQGPSIVGPCFAHVLASVPYGPRFDWLPASRCAPRLPRLGSPWGLESLGPEGFELSCVVPPFDAAGLTGQPTHICAHKPKLGTEIPTARGANFWALHRGLMPHYETEPFPGTVSIGPFGPLYVFSGSPIRLLGGRYDVLLSEMGIERGSYGLENARGNHNSFSGASGRVLPAFTSRGYRSERPRTASPPLYPLRDLSHGSSGV

SEQ ID NO: 1012069 - protein, 247 aa, Homo sapiens
RRSRVVPEERQLCSWAPRSPPTRLLARAPLGPPAPSRSMNYLRRRLSDSNFMCNLPNGYSDRPAASASRATTWRLDWRTYLIAPELHNDRDPGQRAETIGQAKKVERMRRNADARARLIGREHQRPELSTTRDMKKRPKKATQAKPQTDKRGHMNTAKRTTHTERGRPRSKQDTRCGGRDTRVDTTETYTAQEIEPTAVHRYRHTESNPTEHVTHYGRNRPYERTHSDEDHNTQTRVYLNNMAWHIP

SEQ ID NO: 1012070 - protein, 183 aa, Homo sapiens
MHIYETPKTDVKAPPALGRVLSKSTGAASRTLFLERIPMYLEILLGNMMVRPLATCKVQGGRRTKESHKGRQGQVPAMERQALPGQDTHGDEVQDGPRRKDMLYFTMVCSLLGSQAGTHCAQGPKRSPTAHTTSSYIGCINTCEHTKQTKRTRTQRKTKHNGQTQQGHTGDIGTRAHTHKPHT

SEQ ID NO: 1012071 - protein, 147 aa, Homo sapiens
MTPVQRGGPGGPCVALGWGTAVASCGGFGSGIRGRGRWPVDGAGAEAAELAEARPTDKEWMPVTKLGPLGQRTLRESMSPWTEDLVSLLPCPLHGIERSIEFLPWGDHLFKGDLTVIAQRFIAQLPGKTRTPVTRDPSGQHRDSKGQ

SEQ ID NO: 1012072 - protein, 189 aa, Homo sapiens
MTEGNPEHEDSTRYQERASYTPKTPIIYCYMLTKSGRSQVDSSPDISAKKPGVHSNKLVRVHLAASIQDPSCHPNYQSQLVPTRVHESVRTYQYALTSLTTERTPGMSTKERHTGVKRGQPCTEKGGTPNGSHGCPEALTRHPVGLRIPQTRPNHEGRHTKEITKHHDWIQPRGWGKNARHGTQVDKAK

SEQ ID NO: 1012073 - protein, 161 aa, Homo sapiens
VRVSGVSLRVSPTGRPQTTPAARGTRRPPQDPGPSARKPLSCFSREAKMPTLVSPPNDSAGSLWGAPCILTPPGAWCPLVSLTGRGVPRPGPLVQKIEPLQFEGLLVSLTPRFNVTDTRFLWQLQGLAPRGLKTTLPRADLTWPLRLMPGTPRRQEDHRND

SEQ ID NO: 1012074 - protein, 220 aa, Homo sapiens
HAAAGRDLGTQLGSQETRAASPSRLSDSPDRLARPPHRPPTLPSLTPSLFPVPPPLPDPGCHNHVRGGDSRESRLRITSTFGCTTRRSRAVMEARSSRFTTGSTWYRLMRSEHSYNTKATPFADLTFLSQDKPVLAMALDLCSRVATFDDGLLGRTSKHEVHRDGGSLPGKRHPRNTLAKAKPSSWGDLPSSASDVARDGVRLQDDSTKNRSNIPVTQTG

SEQ ID NO: 1012075 - protein, 295 aa, Homo sapiens
RARRDSGPEPGPCRNTRYRNKRQMRIDSWQTLHCPVCRLRPSASGSLEPSPQSQAEDGLEPVLCSWGWYQRVPVKDTGPAPQERGGGELSDSGCLRVLPLPVASAISGSRPSNAFYQMSCLLDHGLLLLTTVHLLPAMAVSPPWTKSGEEGPIYWTQRDQHTGQGPTPSLLVDEATVNPVLWVPRAFSIGAVAWIEQYLLVRPCASSLISSISIVPGRWYKDQKAKPDSYEDMVEFVNAGCALCTASGGRGKSGLELQVDLGARGDLALVLPARGVELGLPGECAPCGMASCIGE

SEQ ID NO: 1012076 - protein, 258 aa, Homo sapiens
MAPKRGGKAPVPAKKKTEKVTNPLFEKRTKQFGIGGALPPKKDLHRFVKWPKVVRIQRQRRILKQRLKVPPALHQFTRTLDKNLATKLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKVGVVAVMGSQVASEDQGQAKGLSQRELRSG

SEQ ID NO: 1012077 - protein, 336 aa, Homo sapiens
SQPEGVPVWGCSVAGGNGMCQCLAGAAERLCTWCPRLVVTGFQDVLGAGAAHPHPPRPTPPGLMPPSCLWEPPPVLLLLGPASKAAGHDCPPQPGMPPLTWDDEHTTGVRCKARCPVALLDHEGVGFASYPLSPRDTRPQCEAWVAWTLGANQAVQTCPQGTIIFCFMLRVADCPFSHPTDMLSYSATRRGAGTLGRKPTEDGDKRATGVDQFHLLCKRSYQSSRTITPPHLMFRGACGEQLKVTSNGGEERRRYSGPLQTWYIGEGLQHPDGRHRVRVQLGTSTHRVGTLCDWPHQLLPLKRPGGTCGNPNGNMQNVRVSIPLTGHVFPPILYKL

SEQ ID NO: 1012078 - protein, 182 aa, Homo sapiens
LVLCVTTPLPSSIFIFLPHAELDQGERGRRMENSSGREVLPNGGGAGGMGNGAANGRAVQALQRSFAEVQAILEKNRILIQEITQNQESLEAGGLSRNVALIRELNSNIARVVDLYNALSCSFSSSLTNGSAPAASDASKGAYKKAAPCPVEETDRQRHLLLCSDLDFCCGHPWPGLSGRQI

SEQ ID NO: 1012079 - protein, 226 aa, Homo sapiens
SCAPHAPPSQTQASGRTKSSSSRPEAAGGVTRGMGQWTFQVSCAVEQPIVIGLAADSGCGKSTFMRRLTSVFGGAAEPPKGGNPDSNTLISDTTTVICLDDYHSLDRTGRTGERCDRPVTPKAKRLVISCMSRCQAIKEGKAIEKPIYNHVTGLLDPAELIQPPKIFVIEGLHPRYDERVRELLDFSIYLDISNEVKFAWKNSERHGRAWASLESIRLASKPGNLI

SEQ ID NO: 1012080 - protein, 155 aa, Homo sapiens
GLFLFLPDSTPAPCEERVNIFVLFICFWRWDGFVSSPGGLIWPSQAGCSQQPWLGGLTPFPLPQAVISPPRPSPLLSFADVLFSLSRPFTPSMYSETCRRDFPFWSRWLEIRGCGQERKAPCFSFVRPASGFSAVDSPPVYLPSAIPAKGLRKFN

SEQ ID NO: 1012081 - protein, 136 aa, Homo sapiens
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 1012082 - protein, 52 aa, Homo sapiens
ETRDLVRLLFDFPPFLYTQEDPGKSGDHTVNPRRRGTLGIVSPVAAVITAGA

SEQ ID NO: 1012083 - protein, 41 aa, Homo sapiens
MALLTTRTLSLRQRPVVEASRQAAKREAQRKRERHGREREV

SEQ ID NO: 1012084 - protein, 59 aa, Homo sapiens
MARPSSSPMATRLPLLLVLLSSLALQAAAQKYNAVYSFGDSITDTGNLCTNGRPSAITF

SEQ ID NO: 1012085 - protein, 37 aa, Homo sapiens
MHMGFLREPMICSNQNSVVKTLILSRPSASRFGLLRH

SEQ ID NO: 1012086 - protein, 269 aa, Homo sapiens
ALVFALLPQNCRSCDGRPLRDFLAIVYAGLFFPAPNSWVGSVCLKSLSSQSCTRVPLCAVLDPTAGPFRTPSQERTLRTSGVETPTCVCLSSFPYSRSVLLLPTSAVSWSRWFRSCFLFLRVPPDLVGGGLSSYSRCPLVSRFVFWSTFSFSLVCSSWPLLIPLRGRLSCRPSCEDLLIIFSRTSLVLDFGLVRLKGLTGWIRDMQAMAPGTDVTQVLEVSRVHLLSRRKVKLRREALTLEPAPARLPEPVLTRALASDDACAVGPAGA

SEQ ID NO: 1012087 - protein, 88 aa, Homo sapiens
SAIVSKLEAVAKTLNLREEKDNGVVKMQVRKEGRNGVLQFDSEIFEISPSYHLIEMKQTSGDSLEYQKLLEESIRPALKDICLGMAWS

SEQ ID NO: 1012088 - protein, 214 aa, Homo sapiens
WPSLGPRGMTVDHQWPAGPPGSKVTEAKTGEKGPAGGRLGSWGLQGPVGFLERCVAPRPPMRTPWSSWQPRPLTKQPPRGALYSLQPVYETKTMETHRLASAICGHKVLAGVQGPQEVLPLESTKWFHPLSRPKEGPPQEKLPRITRMESQEAHELGRGQKGTKMGAQSRSETVGLVDNGGGHMKRDEEKAQHDFDKKVSAQGRDQTDPEQNGH

SEQ ID NO: 1012089 - protein, 102 aa, Homo sapiens
RSPSPLPVDTLPAPARSPSAAAGGQSADKLGTGERLDGDGGAGALCGPEAELVVMRRMHLSERRMTLFKNAWSAVQEVSFDDPQEEAIWGCATSVAYDDRRL

SEQ ID NO: 1012090 - protein, 116 aa, Homo sapiens
RSGGVQSERCAVGRLMGAHARARWAIWCSSQSGTLIQLVRHESCNQPSSNAKSDRPIEEARERSKLPSVAASSYSGSDLSKLNETRGVFRIGPCATPASHSWASLSGQSDSRTSRL

SEQ ID NO: 1012091 - protein, 294 aa, Homo sapiens
AGAWARGLCHAAAKARVDSLGEGERGRGVPWAVFGGGWGLRGWLGQSPWCPGPGLLTLLCCVFPRTPLCAVCVSLSVARCSACPWHVLHWCPVRKVVHFSDELHVDVASLSAMVPRSNVLLRDACETLGVDYVLADFARRTASDTSKINRLMPRTRRDSSGCAQFHIVETCCSGVCLKQLVYAGLPYAMWRLSYDEGFLRDNVSRIRFTERELSTESSANTKCLPSLTEPLIEAKEPAELVDTAYRFHAQNMTCMMQRGQEYNANEIHKSTHVPELGARSIGIHMGLIARRLSA

SEQ ID NO: 1012092 - protein, 109 aa, Homo sapiens
MYRFAQYTGLQECATIPANFYISTFAYFGRDRRSHHVAQAGLSNLGLNVIHPSRPPKMKDLWIKFERISPGDKWVITCNPSDFMQRWVHQLSAMTFKTSLAKMVKAHIS

SEQ ID NO: 1012093 - protein, 383 aa, Homo sapiens
AGDEPIAVSRERAVAAPGRGPEGEQILTNGPMGAAIATCWASCGPWSAAAVGYCDDCSRCLDPAILMTPGLQHPSTVVQVPRVAVCSPDAPPGGRPMVPAPGAPRDAFGACPSDDCALRHLCPPTRTMGRPGPAKVGGKTALARARGRIRCDVEGRGSLGPGCWAGRACGAPDPVPVAGERRRTGVGFDRSYFPSLLRVGLPRAMLAFPLGVRSSAPFAPGSTTVTMNAPTLATRASQSDAQSGTLPIRMSESKSRGGSGTDSPPLGQGAYRCPNSTGLPTQCKMPKTNPGWRAPWARNLPVNSFLWRPSKVGSYLRPPGWQRNERIGTGGLTKYSVPPQSAAKRQFWPIPLVKKGADGGDWHTSGRREPISCSHCSPARYRN

SEQ ID NO: 1012094 - protein, 142 aa, Homo sapiens
EREGKGAHAGRRGVPALRFVAAPSRHPGVAPVQLDFGCLRMLLTEETQLTQAARRYLFGSAGVRDSAVACGPASSWPLVQPPVAGRAHAPVPRLVRGLGAAVNGGSARTAQTWARQALLPRSGLAVIDGHLALLSCPGLTSW

SEQ ID NO: 1012095 - protein, 76 aa, Homo sapiens
MTHLKIYAVRKYTQISTCVKHNKFMCRANCTRNSQICLRTRDVIRHHPPIGIILTRRSTMNGCTHNQQNVYISYTH

SEQ ID NO: 1012096 - protein, 118 aa, Homo sapiens
SGVTLDSMSKSGVRGKKAPGPGADGSPPSVDSDRLDLPISVSPVQSADSCALSFPDQIISHLSGLHLLHTCKVTLKDALLQRVLSGNVLWSTLLRDTSPGYCVEAGAAYVYLYASNVG

SEQ ID NO: 1012097 - protein, 184 aa, Homo sapiens
MVEVGEFDDECTSETARGGVWRKTSPVQNRIALTNSGKVLPRLDENEQHHVRVPWTPAVVTLTSIGESETGVQRIDRDRDLCEPLCLTDIRIAQLKVWTLEGAPKKGPRASTVDYTLCLVALHPALICDAEPDPISLLRMLGLVSRTSWSPCDQRDEDKHLLIDKQKLRVKKIHENEKRLEAGD

SEQ ID NO: 1012098 - protein, 105 aa, Homo sapiens
MSMNSKQWYPRISRRTVQVGRLNLRGTFSETLCEVLSFMETPPSLPSMPSEPSTRMGTGALTSREFIVRSVHQAPGGSLEHEARTGPSICMTWMVDGHDRPEWRC

SEQ ID NO: 1012099 - protein, 137 aa, Homo sapiens
MADAKATTAVTLRTRKFMTNRLLARKQFVLEVIHPGRANVSKAELKERLAKVYEVKDPNCIFVFKFRTHFGGGKSSGFGLIYDNLESAKKFEPKYRLIRNGLATKVEKSRKQIKERKNRTKKIRGVKKTKAGDAKKK

SEQ ID NO: 1012100 - protein, 256 aa, Homo sapiens
RNSGRASASSEPGGSDPADLETGPGGWLVRNRVSLSLKVVMGSMLLRPSCAGPAGFQLAATGCWCLDPDTLDQAASREVDVEVVISDGALVMKTGSPMGHRISGVNEDSVNIYSECKRLCIVSLQLRREPRQLTWLMWSGNRMLDLYAQISSVPIGYMPPDLLKLDPNESVNNASMYVNRPGLGILPPENFVEKLRQSLLSVAPKGMSQLITEWPVGSVLRMRNALETSFMWYRSKERGQRGFSQEELETCMINRP

SEQ ID NO: 1012101 - protein, 415 aa, Homo sapiens
RVPGAPEALRALRARGKRLGFITNNSIKTRAAYAENACLLPGLLAGPRWGPAPAWMVFCARAYCTALYLLPSALAGRPLVPKGLRAGQAQYLSPERAGRTVGRRQLMERGGPEDHVKDRRVPRDDWACSGRPNGSPKQCRGGWMDEALDPGHLPAYQLTGSPKGPLSDLPLQSQAPGLPIESAGATHTIWTNAEVSSALKEHGHRLSNSAGRDSPDEPRPTRGRRDGKKHLLKRSASDDEDEEDLTSIAHMEPIYETTEGYPQWWTPPTRRINHERMEIHSGTQEDHDVEENGTQKHRNRPTRELPKHVHSSRGKEPPIEPRGFPNVITREQTAMIVYPPEGVNVTQCRRFYTAPREGRTTPWHKISRLGEEDPEGPLGTERQNEYPFHLYEVGHHHLVCERLPTNEPKYTMDSP

SEQ ID NO: 1012102 - protein, 137 aa, Homo sapiens
AGGSSRPGAASVRASLSTRRKTRLSYGTLKKHPSVRGRALQAHVIGGCSVTALRGEILSLVLERPGQTSMPKAQEKVRGKVSSLVEKVYERGQREGRSLGFTWWNEVRSLTQKNSEDVDLKLIIAVTGDGSNDRTAG

SEQ ID NO: 1012103 - protein, 79 aa, Homo sapiens
RRPRKDQSAPPLIPEVSKPLVGRGEQAFTMAVAELWETLKQAILAYTGLSPTAFFTAVAVAAALYHVVSGIFAPPPPPR

SEQ ID NO: 1012104 - protein, 340 aa, Homo sapiens
SGLRSVGRAYGTHVMNLLPRVVRQVLRAEERAQGILPPAARPSRSWSSSPVTVSPRGSYRSCGSCQPPLGALTGMSCVIGAQMLPSGKAGPSGRCSAPRGWTRASPGGIPCLTASRGPIFARETPATRQALGSAGSPLKMLQGVGIACGPSIEAAGKPTLGQQPLFEENKTFVEGPFPDVDRKGAAPAQRGSNAHENKPRVGRGTAQGSFGLPFKRPGGGRWRHRCRSARGAAFLAEFDRGLPLHDFFDTLVTLRPFLPLPSPRLPLVGRIGKGKSKGFNARPDIIPHQVPTKRAPFLPGLFQHGICPSANVGARRSKKDNYLFQPVNSGAPRDINQTNP

SEQ ID NO: 1012105 - protein, 100 aa, Homo sapiens
MCTGQWNRTLRFVENSDRAKLTFRLWTPVNNPEVPFPRDMIDLEAIVLTKIDNELKEINYNIQEALKRNFLELAELQFILRRTQQFVDEMADPDLLEESS

SEQ ID NO: 1012106 - protein, 141 aa, Homo sapiens
METEQQQKKPYPNTVNQSGEFGRDALQKIVEEERSIEKSLETTDEMVEVDSIRAFRAKNAGASDWKRRLRIVKASPILDYNASVSVTRRADGPEAHIEYQLLILKADEEKILTRKIIPTFGRRACECANHPSETSQLPLDI

SEQ ID NO: 1012107 - protein, 264 aa, Homo sapiens
RGAGAWSLARRVVVVRSLVCACLSRGGREAGCAIAFLSPARLCTWALVPSAGDPTSLEESARSRPWKVGEHSICRIRKNNCHRSSRVSRARIVAGTPGCSMGNCKIAGTSGSSRDSGLGFLPFDVFHLDVRPRFPSSVSNRLALSSPQHVSLVSRGRDPLHRCRWDFGEHPGAAKGALAPSLVVRGPVFVHRSEFGDTNKEEDSDSWSSLYGSIAVSDWRLRERTITIPFSLSLCHSELGPDNVLASMRPLGQIGFRSSSLGVV

SEQ ID NO: 1012108 - protein, 247 aa, Homo sapiens
MAGERRHRNHTNTEKKDREREEKKKGRKKRRREGGATTRQQGDKKGREREGTDSESSRKEQRNTNTREKRPDRAGAQHDLAEEKQQRDAGETARQKNNGDERTKEEQREREGGQGEERKTGEGRKNRKETGKNKARREAGEAKHRRRGNGQRKRKTRQEEQVGTQRERGRETRAGETRRAGRGGREKGRERDQQAREKEGSSEGKQQRGGEEERQKGREESKRRGEKTEDGRQRGRRGQSRGGDGEG

SEQ ID NO: 1012109 - protein, 411 aa, Homo sapiens
MADFDSYEDRAYCSFGGGQRVHACSCWWLIGFPVSRRSSATSSPRAYTVISYGHMLPFRYGFMGRRKDAYRVKDSHAIQRSCTAEVNETKDNLIEIYEDFWLLVEFWIERWGVPDNGSALSIQTWVALDQERIRVPLCTVVCGPLSHEYGRAKQPHAYKGACAWWRNFLGIDMGSRTRGNLNHDVGLYEVGIRTFSFTVSEPEGGRGQGPGRPQGTRSPRGLRHRMGRTLSRWGLATAPELKPRNEVGRRRNPTVGRSEDNPETHSGQVVGRGKKSPAESQGHMEREREGKADYGKGTPTRERSHGRFENIATGDPMVRGWGVSRSPTISWHNGEGPQKIRAKIFPWHKFRIHEGGEVWPQGVRLSNRKSDSGSAPTQRHCGRDDREKLDELFGAVYVARERGKLGGQYAR

SEQ ID NO: 1012110 - protein, 106 aa, Homo sapiens
AWVGAARRSEALAGVGAARRRQGLRGAPRRPVQFLADGVRLPAICLLSLVSCSPALLVPVPSAGPPGGRWAMVLASPPSKDLCLVLSSSLDLSWWWAGLAIFSCVL

SEQ ID NO: 1012111 - protein, 103 aa, Homo sapiens
SGPTWSRAPDPCCSRVQDSCGGAFSSSRCAELSSPHARRVCIWSLAPRSSRGRLKPNTVPGAACRRRRTLRPLPNQQVRDADMHPATGKWICAFRVDPSEDHR

SEQ ID NO: 1012112 - protein, 39 aa, Homo sapiens
MERDQRVQDSERQRENTTFDAETAELKVGNSDSEAQNSR

SEQ ID NO: 1012113 - protein, 84 aa, Homo sapiens
RARPAGPEPRRPAQYPDRTQPTRLYCRLRALPRGLDDGLLRPDKRVDKDADSMDYGGVVPAAMLQVNLLACGIYQLRSVGGTET

SEQ ID NO: 1012114 - protein, 283 aa, Homo sapiens
MGPSLGPCRSMLSGPAGRFRAREKLAHVTVLIAAETLSDGRRWPLTVVPGTPMTTFSAAQWHLSTDAGTPLPFRCTWGRRAPAGFQLIALAPLRPAPGLERWRKLWFSLRFPGEAVTAVPDQGAPYRKLPGDRLRGMRERPGTPSVAGCPTSAGLTPPGGGETLGKGGTECAPPEEAPRTRRVEGPPAAEEYPPSRALWQRGATTGRAVRADTPCRDTIQEEPPLHNSILNSPPGPNPPETPPILSNITHQGKASNYGGPGYRGAEALTSTKSATQLLRANRE

SEQ ID NO: 1012115 - protein, 98 aa, Homo sapiens
MVTVQERWEGYNSTGVKTILPERHTVHIHKKTFNLEVGQPGMYDISRAHRKEETYNGRVTPPQGSVSPLEHGTTRGTSHPQRNDNPHGTKLQPRAHKS

SEQ ID NO: 1012116 - protein, 178 aa, Homo sapiens
AGIQPASCLSGAQVLGPLYSPALPGLAVSCSSSHAVAVAPGCLSCCDFGCGAKQGLWGCPPASWAGTEPETQEQQSRSKRGTEDEEAKGVAPRYVPEECAEIPPAHITLLGLIANQAPRWSTRLLNPTKDGGHPKTVGRNSRGKLTGCTRARGYRSRTPCIRDRELLTGLMPSMLLAL

SEQ ID NO: 1012117 - protein, 187 aa, Homo sapiens
MPLPTVEIDNWDYTHRDACVQANAKDSAEASGAGGGLLDCITCGLHAPLTCVMLHHHHRVPADSSIPSCDDDETCVVSIVCAYQRTLLRTGCPARLPSLGCCHSSQPLTRGQQRGNDEERKQNGQKKYRDERYEAELQDIFNDVLELLDKYLIPNAYNKQNSPVFYLKLTMEIIYGYLSEVASGRQR

SEQ ID NO: 1012118 - protein, 119 aa, Homo sapiens
MVVCKGFVEDLDESFKENRNDDIWLVDFYAPWCGHCQKLEPIWNEAGLETETACGFSRLRLEQMVCYVRYSMHLLQELWQFDGYPSNYSSLQGTWLIIIRGPRTKADIIEYCSQSYLGL

SEQ ID NO: 1012119 - protein, 175 aa, Homo sapiens
MDNVFGGRSAEWGGTDVPCSVQSRVVLEMLERAKMEGGGLAEPCSCTKWLAWEVLALGWTSPDYYEQHAVYFAVLRFSVSHRVRRGERDDRPFRIVLPSRNRWHECEWYYTLQRAAVGNISIHLVPEATVVGTSMSYSFITDGESNLPMCLARRAMRRRITTEETTSPLGPLEAA

SEQ ID NO: 1012120 - protein, 147 aa, Homo sapiens
AEWAVRAETVLEAGAIRDRRCVLMRRMALSRTIIVVGAYAGVIRYSTQTENTASATIHGIQMPTAFICSRLCSNRNRVLIDHSNLRQSETDDWDVTTVTGLFWEMMSDTCHHEERDEKSGRALEILPLGKERGCPSQEKNTYLYLLA

SEQ ID NO: 1012121 - protein, 60 aa, Homo sapiens
MSQWPSPTSAATQPSTVTSRAQTHASVAATDCMGTLARGPTLQFLETLPKYLATDYAPAD

SEQ ID NO: 1012122 - protein, 79 aa, Homo sapiens
MVPQKGRGGKRFPYLQLFKPPHGAWAPPPKEYVWRRSQRPWGVEGSLEEARPLIRRKLVPQYTAFAKHQTPPKRRAQNV

SEQ ID NO: 1012123 - protein, 231 aa, Homo sapiens
AGRRIVASRRQERDAQGSRDPPAHTHMHTLRALTRIHTPSLPRSPPRPPSRSRALRSGNRGRSGDLEAAEPGDAGPERSRARTARPGRLRHPQALRLQCPQAERATESSPGWALPSCTPQTPTQPEVSHRGGPDLEPGALSPETMLEDLYDHDLATLSLWGYTAFSLHLQGSDSIQLLDQLTKSTPDPSLGQGDFSSFGTQQGHSSSQVHAWDRDRTGCRTPGPQRPSLFA

SEQ ID NO: 1012124 - protein, 68 aa, Homo sapiens
RRLVEVVAAAPQCGEDGAAVAERGLKSVVWQKYKPGLMTCRKSEGRLDDITTLSLLAIQCCQKLNNSP

SEQ ID NO: 1012125 - protein, 32 aa, Homo sapiens
MRLSPWGGGADTHIRVSPNPLAAAEKVRNVHP

SEQ ID NO: 1012126 - protein, 208 aa, Homo sapiens
MRGMHRIKRTTRSELSSARDRWSDLIMEVVTSCVCKGFQKSCVLETMNGLTESVPIRSMHDSDMRAQSFTHNHCTWVLASCNVPDFRLCEKALCSTSGDPMLVITNDAIRYQSIDVAHRLGGSRRAFIMHEDNAKIPPETRLTSKSTARRMPEKDTTGPSTKRKTRGHSEVEHLPRTMKFTTLGSFLPDPIATTAQGKKRRQPYGQFP

SEQ ID NO: 1012127 - protein, 129 aa, Homo sapiens
RVHPGLGVPMASRVLSAYVTRLPADFAAAAPGSGCLAVARPLSSRYSAPSGSPDRGSGLLQPALVLAHRSWYSYTARAVSIRDSARPLDVYARASKDPCASERYSKRRIDEENLSAMKKCVLHVEVLSY

SEQ ID NO: 1012128 - protein, 81 aa, Homo sapiens
RDVRVRQLPSCPVPSRCCWSLDSLLPGPGAAQNEPRIVTSEDGHIFCEQPLYSHVTLQCNLTIQTLTPLHTATGLKNGRWN

SEQ ID NO: 1012129 - protein, 136 aa, Homo sapiens
MRTYRLRRKNSMRQRTMLMLCLHNKAERWYTHRSLWNTYDDSPMAENLSRVGVLASLLKFEKGDGQYTTYLDSLSASTTVDIGCEKVNFVIGLIRDSCLTWINLNTVCECYSTKDIIHRHTFLDFTWTLAYFEEGV

SEQ ID NO: 1012130 - protein, 123 aa, Homo sapiens
AGDDPRPLLPGYWGLCLSAQAAVDSTRPGAWCSSVDSSWRPTEGFPPAGVRRVWLHRTIRDREGGTGSMWTRSGAPACPGVHGRDRLPVPEAVTEGAVRKSLAPEDLGKTKHVSFCKVETSSI

SEQ ID NO: 1012131 - protein, 125 aa, Homo sapiens
MATALLREKAQKLNEQHQLILSKLTEEEDNKYCADVRGLRSSMGFLEYWCVVLRIRCAGIHRNLGVHISRSNQSNLEPMDMQNTIRCVRDMGNATMQDYSMKPIFRENFRRPTEQIKQWNCSHQR

SEQ ID NO: 1012132 - protein, 216 aa, Homo sapiens
SGGFPMLVLKSRPLFLGRPVDRASAAETMSADGAWRLMAATQVTVENRYSRSPSVVDRVASYASDQLHRADNGVRSLCLHRRQSYPHIKTVCCTATREGSDGPSTAAAVSGASADPLHSWTPQIASRQRIQPTRGLDKLEENLPIPAAEPTEKVLADTKELVSSKVSGGPMRWCLRAKDTVGHPMCRRRWTRPAVAVQSGRGQDKVRNDRRVQSVM

SEQ ID NO: 1012133 - protein, 205 aa, Homo sapiens
GRRFGEVQRVDGHVLVNRGDEHLVADRVAEGDRGAELAGSLDEDDQRAERIGPDHRGDDHALNCCHRLAPATCAISSCEAGIDANALRRIRERNGNSSAAMMKPIPHTELMADRTASPSMGPKSMSATPRRRVKSIHAIAAANGGVINGTMTSTSTHPARRMGVQERKNASGAANRVAKKTTRTESQTVLRMTRSISGRTRLSRA

SEQ ID NO: 1012134 - protein, 101 aa, Homo sapiens
SGERLRHPCRHADLYSEGAAGVPTCRLALHDLVAIGEPGGRTPLTTRGLCSSCRQSLVIQYSLCHRKKSQAGFNPPQVCWDLRCVKPNTSLERKDEIGMID

SEQ ID NO: 1012135 - protein, 68 aa, Homo sapiens
ERDGGFPLLTPALGEEVRSPRGVCQSWYTVDHIEEELYACQRGCGLFAYLVSGVDDWNGLKSTAKSAM

SEQ ID NO: 1012136 - protein, 39 aa, Homo sapiens
RSGGGLSGFEPVSGSGGTGRLRGWLTKLEVSASASCGAL

SEQ ID NO: 1012137 - protein, 137 aa, Homo sapiens
AEGTRGHLRSLGLARSLRRRLSDALLSSLWGRPGFVPPVIAQIFQTCKRARFDCQSLRRHERRDLRSRPTLGHYPGKEISAKREGRYATRNLLYTSLTVVIPDPEDSRTLTSLLEERSDDNYTLLLPKPYHSMSFRR

SEQ ID NO: 1012138 - protein, 231 aa, Homo sapiens
MSPGHCGERVKDPRLVSVLARATCGVFCALACPRSSPIVVSAPSSSACSIFCLWLFLLAHGLGFLLGPPPRRFTRIFDAGLVFVCYVGDCLPHLAWTNGYFVHGLLMFACDATLFYASAFGMQPLALRTGLVDGTRVSGLCYALRLTHASQVPSPTWWGVYCGPYRLLWRWRAMAKSAAGRVQTGAGQSWQLASGALFFIISDLTIASQILYSCALLSGAYSWSTYYVGTN

SEQ ID NO: 1012139 - protein, 189 aa, Homo sapiens
MALGFAQGSPTLLETEAFPKPNAGKLVGGKWGKGFPASPRGGWRLGENAFSGVFGHFNKPVIANSHCKFALQIHHPFSLSPRQRWHCSETNNVGPCPLMMTVGREVHGLFPFPPLFPFPFPFPFPILFSLSFRPLSFSFFPSLILSIFSSSSFHIHLSKNLPWPEITLSLQKLASLQPISQVGETEAWA

SEQ ID NO: 1012140 - protein, 139 aa, Homo sapiens
WKRISLCAQAGVQGSICGSLNSASRVQPFSCLSPRGVLELQAPCHHARHNFQKLLRIRRRGFQPCVGPGCGPQNLLRTSVITTPALVGSSPRSAASKQQGERPNPAPGAVTIHLLYLKTRLNHYKQSVCAAVDKAPLMR

SEQ ID NO: 1012141 - protein, 106 aa, Homo sapiens
MRRKSTGETSSDLAELTEPVVMRWRYLRTGGDRSIKPCPETHYLSNESHGPAERACGKNNKESERRQEICVSPRVYEVTSFELATVGVCALTESWSWGVYTSVAIG

SEQ ID NO: 1012142 - protein, 71 aa, Homo sapiens
AHKPIDIINMISNGDSIVRAINPIAECVQNVLSSYPCEDIGFATIGIKAAPNVHLQLLLKEGSKILNQKNV

SEQ ID NO: 1012143 - protein, 147 aa, Homo sapiens
ADGAPSLDQPRNPQHGDVQSFGFRGPHWKKNCLGPHIKLTLTVADELKRRSVPKAHVLRKFTNLCWAAFMAILGHSQLRQSLRSTGRAPALLHPGTGPCTDQEAVALQVVPAGNSKAHKPPRDLMAASSVQWAPRLPPRRVGLADVS

SEQ ID NO: 1012144 - protein, 109 aa, Homo sapiens
EECSAREESVVREPVSWLWMRLSGAGSRCLYKQWERLWGLCRREDPTPSGGGRLSDAELVPLPGEKVARFKGTTEGGHGGEASGVVCLCVCEAFTSNTLADGADTLGII

SEQ ID NO: 1012145 - protein, 39 aa, Homo sapiens
MLGPSALRWQLPGPSLDASVNIFRRQRGSTGQAVVTTQS

SEQ ID NO: 1012146 - protein, 181 aa, Homo sapiens
HRSDLSLLSISFLPHLRSQEVQTLVQPASADTPRRAASRKQVLRRTAGDERSGLQGRGFGGAAEMDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLIL

SEQ ID NO: 1012147 - protein, 139 aa, Homo sapiens
MARRSGGGRSSRPAPRAAPVRNPPAPARPAPPPATTQSSGGGIMSGIGSTIAQGMAFGTGSAMAHRAVDAVMGPRTIQHETVVGEAAASMTPMDNAADDKCGNPSKAFQDCINHYGSDISKCQFYLDMLNECRRGGATL

SEQ ID NO: 1012148 - protein, 232 aa, Homo sapiens
MSKLPRKLTRDLERSAACPGPPVWLLYCPDSQSLSSHLASDSPEKLKGLLVMSAAPFCLFVTFDLLFIFPGLDHRTEIPTQATPYTTCDLGRSSKSRTLKLPSSTSLSVAFFRFSGLLLGYAVAAPPRTWSGRLPVTTLVSSAFLIVTVILSGLLYARGGEFGVPAPPIVSFVLAWWETVVPDFKGPTPVKAEDGADGILPPRLLLPVDPCCSPVLCPRDSSIHPQNPLQGL

SEQ ID NO: 1012149 - protein, 487 aa, Homo sapiens
LVPCSSKWIATGLDVEKDMVKAELPHTSSRSTSSDFTAAALSTRGPCIDPKHTCTTMHIHSAPLARPTVVRLLLPLPPERTELARPLAQPAPYPKSVTRPPPHSVTHSHATPPLPHPIILTSPYPRLPPVCEPLYALINSLPPYRQHLTLTTAPYPVPTHRHSPPGSNLSLDPHSSDKSQNAGTDSPTTPCVPWRPPTRSFRHQHKIIRRTGATFPPRQNQSLGHERRANTGPSNRGHIGLKARFTLRKPLALSFPPPLAQPQSPQNDIEHGKLYTEAYPNCPTAKSNLAGLHNSRAYNLAAYTTPTFKPPIRVLTLRKPRNAQTRMAPTAHLPQSPRNSPHHTRLFTQRSPLTIVPLAPTQKRLPPRSGTTTPPLGPSPALPPTASREPFSIWDRWRSPQLLYRMSILAQTFPERRHILGTNTFECRLDRNPPYQHLHLSHLHHHLPLSTPRPSLHINISATTSTTSSTSTQPQPPNDSTTPQKST

SEQ ID NO: 1012150 - protein, 186 aa, Homo sapiens
MPPPSNTNRTRHPAQAYLSTTLITPRTHPPRCHTTPPHPLPPAHPPRNTTRPSLHSPRTARGPTRNHPTHETTPRPLIPPQQHQRDHAHGPEATPWHFTKPTKFDTADTAAKHRERTSAPPLSPTRDSDLPSLPPTRPTHLRRHSPSTTHLHTAPSTEDIDSEAPATKDRQDPTNRQQKSTSRMHA

SEQ ID NO: 1012151 - protein, 313 aa, Homo sapiens
VRVPARVLLRAGAKPWGGQESWPVAGARTGELTVAPPRCLRSGPCAPWCCWPSWLDCELVLCLACCETVRAGSFRVSQAGVHGVEPGLLVRQGSAVNERFKEPPQMNRPGAWEFRDGSLVSQALEEGWMNGQGAFRGCQFLDASGNLRPELSFIRAWPLRPVNCERVVSGTGKPRDPPYSALRVTLGKGPGSHGRTALVVLCLRFGYPRDRQSLWGCLGFLPRRKFRSGVVPLPPAALGGGLAIGVGDPVEPPVVERLPRGRNSLLARRDQNPREGVSLGQVLENVQRWRKPPEALGGNSNLASPVMPWGLKT

SEQ ID NO: 1012152 - protein, 335 aa, Homo sapiens
GAGLEVGVLRDALRESLRRCGTWPELEWRRGSGLVCVSPMPGGAGFWGVCVQAPWVNGLGDVGAYRGVWPGASSHVRVGCTDLSCGQRAEDLKGDPDQLARSRSRPSEQFQDREWVCCCHLFRSGPPLRWTLHGDAAAGGTKQSVIEEAAGQAAGDEVYSHSPSEGEGLTDKGYRGELGKTVLEERAFSLVKDCRIPMAGPLVDCAYMIASHAPKGSRKKKEREEPGSIGREKGKTVVVGALQPGWNVLRGGTDIHGRETNQGAIYQGDEGLTADVPMEKRSDKFHEKESGRRRARSYKRYKKHRTWIACTEVNTRARSRPRNKGAQWWKVGVSK

SEQ ID NO: 1012153 - protein, 102 aa, Homo sapiens
MLYLLLIPVLLLLRATNRRSAGERAAADNHGGRPLPSPPNKLPLIGHLHLVGPDPHVSLAALAAKHGDGGLMLLRLGQTRALVVSSPRAAEAVLRTHDHIFA

SEQ ID NO: 1012154 - protein, 41 aa, Homo sapiens
FGGLGVMAVASRLAVARVVQPDGGAASGRRGRQGFAVVGLP

SEQ ID NO: 1012155 - protein, 248 aa, Homo sapiens
MLPLGSSELADAHGAAELPVAARIGNSGPWIIRIRGFIKGADTCGRAYATSMSCKHVNGLRRRVMGVYARGYEEGWVEGLDTGSSISKQETRIKGKGAQWAAVTLTEQGEDRRTQIEELQGSTYASYRLPKNEGALCPNSVMRTLRASRSRLGAPQTGPSTPAAKLGSGPHPFAPSPSGHGQADRPGGPFSGPHRPTAQQFTPTERQETDHNERPTRRHTGTARCTMMGAQHQHHGTHQHDTTAITTR

SEQ ID NO: 1012156 - protein, 90 aa, Homo sapiens
RRERMAAAELAPLAAGGEEAAATISVPGSPVSAGETSAERALEEAVATWDPEPVYTVRLKHFAPWAAACSYDLSDITQADLSRNRFPEVP

SEQ ID NO: 1012157 - protein, 128 aa, Homo sapiens
MKRGRRKFRDMAVYLYGSPPIHKVKGAGSVGRQVWWAFQEIGRIYTGSARKPFGPTTRLVNNSQPFYQEIPDNGNLTVQRLRRRLGPILGPLIQRGHLIPEKVAKRSRCCSAYRGVATGFNPGFYSAP

SEQ ID NO: 1012158 - protein, 37 aa, Homo sapiens
MASSAASLLLAAVMCALAASSASASRDLRSRPTQFVV

SEQ ID NO: 1012159 - protein, 137 aa, Homo sapiens
STRQGKAPVVTQEKSKSSKQHRAREKRSVSREEVAESKPFVFAASPKKQQQEEEEAAPVRRRKPAQYRGVRRRPWGKWAAEIRDPVKGVRVWLGTFPSAEAAALAYDEAARAILRAQAKLNFSSSSAVAAAAPGARK

SEQ ID NO: 1012160 - protein, 260 aa, Homo sapiens
AALPLLLPGDGKPQPGRALGKALCALLLATLARRRPSSWGESPSVPPEPLAIYSITFTGTWSQTGLPPSSTPCSCPPEQWSSLLVGRGKLRLQHVEEEPDTSANGTATHFVGRRGEGHGQLMKEIEAGGGGAAERARWCCSAPAVPMRHRCMTSAELEVQLQDSLVSFVVRIVPSPDWFVGVDRLDLCDGDRWRDTGGAGPVPLRRPVDGLAASLLLPQFASIPGDTVTEITCSSPSHPANVLLLPAAEGPASHRQGDTC

SEQ ID NO: 1012161 - protein, 307 aa, Homo sapiens
EAPSSNSRLGHRTTDSGAADMASTIMAAASRAVVAKTPFLSGQGRAASASPLRDIAAAANGRITMVRTCHELTTTEGTRPQCYVRVLRANDCLMHVCARSQGNDLWYGPDRVKYLGPFSAQTPSYLNGEFPGDYGWDTAGLSADPEAFARNRALEVIHGRWAMLGALGCVFPEVLQKWVGVEFTDARLVQGRLADLLRGRLDYLGNPNLVHAPSILAVLGFQVLLMGSWVEGFRINGLTVSGEGNDFYPRGQYFRPVGLADDPVTFAELQVTGHQEWPSRHVHLWKGSFVQLLSTVGSIAELFDTSR

SEQ ID NO: 1012162 - protein, 120 aa, Homo sapiens
RSFQRARARRRPALLKLASLPPSCHAPPARAGAGGDAAVTPPAGEGPAALMAWPLVALSHLLPGKPDGSSHTGFAVESHAPRVPWLAPMARAPAARWTRLVGSVTQGTLSVQPWTSRALT

SEQ ID NO: 1012163 - protein, 351 aa, Homo sapiens
NHYYKLFIPWTNQKIQNDFACRGTCCEFNATSEGFDRAFADNPGPMVVFAIASGDASTLGESLHGSSRKWAVKTYRSNMVIMPGYCVHGSPSCQEDPQRGSGKLADVRGGQCAWEVKMSGGVHVMSVGYHGGTPRVIMRLVCGPGESRRCCAAGAMSRRALSNEWTFLNAIHESMQEAPFMLDVAGGVGVPSIEFMYGVMSLVLAWLISLPLGGSMGDHNLGYYCLCLNGRHHGVHTLAHNQGPQQTLHPVIALLGREWACLEKRGAIGGRWYGGALAQWGDGARGCIEGDEDCERVKPGRVIVWTRTAWPTLSFPAAGCCPPVEGPQESPSAGHMAASNSLGCDCKGTRQ

SEQ ID NO: 1012164 - protein, 106 aa, Homo sapiens
ALCLSALGFYFFFSLLPCSRGRCPAAYFLPGSLAPHSLRVSGKTKGPRGLSQAAMACVCTLLEAPGAPVRPRASTLAAWRDQGVPGTTWLTGRCRRRDGVETPGKP

SEQ ID NO: 1012165 - protein, 357 aa, Homo sapiens
RLCVSLKVPGKRPGAVATPVIPAVWEAEAGASSKVQEFETKSGQDGETPVIYEKYNKLCRALVCSCPVISGYSWRLSTGEIACTSGGTGGCELTAEYHRPPATSYAKWRRGAVTANLQYNEIEYNNRGTLEIYNSVENVAKNQMGRVSPLVTTNIVPPPFRYRLEKRLQCGRKRSCASCAAATLKSQPFYNAHYNSDNSGWETQETLGVCYTPESHWARVETAVGRQALCVSPFGAENLSSVLRDVRALLASHKASQHRGGLKAPSVSGFSYTGQRIQCGGNTLEDPLCLRSSATGERPLECPVSTRCAQRPRGETVTPGLTSMRRGTESSVDPLEAWGPMRGAGGLVASTFDCNIP

SEQ ID NO: 1012166 - protein, 150 aa, Homo sapiens
RLSVEFWFVATSWLWLPLFRRRERAGGAGGAGHHVPIVPPLAGAQSARARRAHCPERLLRRGRRRACTWREPAAGPEEGALPWRQLSRADGGAGGPGGPGKEGLVSWPPASPYSPLDLDGPSWGQHPGIGAFQLSQNLQHPQLPVLASSK

SEQ ID NO: 1012167 - protein, 324 aa, Homo sapiens
AGWYLVLRVYGSEADAELAGGSSARSAGWLGAVAHGGSACPDGECPSVLDEAGCMHHVIMCLYAMPSSNLADPQDELGWQGHAASKLEMPEGPVRPCCGPLILEHPPGHGVRSIVVTECEAGACRCRTFGFEEQVTCDPVGRPIGTAECRRALNDPSVGTPSGHCGPKSSSRVGHTSMDQSVTKGRPCDSTNEGLFALGQDPGLRKGTIGYQIEIQGIRAVWRNSLGGPGYARIGRAVKLSSSLFRRTLSRHLEKRVIPSFQGRRRSVDERFRATHHKERQSGHHGISCMDKVTKRVTDYESGQKTRIPEFHESNRNSGGELTI

SEQ ID NO: 1012168 - protein, 232 aa, Homo sapiens
QAVLARKFWACSVVSLDTAWLPKAVTDCVVPAPWRSGGTGVCAPSGSAGGELANLIQAELVDLVQWTDLITFRLPDGQLLTGFVSNLFQPCSGTRASRSCATSNLHRVSGRGRWSFLDNESGAVSALCYRVAGMWDKYNDAAVAVMLCVFLLSGPARRGPRAAPRTGRRRPACCASTGATSLDFPELDQPFADHQRISLTTGSPHSTYLAQCSIISNVVRAKVTGQSESWDL

SEQ ID NO: 1012169 - protein, 311 aa, Homo sapiens
GTLGLETAATVVKLSDPVSLETVSFSTQAPPARARRPPPPEFWGPMEEEPSQIARYPEPTDRSDRELPEAPLPRSDRKASPIRVRNPEGPPPGGARRPWLRPCVAGSRSSTHSHDAGIAAQDVRGQLRGTVFREYMEINCRSLTTLVAPWLGYAYRTNTNAYRYGAYKANRYRQQKIGPGTGEPDNDTGQGMPEPPCTQGGPPPRIMGDASHAPYVAAKQWFKAFCPQNKHRQELTCNITKTSPAHKRRAMRLGTDLGQPPWPSADTETPCGTDTTNELPRKNGAGGKLNRTIRPPSKHTAETEVTTTEEQ

SEQ ID NO: 1012170 - protein, 137 aa, Homo sapiens
KAASRREVGITSSLIQASGCRIYEMIFPGLPSFLPSFLPSFLSFFLSFFLSFFLSFFLSFFLSFLPSFLPSFLPPSLPPSFLPFPLASFLFLCLSFSLPSLSFLPSFLSAGLYSVQTSWSADGMITVSLRPPTPELK

SEQ ID NO: 1012171 - protein, 301 aa, Homo sapiens
GDLGTVRRFFGTVKNTWSLAARKRWHFFSVACDEVLGMAVEGYTHMYPGNHGSGVVCLIGKLYISKPCEQDSMYPRDGTEGLDVLDMSGECGQDVPQGRVDDGAYILIGCRKCRTVLYCLELPWKPNRYCRWAGIVSWSYKYTITQVVSHGCGGRTCHVYPRRKLDRLPCHLRLMCWTLLHLALGLRREACLCLQDLVAKYWQVLGGPVSGLSIGTGRAMLGTDTMEVTVYHRRGSRSYVPLAHSSSGFTITDQVPFSVSVSQLRGLGWREQALPEKSGSELLRSSSMTQWYLAEADSPTP

SEQ ID NO: 1012172 - protein, 72 aa, Homo sapiens
MVDEDRTEKIKRTQNENNQQADRSHTEANKGQKKQKRNNGHKNARTKPAQKTEPTDETNNEHQGDQINNQRR

SEQ ID NO: 1012173 - protein, 46 aa, Homo sapiens
MALLPCRTQTSQGSDVPPCGPLSRVPEPLQRYPSAPAGSGENLSNS

SEQ ID NO: 1012174 - protein, 210 aa, Homo sapiens
MQVSVEEVLKTVGNNRDKGRSNHSAFLFGSGDGGGGPPQTMPEYRLKRLSNQRMGMPRVQDHTLRPQTALLSILESDSVAACARGLWELFLDAAQMASYTIINAQIKKGNRECERSPATDSVTSAQYAWPWSAAVSPCSYSARVEPSMLSSSWRLLLLNQFPLMWCLEGCIRAWWQRKPCAHYEDIRGPGQYTCYSASEPKHCVLGEPGH

SEQ ID NO: 1012175 - protein, 40 aa, Homo sapiens
MLQLRTKASYPGRVSQRTGLEDGRFRGLAPRTRTVFLLRD

SEQ ID NO: 1012176 - protein, 82 aa, Homo sapiens
KQSGLAAIDMSPWPGGTGRAQEKLHIVRPSPGGSLWATIVSQRVPEAPSWPGRVSPRVSEEPCLACVLLDKTGRSTESRTVI

SEQ ID NO: 1012177 - protein, 348 aa, Homo sapiens
MLCRGVLLGSCCVPAVSSDMGLCSCLRMRPCAHALSMMSCCDMLHCPCALIPTHVMDACVPPLTSSLPLQTLGLMCHVDVHVHACEHVLFLVPTVMPCSLALRCMLTVLPCMPRLSSCVLLMPPISTGGDAAFPAQPSPSSPRTPLTHLWSLPGFLVTPCCLCGDVMPNLHLLVVTPLCPMCLLLQLLAQCAFLVDACADCPQNAVGKTPCPLATTPPRWTCVATAQGYDGIVVGAHRLLLLALLKVVASHPQCLVKRGPPKGFLAWAFPSSHLPTKLGGGGWGGAGPNLHCIFGSFLATLRLVRWINLVPRCVPLLARPQNTSPYGLEPLGGPPSSPWIFSPQGPPQ

SEQ ID NO: 1012178 - protein, 109 aa, Homo sapiens
CCLALRLPRPAYKALRDDCGGWVRGGARLDLLALLAGALALPPFASPCLPAPPRLRVSTAPRFWYKPKRQDRVEERMEVTIYKKMSRDGKHITTSLHDTEGERERGKEQ

SEQ ID NO: 1012179 - protein, 87 aa, Homo sapiens
MLGWLARASVGGDYDRRLHTKEDEMTVTGIERMREAAPTKFPLWLLHDLEEGAGPTSELAMTAHSKDVHKGCRRHHLIHHISDFRLE

SEQ ID NO: 1012180 - protein, 283 aa, Homo sapiens
VVWPGDFEDDGLRRRRFPDSHAQLEQLADLLLEARSCLRGAGRVRWEVAGRKGGLLRAPCVPRTSGPVHVSRRLLGFSIWGHGWGGGGPGRKCGACRCAGPEADAALRGLGQHLASPEQARGSKGGAWDARRKYLPVRCPSSSVSCLPTAPGRTRGRGGLGGAPLILALFSPAVPFQGLLPGIGLRIISFLLHCPCGPSRAPPIYLAQRPGLYRFRMEHACSGLFNQGTRGLGPCLDIAGRDRLSNNVPVGSTLALLVPWSQRWSSKISIEFGIVAKVTWPVP

SEQ ID NO: 1012181 - protein, 230 aa, Homo sapiens
DLTFRTGKLPRAREDRAPAVPRTRADRGCQSLMIMSKDEELSERRFSAVSAPHMRPLKNPWPEFHGAEFNQYPQPACNENLQTRSSWQRPPAGCAASFSPTDSGEEPGQHLPMDVQFQRRQNQRRFSMEDVSEEALSCPWDIRLPQGIPTECYRWRAQILPKPLSRFVPPGPPCQTLAFGKLETYVETWHKPWDEGTLLPTVFQTVRSQILTWRKPCCALEMQNPGLEAT

SEQ ID NO: 1012182 - protein, 139 aa, Homo sapiens
RLVLVLGFLGIVTTRLCGAVEAAPKPRSSRLGWGSLAVVAVAVVRACRGSSALTMCPKGEDAGACRLPLPVLCQPVCRVAAGTCGLGDLAWRPEVTNWRQLRTHLAWYARLKGRPREALEHFAVMPKGTPLEFLGTGFQ

SEQ ID NO: 1012183 - protein, 265 aa, Homo sapiens
LVRPEVRALQRQRLRSCVSSSSSYSLAYASSSSCVSPAASAAPDCGALEPAAEPLASGAYAAPGGWRVTGCADASCSPALSRWRPAGCCGCCSPASSFGCRPCCGAACRPPGCSRLSREPGLVPCRGRAQVSSWLHMPVGPCLQPFQEGPGKGSVGAQDAPGLQAWGPGPSPELPRLSIDFLAPGACPERSLQHFNSAPLPKGPDQLVPGHPATLGFLGHGGQRAWTAWCFPFRLQGSPYAHGSNPFPLFSCVIRPCCTLSPLLP

SEQ ID NO: 1012184 - protein, 145 aa, Homo sapiens
MASPWWRVPSALRFAGAVYVAGCARTLLGNIFRDVLEFLRSLRCCCPCLGSYRAPTNALYGPNGLTVVVELGSCRSGLGLQVLRALNHHFPESGPIVRDPKVTKAGSEDDFGVHRNTFYQLVKPAVRGSCGILASKLQELEQEVG

SEQ ID NO: 1012185 - protein, 194 aa, Homo sapiens
DEQARGPGGEGRGWAGGSLLSAGERWARGPGGLLSGRAGWAGPPGSRVWAVPGKSAFVHPSAGLGCWSLPRPLGGKAVRGAGEPRSVNNPERWLHPLGSALHDGRPVTRGALHPMLQDPTASKLKHGGPSPSSGSLVCTQEYYRRGVAPLPPIHRGCSAGASGGPVQAGGTSARLKAGGLGRLGPRSGDGDLSS

SEQ ID NO: 1012186 - protein, 154 aa, Homo sapiens
MPCACYQAGQGHQGPGSGPVLMGQCTQVIGWWHLGDCRRPISLFDLYPVPNPCQPESGEPHSHFITGFLMVPFKRSVFWPRSRSLNSISASHSAVAFSADRPLLLPPAPVGTRRCAWNSWTYTSRSIIRNVKGPVREGDVLTLLESEREARRLR

SEQ ID NO: 1012187 - protein, 127 aa, Homo sapiens
RLYAMELWDLHDGGGKTLLCVSVLTVRKDSQSWDMRKEPDPSGQNAREEHWVVVGAGVPPLSSRRVGAIARYSCELRSSDRTVQSEAERTTGKVKPVREYLGRTVVWGLGACRSATLFVVEAVAEDT

SEQ ID NO: 1012188 - protein, 107 aa, Homo sapiens
MGENKRWASEERNTGATTRLAAITARTGNPGHRTQATQTSESHTSPKSTGITRNGSTRGSGPIQGRDNNWDPQTGLGEKTGKGSRNIPHTRGIYQTEGANIERTAIK

SEQ ID NO: 1012189 - protein, 265 aa, Homo sapiens
AGTGPEFVRMRGACVSSFPLPLTTAPTALPCPGHSENVDGVCMSVRLCCQGSEDVGALRCDAPPCGIFEHNHLLIPDYVSVLMVVRTPECSARISPEEELHTWVMTAIRVAARARDLCRDVGDVGTRCMALERPWCCFGIPMEWEGRRSLERLLDQEICIMVVGEQVHILGPVTVSEERVSVTGEDSDIEQIGWYTMTSSETLSTGQKHEEALPGRAGMGAYEETMCIEDRILIHWKPIDHQSTTQGCSATIDHSMQQQYMPRVT

SEQ ID NO: 1012190 - protein, 87 aa, Homo sapiens
MSNPELTSSISFEHQGKSWELAQTRQRQVWLGIELGSLAKYKPKVPSRDIDQGTWINSFRELNHGKLEGVRNQSPLHPSVELHKKTK

SEQ ID NO: 1012191 - protein, 282 aa, Homo sapiens
AGTAPGRYGMRRRIHAELTQCHWKTVSFSTQAPPVPSQKIPLPPNSGGRWKGAESDREVPRADRPERQGGSQKPPPPEGVIGKASAIPGERTTEGPASGRSPTNLDYANDGGGIPARQQNALRPDTKAKDVRKRQDASQDTTCGPGKHIINAGKDNQGTITKADTSWTDSHETPHMSSKRHGNKPEKTQLKRGRYRKIGALPKAPREGEDRKGMTRNTRGKREPEEHKRKHRRIQKTETPRKKSNTTDRHQAKYLEKRPNKRTGENTEKREKTTRKRDIHEA

SEQ ID NO: 1012192 - protein, 294 aa, Homo sapiens
AVTGPGIYRHVEGSCARLDGRQVSPAGKAWMGSIGVAFEGTLSPILVPACVCLDVAAWTPRDDWPAALVHGPADDVLRVLLLLVPGTAGWVVGVTSDLSSLSLLSDIVFKPCCGIPDCTAVMPREDRATWKSNYFLKIIQALDDLSDNVPICGRQTMCGSKHDGSEIRIVPFAGRLVVLIGQEHHDAAKAILRAPGTTTQLLEKLVASYPGGNVGLVFTTGRTSLEIGDMLLANNGCQPCLPVAWLAIAPIVKVTVCQAQNDWISGPEKTSFIPRLKGIATKIFQGAPFESLHT

SEQ ID NO: 1012193 - protein, 124 aa, Homo sapiens
AVTVWNFWDGGAGSNEACWRSGLSSVCAFDAMCRCAAVYRGAEERGPARSGDFAPGGTGAAARSAHIPPGAASLGGPGLRSSCWRSAPSQGREEEAVDATTRRCRAKRSRIGSPPLSTALQALL

SEQ ID NO: 1012194 - protein, 223 aa, Homo sapiens
MRARGLARWSHVAGSFLSACRTSDPGTPFTPFPVRPVRPAGGRNSERALTAAAAACCSAVRLRGSLECALCRPDAVISIFPCAMIHSSRTQRGGIKLHKNLLVSYVLRTARQLYPEERYRRASTGRQHARSNSKQAAPTTSTQHLSRTRTPAYPGQAAVPDIRARPPNFGGRARWELPVRGACTEDPESQRHRGTPKHIDTQELQQHNEFQTERGNIQKNKRH

SEQ ID NO: 1012195 - protein, 265 aa, Homo sapiens
LGSGSSAAASRDTDQYFKHKKLASDAYIFFTRSVQFTGGEIVRQAEKTELDAHFENLLARADSTKNWTEKILRQTEVSSSETQSQVPCCGVSSLYGECWTVKVPLQWVHLTWELAGYRYHGRTRPSESGSRTIPHSGNHTALKGGRQLTTRNVGIRLRAGTFNPPRHSISFAHTLAANFLDGGLDRPSRMRGGSIQNRRSETWTACTSEAEERPRLAEAKSHALESMKWNKGDAGSSSDWPKTRVDRQDSKGTGLLLEGNQETLT

SEQ ID NO: 1012196 - protein, 104 aa, Homo sapiens
MYIGEFEGPYGEGITEEYRGENEDQDLGFRKRKKLEDATERSNYIVEVANTHLVTSKAREFVNNRQAYGAFIDRTGEQLIVQKNGSEHLVKLYKGKTKVEIHSL

SEQ ID NO: 1012197 - protein, 122 aa, Homo sapiens
LGMELWSAIAHASARRDPVRELRRGPPTEICCPGPDRSWRHPQEAGGGGRRQRVARRAVLTRGSAKDEIPRWCTCPPSSYNVCGPTVRGGRQAGGAGDCGTRRGTGGHTDRLTDRHHRSYPL

SEQ ID NO: 1012198 - protein, 177 aa, Homo sapiens
MEEPLALACCLGQWPSAALLLAQLSCACTAQPSWRGESILFQPEAPDQNTAITFTGKWSQDGLPQAVPPVPHPLRKWSSLTGGRHSSEYKHVEEEPVRQYRAERLLRSGGEAWALMKEIEADGEALRACTKVTRAARRYPSGTGQTVRAELEGEAQGTRWTRKRVRNRAKPQKGREQ

SEQ ID NO: 1012199 - protein, 115 aa, Homo sapiens
MPTVLLHIGTEDNIGGEEGKHEVWHYPEEREGLVLECAKEVDVAESNRRLNLSVSSACEESQVYVHALYDARCVLDMAGESWHNDEHVRHGRRISRENWNFQLERGLNHVDQTLL

SEQ ID NO: 1012200 - protein, 92 aa, Homo sapiens
RKPRSLLLALRRLGSSDSYAVTGKRPAACAASISNPGRRLITYLKKYINILDIEGTLTNAEMTQMGQKSQDSYSHRAGLVGFFTYGVSVRLS

SEQ ID NO: 1012201 - protein, 102 aa, Homo sapiens
DSRSKQELISSWQSWAMEPVETEPSDERRGEGKQNEARQNGPRMNHINNQAESGWRNTAPNTTITRNMTSTQEAARELIQGRGRNWLAMGPVAPEQSNLRIQ

SEQ ID NO: 1012202 - protein, 121 aa, Homo sapiens
GSLSRLPTITMARGFYISKVPGAYLEDTYLRQNNQNTNTHTIQEKHPKKKQKHQQHPHNHHHPNHHNHHQPRLGQHRWTRSKAWESVTGSPNTSIGSPILDPRSMMKICLIYDLFSPTSLS

SEQ ID NO: 1012203 - protein, 117 aa, Homo sapiens
KGDGMEEVPHDCPGPTAPRRAEGLIMSGMPQPSNDTLSKETGMLTDYDPTKNRKNLNEIRMNGRMKISIYNDIRKGLEKIKSRILGWIEAHSGAHLLLHWSLALEDCKCISEIGNGR

SEQ ID NO: 1012204 - protein, 343 aa, Homo sapiens
KIYTYSQVAEHPPARLLETKPHHTCRSIQDHLLSAGSAAMPTFVHPRYGSPRCQNHQHTLTDDAALTCWHAVGCLPALSLWGSQESLASGLRWSHTSWRVALHGSPALGNYFNGDEEAAKPTANATPLLDLNGLVRMKFVDQSQFILAGGQGLLVLIHPNLGLLGLEYPQEANYTSMSAWEQVDREEGSFWADLFNRLKDDGWLSTMHPAVDSTWAAIKWHNSGECCPSSEEISESKSLHFKAGNPSGAMREKGSLSDRIGEQIGLLFMLIGEQDKKKCRAKQINAPKGEGDSKRQMKEWLRAERGFAAETLVPFQVRCESCHSYLSLRCPARAMSPWDYLAN

SEQ ID NO: 1012205 - protein, 106 aa, Homo sapiens
MASEKRINEVDYELRNQYIKIIKHEQRTNNEIHSGRICKIKIKTNIYLPNSEYMGTSIMKYLKKDRLKESMLLPELTADEITYREDTEKMPRQALDEMIAGNECNC

SEQ ID NO: 1012206 - protein, 154 aa, Homo sapiens
QQQKQEPLGSDSEGVNCLAYDRSQTITTEAGSSRICKRIPLEYRCYYRHSSSIEKENAKMRWNYDYQRRRQGLSKIGEELRAIRKDQSQDGNLYSIRGFSGYLPGEKNSTMMIEHDNNEIVIYHELIDNQMIRNEIPNDTLESDQMNIIIRNCH

SEQ ID NO: 1012207 - protein, 67 aa, Homo sapiens
IDYNGDGGQAVRLEPGGSPTSSYYYWNPKERNQPRRIAVREQLLVLSGRTEPIYRAYSPKEDYRMTA

SEQ ID NO: 1012208 - protein, 111 aa, Homo sapiens
RRLPKWRVRLRGLAEQRRRSVQTSRSCYTGPIAQVELTIEKQTSERKRMERRAVYKDTAFIHHSTVAWIQATVEIYAMIETGERDESELQGGLHESKLSLKDEIKPNDEHT

SEQ ID NO: 1012209 - protein, 196 aa, Homo sapiens
MAPRPEKHRTKKARSTMKNKEEMIKATEDRLMRNPKEPHDDNIAAKKPDGRRTYIRTPPRLIPNHILEQIDIPDRVQSMQTDKGAAARFSWFNQCLGRYFSKIVQYERKDRPSNQTYKWKKNRKGSDNENTCNDALLKAKRNLAYKREKLSAKGQPTNRKNARQAPYEEREKTGQTEADKTILSQQEPMGRRNLDH

SEQ ID NO: 1012210 - protein, 376 aa, Homo sapiens
MYPGWSARDNYGKKKKRKRDKQPRRDQKTKHTELKRSTQVMVRLLKSQMTSPDGDRCSMEKCGHDDWTKTEQSVVVANRCRDEKRECVRYIRRRMAAASSPPTRQYIKANQENDSPRAKRQILMEVRGRPWEKERGTLNWGGESLLWGLCCPIGRAWDSLGGQIADGQKEDPHTFLGLDAALWWLCKECRGLRAKSTTLCQTDGHANLRKCLQMRPLRTHQLRIEAPNSWAPRRQLVTCVANNCLNGDGCQSKALVIATFDFVHISYPANKSGGVLPGASEALPRAAVRGSLGVAKGGACHSRWQKGTVYFRKLATWRKSECPHFGLSQKIFFQIGAAIFVAAGRKHFGFLRGRATVGVNRACCQTLRNLVPRNFI

SEQ ID NO: 1012211 - protein, 99 aa, Homo sapiens
QLPAEQEKISFLFGYPLDIVKFYNEPIRDANESASAETENLQSSIIDSQGEQNGDIRRTDEVTIHQENGTRGEPGRERERKRDRDQRETQKVRLGREIV

SEQ ID NO: 1012212 - protein, 207 aa, Homo sapiens
MPRPEGRLVGTPPYSRQLRTPHGSIRSVPVPFAVGTWLTQQRRREKMTQGTQAASLRHTSRAACCQDLPGRQEAYTDVDRTIEHRTIHTLRLPPGYHWLAASLTHGGNPSRYGASRPSGPRVDVDLGPGMLPGRLLTSRLDKKEEPPNRNKHGQAVAHGNPEETSPAKVASHTQPSAALPGNANKATTGPKEHSTEEYKKRCTRQQQ

SEQ ID NO: 1012213 - protein, 380 aa, Homo sapiens
MVLGGSLVYVVNRGCPVSGNQPPYESSLTIVCIRIDSHPRTAELAHDRVPEGISLWVGQRDHLVFGGVLFRNVNFLEGVITVVSAHGCLHAMGTNGDSLQVQAESLVEPWVKALLKAEGSWEKGGGGGSIAEVPHHEVRRDSHRSGTLFWFALNLMGMGLRGRYYSYTGPMGKPWVYCLGKAGDSSYGFPLAGLPLGSGADGALFVAPIGQFDKGGRNEVRYNCPPIWGASPLVHTCVPFVYLKLEGLRKVPRSRIGAMGRGGSTSQRPNLGREEGPLWRPQVGPFASKTHFRFGGESGKPEPSVQLTHGAKEQPARGPSTTGFWLKRSVSSNLPLWGQSFPRGGTQQGGTSLRPTESGLWTKGCNKRSPQSLGKNSKGW

SEQ ID NO: 1012214 - protein, 107 aa, Homo sapiens
MHVGVLRHRKDREYTEDWETTEEKQYKVYMRREEQKREYQSNRIQQQEKEGGPSRIPQGFLLSDDTHLNIGGVTFPNMFYSDKMEACVGGLQVEKAPGLSYSCSINN

SEQ ID NO: 1012215 - protein, 97 aa, Homo sapiens
RVSVPSRSAGASAWVSEERDTKRGAVCGVWWRVRYVDDDSEVQQQLLLIFVFQPGNRERNNTPPKKKVEYTSAGAKNSKVLSISAKRIQKELADDRL

SEQ ID NO: 1012216 - protein, 313 aa, Homo sapiens
LFSQDQPLAQSRAMAYVPAAGLPVPPTSRCCSLSTSPSPGGLKVANVCLHSNGVASRASMKLVLQMNFVVGQDPGSDVAFHFNPSRYDELVDKMVFNDVAGREVASSEERKRSMPFKKGCRLCSQVFIDPGLQHYKSGGKLESPFYEYGAPVFPRTEWSTHRAMWMGICEPSIQFNFIGGQSLRPLGYLLIDATFPVVPDIAIKDAETALRTTGEEPTSFQTVLCQYVGEAAKGGLTFDRNSSIIEAGYVPSQESEKLLLSRTSRVGYLQGDHSDSCYIKSHDMGNEYRWYQEPVLPEWATMGDSRGKSKITP

SEQ ID NO: 1012217 - protein, 234 aa, Homo sapiens
SEFDGLFTTHKGNFQLLLYQKMAACGGAPVTPFTEDLTCFPEKSSQALLGDDAECEMDARWYMMYEGPLSGVLVGHVSYCRRYTLVWIAWTKLDACTREHRAYVKCTLASALVELATVLASEYGGRNAVVERSLNGNGDIRIRIAVQSLAFPGAPSVIARQGPPGGGIAFVAFVPKALVCRGYRTGNSPLGNPPGGDPTIAVRLAGVPKVGSALWVAPRSKDLGPHPYPLGKPR

SEQ ID NO: 1012218 - protein, 338 aa, Homo sapiens
MRALLARLLLCVLVRETTPERQLVNLQQVPLEAVTVYMEEHVCPTKYFIATIHWCNCPLEIGGQHCELDEVIEHCYEGNGHFYRGKASTDTMGRPACPGTLPLSFSKRTMPTDLMLFSWAWGNIITAGTQTTGGDPGAMCRWAYSRLSKECMVLTDADGKKALLSSRRITISVWPKDSEAPAFKTIGGQNRPHRETRPWVCGHPTGGTPGRLCHLTCSGGQPHQALCWGDQDDTQPESLIIPERQEEPTHPATPMEGPASKGTINPKQRQKWEHHDDVDRLRTTPQAADNNSATPHQTSNPRDPHRRRALASLHTQARVHTDKGQESSTTTPESNNRT

SEQ ID NO: 1012219 - protein, 325 aa, Homo sapiens
PRGPSGEVEERRARVCWRRGACRNAESAGLLLGRREFCCSIRPRRDLLVASWLRGGECGRRCWDCSVSPGLGAVAGEPLGLQLGMGAFPTRSGQSPEPRDPRVFLLRGPPWAMLFLEWFRNIDRISSPCFKDPQFLVTFFIRACEPKPQSGRIRRAGFPLSSRPLLAESGNFLRCEDRPVVFPGTLLDPGTNGPSSSLSYLRRVAEALVPGLALSEAVWSAMGCPALARRNSGAGPLVPIPWGGPGMRFAAPGVGAPLVCGPPGASVAISEGVTVGTFDIRTIRGSPGGAAHVAVFALRRRCCGLWHVGPCGPFAAFIHCVSRVR

SEQ ID NO: 1012220 - protein, 125 aa, Homo sapiens
MEVVAALGSGKPFGLGLSGAGWRHYARGMAHCVTLVQHVTYSCETNLIDKDIGSKSDPVCVLLQDVGGGSCAELGRTERVRNVLQGPLSFLQGTLQLEYRFETVQKLRFGIYDIDNKTPELRGLD

SEQ ID NO: 1012221 - protein, 126 aa, Homo sapiens
MARLRVATARAGGAALIVSQFTEEPYVHKSLVVDKLRQLFQLDRHLLGWTLKLSWKDVGDSVRIAHELRYGPAKRSRKGTGQRGHRKRRDVRLVSSSGSHPSTLALVGSSICAPHLSADASSGFAI

SEQ ID NO: 1012222 - protein, 170 aa, Homo sapiens
MGDPTYEILDVPEDASADDIKKAYRRKALRGGTQTRKPMTNKEFDDEDIYRRWPRQYDGLLLVTSTSWEHLRTAYGRRRAAPGTRQLALSRGQKPGSWMGLGLHAVSSLVRQCAQEGEGSFRRSQSQSLSAGCAVTPCLGPRKASFFVRSLSTPGPFLLTVVTLRGQGPR

SEQ ID NO: 1012223 - protein, 270 aa, Homo sapiens
MTPDWAYSAGSQCYCPWGLALRRVHCGKGVWRAAPRTDARSQALTAECWTEVAWVVWLVMKMIEQLNGGDQCMVLENSTKMGFIHGAVYNLWVDEEAKRWKLVRPEWHVLMCNAGIPNKFFQNWVQWFDVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGSPCLSYYCYNSGT

SEQ ID NO: 1012224 - protein, 186 aa, Homo sapiens
IPLSSATVMQDSGSSSSPAEMMKPPEVERLQSSDLGALGICSVAAGSSLTPESPPSCRVLGLRPRRLEVYSPVTPVPTMAPLNSYMTLNPLSSPYPPGGLPCLPIASGALVPPCSCSLPWGPLSHGLGVYAVCLQTWLRVAGAPGPGLVHWEGDALKGYRRAPGRQLAKVHRYSYISLITMGIQQA

SEQ ID NO: 1012225 - protein, 226 aa, Homo sapiens
MERRFFACANACDLKCSGLLSGLYPWLIDWCHVDGLWYHWAPVLHAHLLVLVLQVWATSFEDRAPLQACTGWGHAHSAMDTIIEVLCAGLGARGARSPEWGIAPATGRYVQSLRCARRTVLGLYRFDVALRLNEGPISRNPGRKSWALPWMRGGCDGSNNKYGRVYSWVGYSNGDRSLLHSAVLGVLGRLVESKEGFRRCTLKVQKLPGTKENLASFHEQDLTDRG

SEQ ID NO: 1012226 - protein, 110 aa, Homo sapiens
AAGACSWLLSWMPVADVLPACACWVRAVCLWGCSCAALLPVACACECPVGPDVCMVPAIPDVCCLHWSGVPRCLAACCLACATPCVLRVPCLRAERVRSQHGEPDCGPSA

SEQ ID NO: 1012227 - protein, 222 aa, Homo sapiens
MAESRLRRRQRRAPGRGPRGEQRAGVVALAAAAAGSGRLSCRMCGRRQAASWAGARGPRGAAWLQMPRAPARQPAAQRGRCMLSQRGNPNCSSSRRGNGRDATGSRQVVYSGIQGRELSVFHFDTSDALLPRRTGPYVTRELPCWTMELKDSIAMVINQCPIVTTSRYETAGISFQLYRMSSGCPGPDVIPIQATFRGPNLAWTNRGAKNFKPNLKAFGKRG

SEQ ID NO: 1012228 - protein, 108 aa, Homo sapiens
EGGDCESHTLRLRMLLILSPHGCRHLWEKCVLGLRGAAPMASVLSYEYLVHAVAGVRGKRDSNDKVFYSPGYSLDFDLQVDDEQENPNNYTRWCSMEIIKRRRTPWHA

SEQ ID NO: 1012229 - protein, 153 aa, Homo sapiens
MRASGREAALAPTLLLRSPTRAARACGLAGKGRLPAACAFASAWLWAAGCPGMAQWAPPRLRDVPDAGRRHVGRAAVPFLSSLPGFAPELCIATPSDKLPDSQWTALAIKEDSTGLGPNHEPFSVTSPKKHQWGLYSLSPAEGPGARHILSSK

SEQ ID NO: 1012230 - protein, 227 aa, Homo sapiens
PARLRLVSSGCFGDCVHRQEWRSSPAPPDARPALLRPDLFPHDCPLALLADWTSAPCVVRDLTLENPGSECLRGGSEEVLTLCRVLADSLSVPWLLAAIEQERPIDHLLDPKLQASCALVASLCSNQKDLPDKLPGLTTGDGWRAGRGAVLSCPGQAHAGRELNSPQEGAALPNSKTRELEPEQNKNGSQNFPKRWHNKPVLVTYGDSPVGKLARKYVNQGLDTYHI

SEQ ID NO: 1012231 - protein, 302 aa, Homo sapiens
CPQTPVPLDSTSVCSHHLACWGENEPRRCLWSVIPNWSGPPAEPVFIYGQCGTNSTLQLMLCDAAWGLWQVVSGGRRKHHPRQNPELLNWSLPAIPCSPDGGLDRGAPYRHQHSVFVRCALFFTQAGLSLTSTQRVLEYGSAKTLCGKTDILHNSLSRSISWHTHIHSIRLGSCLPLRCQLVSRSTPHGTTRYAGRLCQVAMHWRFTGPGLCPRSQPDQPEPPFCRPVTTRLDYLFSVEVRPWSGRLSSGANRFPGERLERSHIVARALTCPFNAKEQSRPSSDAICTEALFQLWTSYCGGI

SEQ ID NO: 1012232 - protein, 283 aa, Homo sapiens
RRLLEGTAEAPLENGGVWRLVGAGALERGVAPIKRQYLTTKEQFHQFLEAKGQEKTCLGNLRYETLLCNELAVSLSAKGDPTGWMGHDVRDWGMDGVSACQMPWVMQLHDSRRVCPVLDKTMVPGPSVNAHCTTTMNSAVSLPNPCDVWLLRCFFGDLLCLLSALTVVGCYLETNAWPTWAPCCVLFETFWPGPYGVDLPLLLGAHLGARWDRTWCMEEVGWTCGTQSAVQSCNCPGTNALACKQLPEARRSASSELSRPLRLFQGKGSPTTHVCRMYPEGAT

SEQ ID NO: 1012233 - protein, 89 aa, Homo sapiens
DLPALLPCPDCAAEGNMAGGPGPAPAEPQRRSARAPRACLPATGAGALKMAGPWWLLARGGLRAKPAALPDGLTCDWRLFLGAAGSCRT

SEQ ID NO: 1012234 - protein, 73 aa, Homo sapiens
SSSCRDGHPVVVNLLIGRTDFREGSIAVLGPCGSGRLAAFLPLALCPCMVWSLIIALPWAVSHEAHTSDEPSL

SEQ ID NO: 1012235 - protein, 272 aa, Homo sapiens
MACLLWARGSLLLLPLLLLRPASRTCWLSPVERGAPNKEETPATESPDTWPVLPTVYRPTEVTDVLETDGHFREKLQAANAEDIKDAGKLSRELDIVSLTMSRTRAVMSSKANSEVSTRVRSGARKAKDGTAEQDPNDTEVEIIVNSSCKQVGSTMGPVKNQQVHAKARRSLVSCMIQGGARQETLDPRKRLQTSVMTDVQRGYEEWLYTDTPESTCSYSGEVIMGRVQQRNSEAGSSESMAHGALKPHAPRADANHLKSCNDGTCARTKDT

SEQ ID NO: 1012236 - protein, 135 aa, Homo sapiens
MRPGRRRRRPVCGDWSWLNAWCQVLQCCSSLVPVAATVVVHGSAVSASTTRRVRRTLRRRLPRAVGYGPGLELEPCTGPQETLDLHRCTLSCPADLRLASAGRLVRGKLLSRCSPSVIEDTVLLLLDSVWESLQP

SEQ ID NO: 1012237 - protein, 30 aa, Homo sapiens
KLYMVPWPLVLMIFNISATVLYITAFIACS

SEQ ID NO: 1012238 - protein, 140 aa, Homo sapiens
MSSRRRGERDSVTDTEMNTSCELLDALLRLAITLHWKDTGRWRSEKQTPSPSPVVLPFLLTVHHGDSVSQDSRAGMSDLYSMTTAPGAGPSSLDCKHTCCSCVPDRQMRTSQKDVRVPLVAGVTKLHSRAFSVSQRPGRA

SEQ ID NO: 1012239 - protein, 160 aa, Homo sapiens
LRAHRLHRVPNSFIPRLAMASRGARQRLKGSVGQQWGYEPRLLDKSAGAAGQPERRAARSTGPTLSGEQQQRQVVWHREGSIAFEVSAFRQGYVLLSWSNDLWTVDETFNVLGAEHTTSSMGKGYRLGNIPQSYGHIVYLCLPVASCAGHAAFSLHRNST

SEQ ID NO: 1012240 - protein, 214 aa, Homo sapiens
RRLACFETAPGRGAAGEVRRALPGGVRGRVPSWACEAPGLGLTRHRGTGRTTTRAWCWLWLLRAHEPVAVWAACRNGVSDWCRSSSTSGGVPMSPSGCSVDCPQSSARWSLGLLAWANYVKGVIQVLPRHVPHPWRSVKVGGQLSAPGGVAVSSSASLEVATYSLPPAACPDSGTIAVRAQVCQQVRAQLRRDALGIMDQVISLMGQKGHALLI

SEQ ID NO: 1012241 - protein, 34 aa, Homo sapiens
DLFPNEEEEEPSNGIVPWYKVLQQLSRVDMRSQQ

SEQ ID NO: 1012242 - protein, 30 aa, Homo sapiens
WYGRKSWIAAISSVRRAETRTGPPERMPVR

SEQ ID NO: 1012243 - protein, 67 aa, Homo sapiens
IALLAVLRTVGSFLRPRTVIPAPGLCGLRDCWERWPDSEGLTGPGPRDSLCLGLEAVTPTALLQGTD

SEQ ID NO: 1012244 - protein, 231 aa, Homo sapiens
MWRAAGSRYVRRSCGCPWSDFLGTPPRPVPAERHCSQYQVLKMSPFLKNPSLDSIEEGTYLCQICKNENLKNLSDYGDLPLKSTEFTEGTFAILALGWWHTCIVGHFEHDAPDNQACSSGSLKNMFVHTGEYPAPFMPITLQKCWASHGGQAKCAIDHLGLTPCERLCRLCLYDASEWSLVESCDMNVAEGSPLTSVAHKFALRSDGCEPRDSREDANQIRGSENLTNQNP

SEQ ID NO: 1012245 - protein, 111 aa, Homo sapiens
LAAVMAGVLKKTLDLVGLAVCNTPQREATEYCPPRFLMCLRKSLRKVQHYRKYSRDTDYKMRTLAHSGSKLQETQDDLNKITRPTFIVTVTIRTMREYRSGLIHETKSGPE

SEQ ID NO: 1012246 - protein, 280 aa, Homo sapiens
ANCVMEVSVDQRKAVEKPNAEDMTSRDYYLDSYGTLGHPRGDAARTRCSTRHVTGNSIVSVTEHHLRMDKVGAWIVRARAPASSACLLPRPGPSKVFGIECFQLSHDSNGGCNEYDLNVRNTCCMTQRWLYHSLKGRGGGSVELPLGEWLDIHQSGEMRWGKLTSFVRYSSAQHSLSLMSREHRWLGARMRSHSVPGPGSSLYVDGSDRGTWLVHKTTRSTGGMNVYGFTMSCIERCGHLRSPIMDVVDPKQVVHQLPALSRRRWTIYTVKVDDLNLSSP

SEQ ID NO: 1012247 - protein, 213 aa, Homo sapiens
MANCQCTPRAGGPLLRPLMARQAYWEDQPGAPCPLIPSFPTYTRCNRRASSFFCVSLNGVNGTRINIDSNRATTHRRKKRKPFLVYHDFYTSLTPPLHVQRVRAQGRKGPRTCLARVGRRGEDYACVWGPCRTPPAQKRRDRKGRRSASIPPCINAVRQALSGPTSVRAPIDVSIGPRGLLLPPGFTAPNTHLGDTPLMNPVARVQFEGPNSV

SEQ ID NO: 1012248 - protein, 251 aa, Homo sapiens
KIYTFNKDHDRVKLGVDTYLASTWTTSTCTPRSEQVPEASSCITRCFMSALTAWKGPTSFLRPLGSLRCCFPASDQDGSPYVSSMLLEQKTTFGPVPSSPGEAQGTVCWLAVSPVRAKLDRQSPAVFQPSPLASHVRTALGLLRSSLYSRERDQSGQHDGVMVQRLVRGALTVVLCGAKVPIARQRGTELSGGHVARVPTYNALLRAVAAIPPYWTCASVPAAISFLAGYWRSRGLGGAECYRVFRSRARA

SEQ ID NO: 1012249 - protein, 66 aa, Homo sapiens
MSCARKGRRIADVGRGSHGRLRWGKNGHGSGTGLWKWAEITWQGNSRKRKEVHKVHSTQTVRGAHP

SEQ ID NO: 1012250 - protein, 248 aa, Homo sapiens
TETDLIKAPECNGPQISAGPGVPHPDDPPETLQEAWATKDDHMGSYGPAFYQSYGASGQFSHEFAGGNQLFSVDLKSREAVWSLPEFGDFARFDPQGGLAGIGVIKAPSGLSWLERSEPQLEPIYSCAPLGDLCHPTRSRGGDWASRKHRSSASVDEHLAPLVITYHLDCADGQTVTEDVAQSSFYSQPDHLFRKFHFLPFVPSGEDVYELTGGALVAWMRHSSGIEELQVPIPSADAMESPDLCPEA

SEQ ID NO: 1012251 - protein, 44 aa, Homo sapiens
MTAPVVCIPPGDIGCTLHHVSDGRKSNRLKRIKTAQTMTPKHKW

SEQ ID NO: 1012252 - protein, 149 aa, Homo sapiens
MRLIDLLEVLDPEIQELYEEDEASVRTASTLESSLQCQNAAGASYSIFTGERAMLVCGTECGWTEENVRRFHGQTSKCITGCRQTTDVVPCEIKYDRRRGKLGAPKARAFPGPVISLLAPLVTLDRGISLMARDLATALLRYVEPPGRS

SEQ ID NO: 1012253 - protein, 211 aa, Homo sapiens
MVALGCTSAGPARGCRVAAGVMLGTDCMLAIILVNCDDDFGGDHRSGGGRLCLAIHGHVTERITLVLTGYFSYVVNVRHAVSDHKWSRRRNLENLGDAEDPGTGTEGIWGLRPPKGRSFSSLESSLDRSNSLSWYGGESYIQSMEPGANVLSSRSLGWVEVPEEDLAPGTDAVFAVNNCIQQLAQTRCRKPASKMVPGGQNIADDPEEGMP

SEQ ID NO: 1012254 - protein, 120 aa, Homo sapiens
QALSPSLQMPCGEPGGGRVWPRIPDLRIVQLRFLLMPVPDAPRETLPVTRRADGGATAITERVAPYYEGLVSNPSTVQIDVDLSDKNEEGQVKMSGQRSDEELEDAENELVGESEIRDAM

SEQ ID NO: 1012255 - protein, 212 aa, Homo sapiens
RGLGEAGEGGPTVRGTGRGQRVAPGAVSRNRGASLTGPPSMKTPADTGFAFPELVPYKPRVVPWSSRHDPAVATLSWSCMREWRSTRASFACAGWTTGNSSIEMTLDECGPAVGLFAKVAKPQDELLINAVVRALRYYYNKRISAQMTKGETRSALRELQLSTKTVCWSITHSIDVGLAEWVQCPESLLPPRCRRVVAHFRFRIPSVRSSEV

SEQ ID NO: 1012256 - protein, 291 aa, Homo sapiens
MAVLLALLMAGLCPAARSALLCYSCKAQVSNEDCLQVENCTQLGEQCWTARIREWGDDEPPGLGLCLLKLVILFLAKSVAQSVCCFPFHLSPTRPVTCTAQAIHPSILSLQSILLHLSTLLHFILLPLPHSFHSYTTIRRSAHTGPRRPSREASTYVHSPALSERSRRDGPIVPQEICEWAETEGRRTQAPRTGLRILEGRGPGVTSKKHLGHGWRQERRPGGQCQGTVQHNKGETPVPGSPMFPKAQLGPPEAVIRQRLQFGTAWMTSQELLRGHNEIECCNPECALQGG

SEQ ID NO: 1012257 - protein, 278 aa, Homo sapiens
MRVVVIGAGVIGLSTRASASMSATTQSCSHLDSKGRTADRFTPDSPCTDVVCRALASPCTLSDSQQPYRRRYRGSQTRSCGSYSPEAMVQVLRNSLVKPWAWIPYILVATNHLSHEALFRDLFAWHRDDQYRGNVLESWARPEHAGVVFRHEFNRLSVPGFRHDGRPYIYVARGTEKLSLTSWALNVDTRLDLGRMRRSWKSVRLPEALDNGAKLHHRRRRWANGGNGAPRTGGTWSKQAHVRAVNRGLEAPANQGERTPPLGMARPKGPRARAQAIR

SEQ ID NO: 1012258 - protein, 202 aa, Homo sapiens
AGEVVVLVAHKPSRASPRRVERHTLLAAAMTEQMTLRGTRQGPQGLWVTHDRYYPVSSRNMILIDRLEIEHQYNSCGKRDRGSEDQTMDIPTALLCGGSLRTVDVEMSVDRPQDGPRFALLRRPWDRKPVAGPPGGTSPIQNRVANASSNRPRGRKLCGLEEAPELNPKNGRMGWPLGKGVVWGPPVSFSPFVENPKTPGAQ

SEQ ID NO: 1012259 - protein, 46 aa, Homo sapiens
DGAVTRTQQGHAGGDSWTPTLLAATGVAEGGSVAPSHISLQTLVAS

SEQ ID NO: 1012260 - protein, 190 aa, Homo sapiens
MRNPSILARCQAVCVLEPFMSVQEFAGTSSSTISSDVRCTSDIMLSQKKCPQGKCQPGTKSSPGWSWEAGPVGSFPIFTEYTSGSSVCPFGVCLGPAACRLSLCMTGLEFRILLHFSQTGAPVAPRGTGAALDHDEHGPQPVWDIMFQVAVPKVNESEADSGNPAPSFPAFSPLDASKCDISDACCLNIP

SEQ ID NO: 1012261 - protein, 70 aa, Homo sapiens
MSVRSPVQAKWLAALTQYVPSRVSSQWILMGTPSVLPPNSGVNQVSSSKGLGGGWVVLLLRPLLGPLAPF

SEQ ID NO: 1012262 - protein, 294 aa, Homo sapiens
QNYGERESRSASRMWIVLTDRGNLQGIPLSNGLAPRKIPGVPDSKSRLPSLNLGLDPERSSRRHYTRSTVFAPAPIDDHRSKVLQIEIIVDGTATAIAPMSTRQASLWEVWANPDPNCCLGVLWADAVYDHRTRDLTQNVFSNIWSQLPTVSTCTMTSSLGVQVGFAFVYFRNCDDAKEAKERANGMAACMGVGSRVRALYNDKDHIRQHQEFTWGDLTYGSSRRRDYYDLEDMIGAMMIRDYYSRSYPGGGGRGGKLESWPRTGIGLIEGRHLLLTIRPGTDTDHVPSISDHS

SEQ ID NO: 1012263 - protein, 267 aa, Homo sapiens
ETLGCGCMCAWRAPFFRRGGQAVCRTVANGLVAQGEELVEQPPWRHTGRAGACCSAWRLVWSQQQTNALTAADGAVAGQWTWSLDCFLCERRVRTVDALASVCRTRAQGLPMCWEQVPVLDDGSLEDIQRDFQGGTAGPMMTPTIISGGLSGPGPDSPVREGLLHADCSGKEVTLEISRYFLQMTETTCSDSSVGSLANVQVSGGGPSFSLCDERLPGSANELEALWPPEARRLPLSPQGTVRTAVESQVMTQTQSLSFLLGSSSSL

SEQ ID NO: 1012264 - protein, 156 aa, Homo sapiens
MLLHRSPACEHARAGSSPRDGYMTERAGATVTLGDLIRHPSTSSIARRVTVNAERTVHAIDGTPTENEPTGVGKVRQMFDQYRYTRNLVDQRNMDHLNLDRFSVVGRTDIVQPVSLRSYHSPNACLERWLQRESTARHKLGLGLTMDSNEYGHRTV

SEQ ID NO: 1012265 - protein, 310 aa, Homo sapiens
YGCATADQRVVGSRRVPPGGGLRLRRCLRLSCSALGLAPTSPLRPSSAVGHLGESVHTHVTDEDIVGYLLTSEAAARPFCRLTGDWDLFVSVVLQLEATLSSNWEEDSNSVVLSFDSAGQTLGSEYDRLGFLLNLDSKLPAELATKYANFSEGACKPGYASALMTAIFPRFSKPAPMFLDDSFRKWARIREFVPLFGIKGQDNLIKAILSVTTEYRLTLALEKPPLPAMHHRGAGGVLAQQSLWGSRIDDYVTFVGENCIRHQLKGLEKGRWAAKRHLASTYPEGPMARADRYEREILLAPAGSLADLSA

SEQ ID NO: 1012266 - protein, 131 aa, Homo sapiens
MNARLRSFYDEAYGHRQLLMTLWVKNVQVLMWSELSGGNDTDQGFPMKDAVLTHGRVRLLLSKVGIPVTRANENWRTDRELSASCVRSCGLQHLSVLNRCASCKNTMDETGIFLDCTDDYKCLAAWDPKKS

SEQ ID NO: 1012267 - protein, 35 aa, Homo sapiens
EEENFYQQQQQSELQPGASEDISKNSAAGHPGPAP

SEQ ID NO: 1012268 - protein, 49 aa, Homo sapiens
MFGGFSRSFYSRYNCKIPNGPGFEKSLSCIRSFTTCTLEHFGTGHRESP

SEQ ID NO: 1012269 - protein, 315 aa, Homo sapiens
MVHKFTSLETLTHAMLLTCGSALSPQPRGKMKPKLMYQELKVPAVGARTSELPMNEIEAWNGCGRRNARWVLLGPHSGGCGLRSPLMTQLFLVGNTGDYASLYGTQRMSPSPPGYDPMEASCMVESDSLKWACDLTPNCAHTVRNPVLTYASAIGLGPVASALVAAQASALALSGLPFLNWCTPSNLKHMKDTRRTARKAPTEAKLGVELEGPFRASMLEPLRAPKRGAGNRSRHFGLMKPKGAKPERPPKRNQGRVHLATGLLSLARRRVAPSGPRRFGPRTNARHALTPVGGPIGITQRFLEVVWTEGPRSRN

SEQ ID NO: 1012270 - protein, 77 aa, Homo sapiens
MSLVSPEVAEETFREIKSGERENLEGEGKGGERPLSAAAKKTDSAKKRAAARLESEAFPAPAGRTCGAHFFKPVVRM

SEQ ID NO: 1012271 - protein, 272 aa, Homo sapiens
MSFLRSYGRVRASSMRRSEQPGPISQPAPGRSLRREREDAPATETLLARKAALDLPPWCSESGRPLAARPLRPEQYCAASPGLPPQRAAIWRCHEDTSQSSNLIEAGLRAIPDAVLLFPDSLTLSIVLALGTRCPGFQVDPERAPFVLSCRVRPSRGLRVLEKPEAAQAADSASSPIGHVLAKPEEGVECTARETYVATLVGRSWALPSGVPGGPLGPPVHGRSDGEMPAPGYRGPLRGNPFGSGKPARGHTAMGKAATSEGAPASPPQIPV

SEQ ID NO: 1012272 - protein, 160 aa, Homo sapiens
GGLAGRSLGGVLWWLPGHTLWLVAQMQVVKGALLRWRKDRAVPSRVEETLHTPGPFRNWGFALLVHMAPSQLGKPGELLQPLVGLWSSAPSSIALAVVSLDCRPCCLPHCESPPTPNSATVVTVHCPVHVPLRGRGLSWFCTACTLRCLQPIPATYRVRQ

SEQ ID NO: 1012273 - protein, 182 aa, Homo sapiens
MASPQRAVASLRSTVPCTVMGRPGLNPFVGGITRGGSRHASFKAIGVPRGRQRKFQIRSLRRRKKLGRGRGGGFHWPRKYSVPLIPNLAPWETPGFISHSAGSYGLWGHRKGSGVVRPKGPLWHAGALPTRGAYLGQRPLVFGTRQGPQMTEAPINFWPDGHGENALNRNGRNCQMRFPCVP

SEQ ID NO: 1012274 - protein, 257 aa, Homo sapiens
MVKLLVARNPVHGGRVLLRCVLGSPAPREDHLMTDLRRRIARRKILSRRATPFGGGVSLATCFNALLGRCEENKLQKVLSLGHISTDYPLAETILLLGFFMTSHSWSSWILTFRKEKPSFIELETFKRRSRSGQQTLEYESPVHGWALRGHALYVEPHGHGPVLSVQGLSLRQPVRLLRLAFALSATRVFEGLAWGLQEEGEKSGEPVRGGGRPRDTGGVALGISMAGGHALRDGGKLGVTVSGMIPWDIRPGLGIE

SEQ ID NO: 1012275 - protein, 301 aa, Homo sapiens
VQVRAEGARGRGPRNKVPGAWSGAGSGLARMTDPILAKAKASKLQRRGHPRAVPVSGRRATVSQRIAQNLVVQHRLQAERLLAGDTSRPAHEGGEMAEAGYREIVFGFQSACDHTPNDVRGRRTGVGQALGSLMVIPEETLGSRPKTPGTKDRVKLDLRDSDYDIFHLEDSLIDRSRVRQLRFNPHWRTGYYNAVYFNSELMVQWIWDDRHLVKPELQAGGMINPGSKLRARPKTGIKEVAKAESVELEYKEAGGSASSKCCRTGTTNNNLARTDALVSYKITTYSVQRSILTLANGQNLE

SEQ ID NO: 1012276 - protein, 264 aa, Homo sapiens
LPPGAEKMGSQAEPRPYRRRRHVVPQIPTLTRTPVACRCSRPGPRGPRAPAPMSVRTRCIYIVTLIKAPTSCWPIRCLSFIDFYLTMLAILQPSDLHSTAPIMNAKYTEENTEQQITYIKTRNTQNDKQYKQQQQNKQKKSASTINTPPHKTKNTRHPHTNTTQNKTPHQNYIQQTHIITTNIQHKTTNHNKKHHTLHHSNNNNINKKNTTHNHTKQQHQPTTSPAQKPKIKIKTQSNNNKLHHHTPSNTHSKYNNNTTKKNTQ

SEQ ID NO: 1012277 - protein, 214 aa, Homo sapiens
ARLAGDDMEVIATELMNILKKVVETYTLIWRLMVLAVDTCRSMVAADGVSNSTGKLGFEEFKYSVEQHQEGDMASIHNSVDTDRSGYHFAEVNSQCAFEAAGFHLELSISITSSSERYSDESGNMDFDKLHHAAWSGWYAIVPWPSNLLRKMASGQSPGEHPGVAAADYVLPELEPQEPTHSPFLAIGVTWSLGLCQGRSLSARRIFVGACCSH

SEQ ID NO: 1012278 - protein, 394 aa, Homo sapiens
RELGAAVPGSLGAERAWAGGRGLERMRSRELLPGPAPSPALPSRRSAGPAAAAPSSWSKTNQPPKDPEFTVPAAGARTLYPRVRREQIRSAPALPLATLVLTSDQIIPRDDEDRIPNPHLKSTLANVSTDNGKKMTKESHPTNETSSHTDSRSKHQTWTAKPTSTRQKATPETRAPAAQPTAKPPKKITQHNPREQSPKHNPAKCTTPKAIETNPSMSAPNPTNPPPAPPTATQPNKTTTHTQHTNQKHPDTHTQTPSQPTLNHPNQQGDNTTKQQNPQTHHPHHYNKPNPTRTQQTTNTAKTTEPHQLHQITARTQSHTLQTQQRRKPHENTPQKKIPNLKTTHKHKKKTTTTQTTNKTNTHTIHTITKQKPTPIHTNTPKTQHTTTSNKKTH

SEQ ID NO: 1012279 - protein, 167 aa, Homo sapiens
PGQWRAPLPQPRVSPCSLISDCCASNQRDSVGVGPSEPGAGYSLVVRRFLSRSEKRNIRVGVTDFPGASVTPFFDSERELPDPLRFPGEAMPRPASARAQCMHPLACIHCLALPSEMNPVPQMEMQKSPVFCVAHAGSCRPELFLFGHLGSGFGITCLNGKNQLKMD

SEQ ID NO: 1012280 - protein, 296 aa, Homo sapiens
MVQTTMNGVLTSDNGGAGLTHEPLSADELDILNNGNPELCSLLVLLQALDGMAIHTTGSGNNTPLETRTILEFIYIPFSVLVRLLSSTTVPAELRSELCCSRLYPCEVQMRRPVYRGYTAGSCVTQGKQDTTCGTYGKEQVSKYYCTNQLMICNSFVKETECIIYVKLPFQKAEVKIMSPGEFKLVLRNMCPSVQLAANSSFLGSVCSRVVVRVALKGLGDSPFRWMYMFLTLHYPSVGSKTGMRGAFWKGPGGTVAKLVQGYHLQCCTKACRTRKHVIEAPGTGPRFKIRGLPKD

SEQ ID NO: 1012281 - protein, 280 aa, Homo sapiens
RERTQVFWQWAPVGHTSGPGCRRPWLGDCSPRPEYSYLVSPAVRGVGDVHLKEAHLGDGHIWHLEAARPSALATVATLTPIHMCLESRLNKKGPQGLADSMGSDKESPEADCQKQFQACSERHPEAWPKNGSYRPSYEEDAVDSTVTTKQAHSWGTCLVTPARGSGTPMGRYKWDALESVWCKMSRVGGHVVPNIDWNETVWHRRWLDYSCPWVMVAYGTCGARSSPLYQVIADNARRRPRKPSLKKGHQVDAAGRDGDVGAVKSSQLAMNGGPEPSPLP

SEQ ID NO: 1012282 - protein, 119 aa, Homo sapiens
MVAGQLIPPFTLLLPHLAARRLCPRTLPPLSGPRQRPGLYFSKMVPVRRLPRTRRRAGVGAQRPERAPALVDFASPASPAPPPHDVPRGVRHQRKHTSDADAARRSVDPMECRVALRQR

SEQ ID NO: 1012283 - protein, 301 aa, Homo sapiens
MADAVVLGLSETGHCSTNGSTGDQPETPALHFAGIEGTEENRGRGIYTFSLLRDVASESLFLREIAAYRTYLSTYFRYRPVEAQEVPNTGSIMALTVHDIVCTKSATLGLPFHRKLTACIYGVQPQGLLAKSSNGIYVHAGEATNEGWWCISTRSVTVERDRDRTELSVQPLGSGPAADELMAFLKLGQPYTATWTLPKSDTGKRLSAEPAGIFLASHPGTMMPLAHISTDGHSKVRPFPLVFHRSRSQTDPWGTSNRLVSVNATITGNYSYVGISKGDTTIIQAGPHSFISFRRTIVQPI

SEQ ID NO: 1012284 - protein, 68 aa, Homo sapiens
ATNCSTEARLQNSPERGIIRAGRFRHGCQVQVSSTVTALGSPSRFVMALVRRESAVDVSSKERWTLRP

SEQ ID NO: 1012285 - protein, 234 aa, Homo sapiens
LEELHLRQLCAERYVPPGSDVLAAPQSHSIPSPPGAHLLKTRSCQALGGRVPGLLGELRSARAMGPAAWGRGLLPGGAAFPDLLAWCFLLALSPQAPGSRGAEAVWTAYLNVSWRVPHTGSEPYGVGRLSEEGVYGQDFARWEPCGLGVLVPALTGPRWPLKAALVNPHTKFHGVPTGLGESTVQSLLWVSGPHPNRRPVGLDTLSAMHRRIPFWALIARPRGAVPWETRSTLF

SEQ ID NO: 1012286 - protein, 366 aa, Homo sapiens
MRIANRTRFRLAFLGQRRRLDSRSGHDGGRVRATIACARRPSHPCSRDVHRLRGDARCTCRSACALHLSWLTILGRPALVSGTLYGDSSSMSLSNKVVAEFFAHLWAKRDFQGQQDSVPCRTYVLVHSTMIWPSPLCNSVGPSLPAPNVLVITTALDLSVPASHWGLGSWLAYISNERILRFATHVVTHGPARLSRGPFDEPSPKGSTRATGGKGKQHKLDPCKCFNFREGFEKFPSVGYNALSLRLDPRTSIAHINTKHAGGAAAHSSETGVSTPLSDARAPNTAIYAGLLPPGAAYALGSPLTSRVGTPPLNLCVYHAAHIALDYAGPQRTFMDPTTDRLCQQSAHHFIHCGVYHILGSYLCWE

SEQ ID NO: 1012287 - protein, 165 aa, Homo sapiens
MAPLSGRTAISACWWLCVSSPTCVCPETMPLDPLGLPVGPPDRTPLGAAARLHGPGYGAMDVGNHHEALWPLSEMVPGTETGNRDDREGVPTGRHGTSCTDVGLSCAQTLSQRLQHRYTRGRQGASRWTLVVKLWSHAPLTAKPPGRPLERYLSLSPWLLSRRRL

SEQ ID NO: 1012288 - protein, 241 aa, Homo sapiens
TTLGVGKQTSGPLLQKSSGWLLTSLRRGKGCETKQTQLQLPAGGGCATLRRPLGFRVSLSLSQPLPRFSVSLSLSLSLPRRLPQNMSTGSLSDVEELQEVEMWECDGLKMDSNKEFVTCNESTEESSNCENGSPQKGRRGLGKRRKAPTKKSPPESGSSAGGEVRSNRKQAQQTRESGARMRVLSNGFSRLKSSLTWCDPQTAKLSKAGSTLRLESSYIAHLRQILVYLTNTEKRVHSPGQ

SEQ ID NO: 1012289 - protein, 35 aa, Homo sapiens
DEETLRRRRSGWVWMPAEGEGRQPQWRLVCADVVL

SEQ ID NO: 1012290 - protein, 268 aa, Homo sapiens
SCGAGGRPRGGAMEMPLPPDDQELRNVIDKLAQFVARNGPEFEKMTMEKQKDNPKFSFLFGGEFYSYYKCKLALDAACSSSASSRPRSWSQPPPCHPCQQSSAVSPPEPQSAPAQGRAHPWTSSLSVSSQVVRAPDMSGSINFLARQTGASDSVPWPTAVVGMSDARSYLEEHPRRRPLIEFDNSPAAPSSDDVHSMDANLGRESKWMFSTVPGALSRCVLMAEQLRNPTHGDGAHFELRAATVIYLIKCPLLHHWQRMQAREADWTA

SEQ ID NO: 1012291 - protein, 71 aa, Homo sapiens
WIICKESISVSSEQLAQFRRPSIKVEGDNAVPMQHNNLPNPTSEGQNSESFILMILRRNLSFLKNTALLLT

SEQ ID NO: 1012292 - protein, 355 aa, Homo sapiens
RTGEEATKCGVCQKTVYFAEERSVAKASSFHKSCFLCMVCEEESGQITTVAVHGEEIYCKSCYGERSMGPRMAMATAQGAVHPQQLTTGESLRYQALRKPLASRSNNKPNALQYLPMKIGGSDALPPMQPGQSMLREKVIGAAECPGQEGLLLDVPSVCNRALTLNHPGQDKAWRMIYCKGTVTATKLRAQGLRLSVQGAGALGSTLSEATITTTIALTTPALFIAISHSHQLSETSQDHHSAHPCQHYHYMTRTSGPSGSPKERRGQPEVPPPPTRTPTRPGNPGQPRSKLAKTSKKIRESKSEESKAPLTNTQDPQEPPNTQAHHGKTDTDNHLNQRNTARHKHRDTQDKAAQ

SEQ ID NO: 1012293 - protein, 214 aa, Homo sapiens
KETRSPTAHGDAGPSTRTSYAELWVANFGASCLGGLEILGPTPRGLRGVLLKAVLRCGNADRRGVPRRRPVAYCHGNPWPSGTCEAAHPPDVTHEGGPGRAAARRPPRRPSGACCPVNASIMTTTAVWLVGGDYISGLDTDTAAFRLQYDKWQREGFMRKGTGASLDKQSGTVHFKHLAVNRSKSASTRGHYVVRRSLRLSKGTYLWGFRSGIP

SEQ ID NO: 1012294 - protein, 153 aa, Homo sapiens
SKKLERYLKGENPFYLTAPEEEKEQEEADGRCPGRGGAGRSGGDLGGRRVACRRSLPCPLGSHAPRGRCLPARTARRPQRRRRRAPCSLVVGRGAVIGSEIPAGKSLGLSGRVSDDRREWLARGAPETRARGGPGSPGPVGPGKSLGKNPKTL

SEQ ID NO: 1012295 - protein, 109 aa, Homo sapiens
MGPERPSPHPALAQQPGPDSQASGKRTSGGRSRVTQGFTPSSGSVLTQRRPGPHDWTPQRTGPPPANKTKVTHSGAGILQRTPQGTEGLQGFENQCRTQPSSLTARARR

SEQ ID NO: 1012296 - protein, 51 aa, Homo sapiens
MELSRYRVAQVDPGALLLWRCSAVSYGCVLRPEGIRAWAPTIGAFRGGDRI

SEQ ID NO: 1012297 - protein, 119 aa, Homo sapiens
MCEVLHVGALRFPGSVLSGRGTVWSMPEKKARRVTSQPEPRSRAPASWKSDVCYSSQEIGHDKSELPAEHFVNLISNSSSALRNSDLHLIKLVMKGTPSKEFSQEVHVHQFEEKTAIVI

SEQ ID NO: 1012298 - protein, 153 aa, Homo sapiens
MYRLMSAVTARAAAPGGLASSCGRRGVHQSRLVLPLSAHVLGSGGAPLGAGGWELALGVNAGSVALSGRWPLGAQSPRCAPPVPLERRQPFLGLMPCPTGQAGSPFRPPRVGDPFPAKNPRAAALASRCFARAIESSRDLLHRIKDEVGAPGI

SEQ ID NO: 1012299 - protein, 120 aa, Homo sapiens
QGHLVGIDIFTGKKYARISCPSTHNMDVPSIKRNDFQADWHPGWVPITAPETAGRYERTFVSLRETWARRLSQKYDCGEDILITVLSAMTEDGRLWRIIWPWADITGVPGLAVVAGEVIL

SEQ ID NO: 1012300 - protein, 505 aa, Homo sapiens
RDWRVGLSSTFKPLLLAARRRVGLSRSGSPGPATVPGQSSRGRTSFIPRTNEPWSNPETVDNAMCEDAERRLDWADASSHRVSRQGPRGSGMGRAVSASRDSTGCQRHDQALMPTFGRSNLMLLVTESRLTVRPGKAVTLVSCMARSRCNFACCSPEQVPWRRTPSSPAIQHSPRTAWTRIAHGTLPDASRPARCPGSASGRSPCSQAHARSRNPLASFALTRADIGHPSEDRHANPLLIARRRSMPVGPLATPLAFPLALNRVDSFHFADPPPPRRCRPSSWGTQSSPLPSALENRVRPGLRPLSLLDAIVPTAFRPEPPASLEVSMRGLGSPPSAPQHRPRRHLFHDGALARCRPAGYQRRRPTPRTPLSHVDEPLGAGFPRRTRPSAAPPSAAPAPQHGATLPRPPCHPTPFDNVPCIQPPLCRRTSFGPAPWFGPPSDCTLHLVPPSATPWSRPGPSRSRPPFPNAAPFWPWHAPTPSARPWGASPHSHRLCALDLRFAGA

SEQ ID NO: 1012301 - protein, 249 aa, Homo sapiens
MENRRSPYKSRGRRITKTIRAKKSLTGKDTKFARGIYRLSHGLEDIYHENRSDVTQETSHVTGIQQSTVAANGTTKSMNPRYINPTISGTSQRDCLTKVPRTIIGEQDTASSVKVMLGKLDSHTQKEEDLDPRALALYNQLTENASKPNCSDENDYKHYYKNNIRGPCFSTIGSHDRIPVNYEASRGTVTAKKKAITPEWGSTHESQHGSPGSPRNTKPDQSAIDKRTDRADTQVRHLTQSNGGIPDPE

SEQ ID NO: 1012302 - protein, 242 aa, Homo sapiens
VAGCEPRTASGGGCSQLLAVTDLPPPPTPHASSLPGSGRLSMGTSGDPAKVVETVIPGHTWQLRNVAVTYFEEMIVSETPHSSLDDMNISYGFVLRLKNLELKLAVEDQDVLCEDAGGPINPSDINMIQGNYGLLPESACCWTGTNGVAHGGYAVGSTCDRAERHGRPGVIPANAGLGTWRTGGCVHAEASSDPKFRCAHPSSERCFLGVHPCYCPTGCCMDFRATCMPGHSVFRMHPTAAV

SEQ ID NO: 1012303 - protein, 42 aa, Homo sapiens
MQTIIAGMHGQRQVLHRIAAVAAAGQPDVEMRMSRMGGAEPA

SEQ ID NO: 1012304 - protein, 317 aa, Homo sapiens
PAPGVPQSLARDAPAGLLGRLPRQWPGLCSTRLSGALLSPSDRPPSSPFPPVPGSPFAPSLRPPAWMDAPRLPVRPGGLASEVVLLFVYADDCLAHGVAKIANLTAGDGTTPYCCSYYAYIGEFLSGTAIAGMSWELVLSTHCAVICWDSPLCTLHCCMKNHTGDPALGTPQDDLTSTPLSSYPAGTTTLPVTHHSHWNTVQHIASLHTPPPPQRSTHSRPPPPCPTPGTPPPPPNLHAPTTHEPLLPNWRRLSAPGPPNQLPSTPETPRHDQHTRLHPPTQPPTARPTTAAHACAPPPPTDTPPTPPPRPPRRTPP

SEQ ID NO: 1012305 - protein, 85 aa, Homo sapiens
LTLRYYESSVRRVQEMAQHRPKHHIAHKVDGTQRQELSGAGPPTLFPPLSGARLLAGGGPCEFQRHRVGQARTSLLPATLTVLCS

SEQ ID NO: 1012306 - protein, 251 aa, Homo sapiens
MADNLSVMCRRHPHANEETCDAGLQAFQQEGMANITGLKDQLLAAETRSVQGHRGPARRPHEEVEPSFWATLPPAKKKLLEAQSHFRKVEDLFLTFARKASAFNSWFENARGGLEQSPCAVTPWKKSRAWREAHDAFRSSLSSAQADFNQRGRAGTLQIKSFRGRTPNPTPGFTMEALEENWRNLQKIIKERGAGSCGRNSGGQEGRTDKAGPRRFAPAPPMAFHPVRSKRPGEYLLGLGIALSTSAIRVY

SEQ ID NO: 1012307 - protein, 364 aa, Homo sapiens
GCHQPPGRYPPGENRVAPSQEAAVSSPCPRARRTVRPCCCPALPLAVTSVSLAEWCVRAVLPVSAVNLLDHERGLHLGAGQLAYALARWLHRPQASCQAHKIIAQNPQKMNLAHGCPRSGQMGVNLTRSNKETVEAQTTSCFLCCEATYHPLHPGLRLGPTCKPRHIAGLHVRPGLSTSQTLLDEERVMALSRARTPKRDYAMQCPNNTLCVRDTRKAAYSVQPPETHPNSPHGLRHGNAGQRIHLRIYTINESQTDESNRRKQRARQNKDTTKPKITSTQGEVNNAAPTTLSTLAPILHHLHIGASWVTCPLGTITLSTGLDTQSARYQTTTGSPTVAHHHNYSEADHQAVIYTPKVTRRSPE

SEQ ID NO: 1012308 - protein, 78 aa, Homo sapiens
GRTAACGEKCPFRARSDGAVPLYSHHLPHLPRCDESCCIGLPWPPQSDERSYNTLTAHLTMCSARFYVGDLARNHSYS

SEQ ID NO: 1012309 - protein, 310 aa, Homo sapiens
RAGHALAPAHTFTSAHEPPCGGCPLVATAVAACWLATWLWVPSSGRGAACGASTCVSAPAWCIRDAGVPGTASEQDLCCRWTVPDDCALPYLGAICYCDLFCNRTVSDCCPDFWDFCLGVPPLFPRSKDVCMDGRIYPVLGTYWDNCNLYAPASEKQAVGEYVTKETSALVDHRRLIKSHQPGQLWLGRLVNHSAFWGMTLDEGIRYRLGTIRPVYPSVMNHDEIYTVAEARVRCFPTGVEASGKWAKRDFMRPLEAKATCCKGTFGPFRMREGGVWESGYRGLKVEYSWRHVSARILTARETLVAMIQR

SEQ ID NO: 1012310 - protein, 185 aa, Homo sapiens
SSDWNRSNAPTQSPDEGQKADTICTSFMDVLKALSQNLFRPCSWVSGFCCFWHSLAPSDGLIRAVYNVPPIAQREKQTSNAYTVVNAEMEYYAMTSPDHSDDLCCFFILGSPIAVFRHASAQAKGTPWILDGNHGCASFPSQPRKVPSHPAPHIDARRACERTLPPTLIDVCPHVAVTTPLPQSQ

SEQ ID NO: 1012311 - protein, 192 aa, Homo sapiens
CQARCCGTSEMIDVLGVSKAEATMGYQSLDTNEAAPGRTTRGLRNVACIGAWHPARVAFSVARAGHAKATIYRTEINKTIYKIGQGYLIKDGKLSQEQCLSIDYDSYLTRASNLWVGFVHYGEVTNDFVMLKGCVVGTKKRVLSLRKSLLVADEAAGLWTQDRPEVTLTPAPSLAMGRFQTMEENESIHGST

SEQ ID NO: 1012312 - protein, 262 aa, Homo sapiens
RAEDEPGRGAAAPGAQPGRPDPYRPYGGAIEAPTHRSDREHRFTRGTQHRRSMFKVCNSRRPTGPASNFLSPKAQQAPLAPRGPLACLPAARTAAPCPPVGPGDIGSSACRSAGGSDRRQDRSRSSVGIQLLARGTAGAKACPIITLNETGVGGLDDASGKTARPGGTAGDTRNRTLAVISYVPIHGPSDSWRLKAIDPNGDVAEKSRRDATCQTEREPLLGERWHRDGGHQTRAEQGARFDTHCLEGLKDARWTQWAAVQS

SEQ ID NO: 1012313 - protein, 171 aa, Homo sapiens
FRVCADLSVPSAQPAVVPGQSSPPCGWGGGGGCTPGPPIHQQPPERRVVTVVFSRPPAGPPVAFLLLLPHADRAVGEPRAVPTDPLYGSWQGGVDLVCQLTSWMPVEKRYNSVLYGGLIWLGILCPCSFCVRTLTGANSELTMGRRPVMQLCLNRVKATSYTDIEDTSREL

SEQ ID NO: 1012314 - protein, 239 aa, Homo sapiens
WAAGRTADPERADEQAPARMDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKSGRYSLLW

SEQ ID NO: 1012315 - protein, 57 aa, Homo sapiens
WYGRNFGMPGREHGACRIWRPWGTCWLPVAALKVCHRRLRRALVGLPPTPPSPPGFT

SEQ ID NO: 1012316 - protein, 117 aa, Homo sapiens
GSGRLGGRTPSPRAAQEPATARERDRGGGGGVDRDGRLSPEQQQQLQPPVSQVLRCPVPPASAAGCARSPVIRYSLFVRLKGCAVTVLERGGASSPAGAAGAMRRRMERAAGLAAAA

SEQ ID NO: 1012317 - protein, 120 aa, Homo sapiens
ALRKLEVEANNAFEQISMTCMRTRGVSSVYLWDLDHEAFAGVILINEGCESRAVKRDDHTGCSLEFHSTSGRTCRRNPSTRTDHYKLTSTVIAVRCETNRNLALGTMNLGRRSLIHEQIA

SEQ ID NO: 1012318 - protein, 61 aa, Homo sapiens
MPQSGYEVQGNTASLTTCRGTILHRTEKWLMRNLFHAHEILSSDATERPCDRDIHHNNVEK

SEQ ID NO: 1012319 - protein, 203 aa, Homo sapiens
MLIPPKQLATPGRQQQQQQACSRKQQPGCRWPAEPSQPRWTPACNHSPSKSGRIKLQRNLQLLPKHERPVGLMWKRKGSNVTMYHIKRRDDWSRSVKWHDSDLTRARKETRELETRHKIHDVEDWMAVKQKSGKAQSQERGYKIQRLARKARQEIIGIQESDVPTLEKAHEAALDSKGREETNSRNAYWHKSGKDRITPIKRI

SEQ ID NO: 1012320 - protein, 145 aa, Homo sapiens
GLVAGLQVDCVNGEQAAGSAEPPEGSGRFRLDACMPRLALSGAPGSAIVARGTMVVVLRVRASDVPVCRDVSQCAGSKGLHTPTMLLIGKSMTWVLKDVNLRPEQTGRTSVFGNVLHALWDRGQIMVPRSPQVTEYDDTRRLMPY

SEQ ID NO: 1012321 - protein, 182 aa, Homo sapiens
RRRGGGGRRRGGRLASGLFERVPLGPGPCAPAPRLDAALRWLSLSASPRRDPWSLKSEQEPPRQRHERTYFAIWRSDRCLLPLYAGSLRCLYASERDSAKRDAGTDSMREPAEPEGVVLRGGHSENSLLRASYVVETRQKAPPAGKRRSPSFPLDKGQGEQKRNLGKSSHRAIQNLMNALCA

SEQ ID NO: 1012322 - protein, 169 aa, Homo sapiens
MPLLQLVLETREERMESEKHGKRFERRQQEVETELKMWDPHNDPNAQGDAFKTLFVARVNYDTTESKLRRELRCTDLSKRIRMVYSKRSGNAPVGLIAVSIGGTDSHELMHMQLRLTKPRRIGTEALDCVSEGVLCWTFGSREAQNSVKVPWKCPGGAKYGGASGLVSM

SEQ ID NO: 1012323 - protein, 241 aa, Homo sapiens
LEKIWDYLKLVRINTKPKGQVTRLHIPSWCFLTPGPQLEDFCMKIHKKSYQQNLNMLWCLGSTLLKHNTSESRVQRPLALEDEDVNSNLCTEVNTFPFSHLPDEPQQRSPMIKHPTPGSILVSWHVTGVRIQGTGDGGHPNWELSFVLPWCQPCMSRLHTRDLARAESRLSMRRQDKTREDTHINHHDRTSPQTKNQKQTTIEPIDKEEKTQTDKDSRINEAIQTQKIFERRRIPYTGQGD

SEQ ID NO: 1012324 - protein, 109 aa, Homo sapiens
LALEVTEGSAAGPGDEETGVLDSVSQCNQCVLGRAGVCDALLPAPALWSDLLRCPCCMQLWPLLQPNECVPDLLCALSISCCLLWRLPGTLLHCGGCWLATLFGDTSVP

SEQ ID NO: 1012325 - protein, 368 aa, Homo sapiens
MCLDGSPRSVCGCAGVAAAPEFPARIMTCLGPRSRAASRVSGSGGGAQCSHVPVLCAVVPVMCALQSSLAVMRCEVLERAVEPAGCAALLLCCHSCVVGMWHVPVACVPAAIRQWSGCASQRESQWARVWLCCADVVMESQVCCVYGDCPECGGGVTWVSSCTVGKANFATHGLQDGLLVAVPEDVLQFRVSGWACCAGRLFGLDVWTPGTSLEIAALLAPVLPPDCGLGGQWFANRRKIFRGDNVKHCVIPFIVCWAMDVVALWRVTDQFPCYISFARLGARSRGDPKPIFAQALVRGVYCKTGLGNDLGVGPFTRITFVRTSCQSLVIRRTFVRRPGAIGEPTNSAGARHTLGGGQFNVTAFGGRK

SEQ ID NO: 1012326 - protein, 84 aa, Homo sapiens
VAEVLVLVGIIFIYEKRRRPEDVLWSELIERPCSASLKMQRAGPEGLKARNVTPEGTLLAREAGGAVEEQRPLTYRCLQHVQVP

SEQ ID NO: 1012327 - protein, 102 aa, Homo sapiens
MIHEMVGLERIRAVEYCHRTQAHSRTGHDQFQKWSWVMSRVWDNGYPWDMLLVSRFGTFLKNKNTEQPSLLVVHEADECKGFKHENYGLMPLKWSPEERACI

SEQ ID NO: 1012328 - protein, 197 aa, Homo sapiens
MPLPILCCVKLPWLVEPLEVASCEGWIREEDAGLEQRKLTHEVAAFLSEATESSSCEIGLLVGGSDYCEDLLSSWVTGDEVIEKFDYVFAENGTGQSSASEDVLSECENHPGTTLGGCELSCSDIEFTLSAIQLNNACLTTGLAQRRQLETLHRSSWQLAWLEQSRPKSRPRFVSPWAGTGIRVPSETGTRDENIGA

SEQ ID NO: 1012329 - protein, 91 aa, Homo sapiens
MRVSSPYHEQSACPPSVSIYLNRHIRLYYDLCPPFLEGVPHFRTDVLHCGVVILDIRRFCTNVVAKFLQHYRSCVFVALHLGLIRIGVNTD

SEQ ID NO: 1012330 - protein, 100 aa, Homo sapiens
MARTDVGSYDTTFPINAKHRHERVAHTTRQAREAYLRQRATQPPPTPANNTTKTPDRNIHAPGFVRPVSQQHVSSAMDKTNAHHTRNTPGQLAPGEEGKK

SEQ ID NO: 1012331 - protein, 139 aa, Homo sapiens
RKLRLRWGEASIHPADYQPVGSASPYTRPGDWALSPTLACIYIESIILHDDEVSSSRSDKIESATTLKASQGVQVLRPFRHWRMFAEGPVPTVNMGTPHRADVRGRVERCSETDWVLLAQTRDGSMPRALSVRGLASTP

SEQ ID NO: 1012332 - protein, 182 aa, Homo sapiens
MTIAGGGTLTLTPTGSIDRVHMDTKTVADHHRAGQTFTALRDSDRQSRPREQKALTGHQTPRDRKPAEVVVQELVPTGQKPTHRNQARSTMTEPSDAGQTMPRLLRRTNTTATDADSRAAKVPKSIRILRAKSIGQGTHNDTHRIPAPRSRSTQPHILTPWRTDSAAHGEPSHTLSRRKRGV

SEQ ID NO: 1012333 - protein, 105 aa, Homo sapiens
MTWQCRLSVQAKTELNRLVQDIGDEAIRLDLTLLSRESNDLVELIEARYEFAPDAGWKKEQGHFIVQLPRASVTKRAYYFQSMMTGLLYELVRTREHIHDSSKAS

SEQ ID NO: 1012334 - protein, 42 aa, Homo sapiens
MEAPWCRQLTGAANGLKMSVAFTQQRNVGQTMCPRTSPYETS

SEQ ID NO: 1012335 - protein, 30 aa, Homo sapiens
RLSARGTWSEEEQSRGPPEVGWLSHGSSGR

SEQ ID NO: 1012336 - protein, 226 aa, Homo sapiens
AKSANAPPATKVSGILSFLYPVPCAPGCPLSTTSSGEVKAGWGCPMCAEIVASSDDPLSGRARNPLIPLVSLSHRHTLAGIHVLAHQACCSLLPRGGLCQSCAPRAASAERGSLDKVQLCCCHDAGDSARSQTVEESRRSHKSLGLCIIVQARETVTGWRTIAAYILSGDYMVEGEKVNHEGVGPWTRQRKGTPMKSTKESGGRPRIDERASPAEGRPTVTGVTPD

SEQ ID NO: 1012337 - protein, 126 aa, Homo sapiens
MARSRAGRRMHRSGWFIYRGGVPRSAAWTCSTKRRVVQVYRLRARGGGVNRGLLAEAALPCMKRLCRQGRCKEAPAMEEAGSGEDAPCGHMIILAEMVGRMVGVFTNVKTLQACVDDQGPENDQRH

SEQ ID NO: 1012338 - protein, 182 aa, Homo sapiens
MRRCDIPADPVCHDLYGGIPWSPGRSGAGGVGQLGVRLIHPHFAGPCLVHILPGIWAFNARGHVPMLRWVHGFLAYEHSTGERSKACMIGAFAIPSGRRQHRGAPACWRSYHPQGGQGTAREKGRNVGPETDGNGPDGVQGPLRKLEHTQLRNHRPQGKPNIAWTKDTRSEIPQTLGQRTYH

SEQ ID NO: 1012339 - protein, 119 aa, Homo sapiens
MRTPSLPSCSSRRVSQASNALRVLSDPKLVARRDSEIVRGLSRLALLCSTRCSLLAWWSPCDVTHRYGLLVRSRGFRHDPFSLCVGLLSIHQTLCAPPDYRSYTGCSWKKGWAQCVLYR

SEQ ID NO: 1012340 - protein, 99 aa, Homo sapiens
ASGKMAACRAAQVRVYGSEPETEQEIVIIISSTVALHMLTLSAVRLVVGVPEQMLHGQYVGITGYTCELGSTLHPFHTSSLTSDQCQYMSDRPGKCRLI

SEQ ID NO: 1012341 - protein, 309 aa, Homo sapiens
TVPISNYYVGLAHLSRQVKTSERPVFPATGASSRRRQIQSVWCLDCSRLFTSCSLRAQCRQCSSRRGAPVPSQSSVVYHPYGPQAHTSWRRITLHIMQDLARVLLSGAVSLPSASRAGLACTLASLMSGAAQPRAGRADCGPWDVAAATRSSVYGSPGVAAQTAPRRHCPRPEARRARRACKHKRARRADAGPLAIPMVNWIHCSAPRGMKRVPRTLKYLDAWTLDERELLFNTVLKPGTVGMTVAGFLQSSPNRAGSKILVSRKFDRLRLRPRMHYEDYPHYGVVLNPYPSLAASAQAKANPKSLKLP

SEQ ID NO: 1012342 - protein, 79 aa, Homo sapiens
CTHQKAKAIGAPRSRSLCVVEGDGMMKVTKAGAPARTLCDLPSALSATHPQVTPHGETRVAAGSSQRVRHRGSMSLEIT

SEQ ID NO: 1012343 - protein, 282 aa, Homo sapiens
RQCRFGGGFLGPSGQWRLRPGPGQRAEDSMGVAVRVRVRSPGRLSDSRHGPVSWLLLHSRCLSSSVEQRADLSSSSVCLGLRGASCKLERVHGGLDLFSMLLEQNDLEPGHTELHARSCFVLPAGRHDSCCGASYDFEDGGVRPWVRRLGKTYLCAAFNVICDKCGERLEKAGSSAQQSQTTNVSSSIDGHDIPRYPDRAVCGMSLRIWKNTDEGERNSGPTCVGGSQCPVQMTLVADLVQEVQQARDLQNRSGAIVPDCHGYSDASTSEGVLMGRALRLVD

SEQ ID NO: 1012344 - protein, 330 aa, Homo sapiens
SWRPTVHSVKWSSSLAADRGLQGSLAAHLRVTRGRPQYPPSWAQSDVTPRPCCPVTSPGVRAPGSRRRRSSPRGGSWHARLAPSPSLFPHLVKAVDWWLLDGFLLDMMPLGSGLQRVPACCPLPPDGVGRDAWYSSADTLPSGFLCPRCPRETWSCVSSWRGAPVAGFVRVDWRCSSRWSVGRWDGARGLALCPTRLASWVARPIELPRLEQGPKPDLPILIRTEPVECAYRNEEKSGDNMVPRLHRASNELQQGRLTGSRLGHQKSETVIVTLRAQSRIALRCWTAEGGRNMEAHGWVIPAGSNRAARCVRLAPKGERVAGGQRVSVCP

SEQ ID NO: 1012345 - protein, 105 aa, Homo sapiens
MQAHRREIGHLQDPATRGLAATLCVWKWTSFRFTPRIQRLNELEAQTRVKLNYLDQIAKFWEIQGSSLKIPKCRTVDLGPLQSQQNCGGGRWVMKLSARTVGGLG

SEQ ID NO: 1012346 - protein, 381 aa, Homo sapiens
AQQPLALPSASPRRRSLARVGWQLLTVSGCTMARIDADLKLDFEDVLLRPKGGDSLKSRAEVDLERTFTLRNSKQTYSGIPSQIVANMDTVGTFEMAAVMSQHSMFTAIQEALLPWIDWKLFCHKSPRMPAECEPVSSGSGQNDLEQDDQQSWKLCHRLSLFAWMLANGYSRTIRGIRETCPCKFPEHTIMAGERGDRRTGEEELNTFRKHDIINSGTVGTRFCVHQPGTKTGVEDTPRLRMPYMKCAEHLPKGTEGTHHLMMEDCNMSRGLSTQRTEESCDSTLRPQAGREANGSNRMHTDNRVIGPSHHTGKAPKQRAKRKTTRNHTKQNRTRTETERKTEPNRAQDGQEHRTTHQEKPTDQNRGTQTHDTREPTTKRR

SEQ ID NO: 1012347 - protein, 256 aa, Homo sapiens
MRPLRVVGVKTGMCWACALRKDLVSSASYQARSCAGAAGSGGAERQGRRVKGSERVLSGPRRPRAGKGARSRVIGAVTQYQPNDEAVPITGVEGPDEKVERDQVSRRDKLGAGVRNREWPIIRHEGPIEGARGRQAMSAMDQEDPNGGGRPVKSRDCRSVTGCLAGGQVQGPHLFPAGADRGTLASSMGDVTEASGGRGDKGTGGPRGARAAWVQTSQGSANIGKAPRPREAGAAHRQVKQGRALGELRTTCRPLI

SEQ ID NO: 1012348 - protein, 105 aa, Homo sapiens
MVPSEFRDARLPSQSSVGGRGIRDPDRPANKYIHINEEASRSSKNQLSLEEPRNHLASSARNRVQRKDSGGLVEPSMANQLTSHERKSPWRILMYSRQSDCMQII

SEQ ID NO: 1012349 - protein, 112 aa, Homo sapiens
QVILGRPSGPPPPPALAGLRGPLPPMRYIYSRCAPPVRPHLLAHLRGTLCCAPEPRSYSPGYLGTCRRSETRPDGPSTLGGLGSPRAPGGNRLAFGDHQFVWNHPPGVSYSL

SEQ ID NO: 1012350 - protein, 44 aa, Homo sapiens
MSSALTSYGDRPQWSPPSYCGIQSRVTVLYVSRVLLEGYYVLSR

SEQ ID NO: 1012351 - protein, 272 aa, Homo sapiens
MSDITEDIEPTFRMVLRCVEADAQATIVSRDRVDGEPQKTWMPAFSLNVASTAHARGRQRHRVFTRQFELTLLLAIELGSRAIPGRARLANQQLRTNFFANNTSCTQHDKRLERDCAPPISRPHCAILRAPPTPRRTLTRKSHVHSASRDSVVPLHSRLSEPTCPYVICPFLLCMRLHSPPRLRDTPAEQGRALSPARHDGLTLPSFPRSWPFGLPLSTRLTTGTLSDTLTNPSSLECPRHLGSAPFTAGPTSLDKRSYSAASPRIRSLPDD

SEQ ID NO: 1012352 - protein, 113 aa, Homo sapiens
MCEERSQQVPSKSHAWRAPVYLEYSRQDLLRKERLDPNRSEHWLVLVPFWATWPYQRTAAAPCGMCGGYLRLTPAERDDLASIMKKLLTYRDDKPSLMTSFPYSMGWHGAPTG

SEQ ID NO: 1012353 - protein, 138 aa, Homo sapiens
MVWFPRWRTDGRDPALVLDWTRTAVGGIPSPRNIRSDEQIGDPFLEEYPVVQGDVQQQDAKVPGVKKARKRLGVASPKAFLCPRSVIRKNRYPEIAMVCPHISVVGQVSPRDLFRQKMGHYHRLNLGSGSVAAAIPFV

SEQ ID NO: 1012354 - protein, 108 aa, Homo sapiens
ARLVRSEFLDRQRMCWTGAVRTECTELREQAHGSVEPGGWDVRDPVVSRSPCLSGGWRWMCGPADAAMKPERRVTRRLLAVPGPWEECFQAACAAGAAGRTDHQKSPY

SEQ ID NO: 1012355 - protein, 176 aa, Homo sapiens
GTAGMLGCHHSRSSAQSAQPLVRSSPTATSAAALRRGPGGGGSSCSIISTLQRMEDLEELEVLDEEARSRGLSAVPVSHRALLAGALLMDFGNELRAVGAPGTPGRFVPPWPRRRQAFLGSRARVSVDRVPRHLPSCLSVRQFSASRKSLWRERLRLSWSVSVGVWLCLGGVCFGV

SEQ ID NO: 1012356 - protein, 244 aa, Homo sapiens
PAGPWSGHFFGLTRATPTHGLRIVVALCPPDTVARRRDARAALVPTRHTRQLHTDNDTCWTYRCLLARTHRSPPHTPRLTANSGPATSSNHTIRHSRTAARTLHKHDHSPTTTIGRADGTHNPPRQTTPPRNGRGCQDGANTDTPQYTLNSRYFPHHKRSRALARERATTTTPHYKTRRQGNHNRTTRSVVVSQEDRGLAKTHHQHTTNHTGRERNGITNEFTATLTPRTTGPLSNANTVPATY

SEQ ID NO: 1012357 - protein, 77 aa, Homo sapiens
QLYGRILDRGVGRRQTCDLVSWWLNSRLVAGTRCPDVSSALWLLPGPRRAATAAAVPFWTNGPQHLSRHLWWPLAQV

SEQ ID NO: 1012358 - protein, 251 aa, Homo sapiens
NLELKEEDFSVVVEPGVTRESPQRPPAGQAGSGFPWTQARTPLSVAWRATGASGTNCVSGYCATDAGDEACVNPGRLRACRDWVLCLAWHNVLCASEAPGAIFPWRHRMFWPRPLGLLARSAVPNLVVGPLQFSAGLGAGHIPPGKRAGAGNPGPFGAGRTFYCKFFPKAIKGGASRKSRAIKIHATTFFGPRVTPTLFFWPAEEAPRPPAFWDATPLPARPFFCDRHGAADDVQRKALQKRCYFIGRRPT

SEQ ID NO: 1012359 - protein, 177 aa, Homo sapiens
AGCTGPEFMDVMAAEGGGAECTLSPDPRKFEVRMPHQLSCGSAADPEVVDGRGSRGGKSGGNRAMGAGGDSNPLAGAESAVPRASAVPASFSAPSPRPEPGAVSRSRSLAGPAGLQAAAPGLAWQRRWLSCMPGPLLATSGALFARGRHLAACEARGPAFRGKLGREGPGPTGGRPP

SEQ ID NO: 1012360 - protein, 106 aa, Homo sapiens
PAVTAPELRMMRTQQSGLTTDAAGPGASLVSIMTDTCPCSVLRMDYKGDATVFFILPNQGKMREIEEVLTPEMLMRWNNLLRKEEFFTRKLEFAIFPSSPFLAPMY

SEQ ID NO: 1012361 - protein, 68 aa, Homo sapiens
GCVRSEGMANLGCRTVPGPDEDIFLYFAYGSNLADESIHLRNPSAAGFCVARMQIQTVLANMVKPRLY

SEQ ID NO: 1012362 - protein, 141 aa, Homo sapiens
LVRSESKDGRAPGQPVGETCIILTKWIHLLLRNKGSGTGSSTLEPSSLSEPPVTGLCRPRLDGQCGAALVILQALLLPFRGLMSDQPMPPAAFVVLWCDWGRGASNGHIPSRTRDIGTIAHRMIDSGLCSILVCRACMPCL

SEQ ID NO: 1012363 - protein, 321 aa, Homo sapiens
DGRQRRRRQRQRQSPGAESKRDDRRGWASQSRLEELYTCTRAGEEKQRILARIPGSLTPDWTGVMGLSEQIPMAGVLRQPPTMGWPFGMAAFNSLDHDIATNELQNSTVLPMRDKDQAGPMGSKKSTDQHQVFRHDRGLPSRPRMNLRWVLAPRPFKKVYQETTTNGWVETLLTRQIQVCPSQAAWSHNRMSSKQHPQGWGSPEVPTGLCQEPERTPMKVKWAFNEEPRRGDQRKRSQLPNAQAILGPRKWLASKCSEAKETLEAPPGLKKVAKGKDSLGWQTRRREQPQEHPQEHAQKTKWRFQGDFRSRLQRRWRKHHV

SEQ ID NO: 1012364 - protein, 208 aa, Homo sapiens
MSPFRFTQQCVFHNAPSNLVMTILLARCVPLTRLAFTPVPLSASLRVVVLVFSHSTLSFLRPVPLLTSLLSLLDQSVPSFAPSGPSLFSSGITTSSAAPTRGLARHPPLPPIRVSRSSFQRAPFTPSLAKPLSFFFRAVPLTDVRLHRHSRRCPLLIAFLLLCVRMRLPCYLSQSFPRPPAPSDGLTSPASPFVSSAPLSSPLPTASS

SEQ ID NO: 1012365 - protein, 284 aa, Homo sapiens
KCTLAIRDAAWLLDTLLDLWLLLSHTGGVMLTGQDHHRAFTKLIIQLDESVITSIALVMSPENHSLIQIWWHPDSLQENLEGREITHFDLRKKEAWRQLFLTALSSLRPNAASGDLKQQAPRPHLKSSSPSSPLGRAALGLSLRLQVTLVQLVSLPHSNRNAFLKASAGEGLISRLWRVSWWGGTQALTFNPLSWEKTALKEVLTHHTGSGMCVGPLHKVVNSASWVYLAQKKGRQEVFTVVLSNCFPLKATFNHALDLNRPENSSREGMHPAEEGKVKGYKWG

SEQ ID NO: 1012366 - protein, 335 aa, Homo sapiens
RFGRRLFPGLANPSHPRAPRSPRPGAAGPGAARKSRFRRRARQGSPGAAGTSARSSVTLRSLHARAVTSEMLLAAARRSPPPSGPPSPCRVHETHQHPPMMEPANVSTHDRAYRISDLHDTYTTLVPNGTTHATPGWKAAINASAHLRIHIHSVHPNTPPTHYHETETTTTLTTELQLTICLRPPQLHTYTSPHKRQQTRQLGRHATQNPPHTPISALHKHPRPPTPKYAFPRATTHLTTTPNNSRQPSPDTPTIQGLIEDHPPPTHPLRTAKRRNKPTSPRTTPLKQPTQRHTSEWRRPIDNTTNQTTIYRHIQNTTSHHSSKTLADGSPLPSQ

SEQ ID NO: 1012367 - protein, 111 aa, Homo sapiens
RLVLVMGLMDRAGERCACDAWDAMSAPVLGSGPERMLESGARPGPAPSPAAFPPCRSCGPTGRAPAMEQDNSPLKDPVHGPAAGACTLIPEAAEQIRRAPAHRLPPSLLTS

SEQ ID NO: 1012368 - protein, 207 aa, Homo sapiens
MERLVPVVTFPDTIVLHQRLPASALRGRWTTMELSRELQALPGRAELPRTRTAWDYDFQRGHACCWGPWTPAVDRTWTCDSVPAFYRETVQVGRCRLAAGAGGPSRSRVACHAPDTSEPGAAEVPSNGLPRGKGGTGKHRHWPYRVDPPGIPQWVTVSDMERDQEGLVSRRWTLGYAQEVGGLVGSTACTVSQLEITENTDDYGERR

SEQ ID NO: 1012369 - protein, 147 aa, Homo sapiens
GWYGPECNGSRWQKYSMKKKRTFRKFTYRGVDLEQLLDMSYVAADTSVQLRATGRTAEPVALRTRSQTLPDCSACVKAKKDGAVPMVEAGMLVEDDSSAVTSSSYPEMVGQAWWAVYNGKTFNQVDDQARDDSSTELGEFSITYQAP

SEQ ID NO: 1012370 - protein, 301 aa, Homo sapiens
VLVRNLGILKLTPHLRGLQHLVSATMRGVTTCLRFPGQLNADLLKRAVNMVPFPRAALLHARLSAAPEPCRGSSASTGRSRWARSSPQQMFDSKNMMAACEPGHGRIPDRWVPIFLGPACSMNGGGRDRCINRARTMNQQAYFDGQWIPNEREGLVLMLRHPDPAAWNMSVTFIGEEPRLIQELFKRVSEQFTAMCRAQGLPCTVYTGLRAWHEMEFTEVESYMERAGVLRYQQYQGQPTATEQGESAAEDGEDEGLRPSQSHSGILRWKCLVVLKPWSCYLVTYGGSGLPLVTNFHWLML

SEQ ID NO: 1012371 - protein, 96 aa, Homo sapiens
MILVVAAKEVWGDEQADFVCNTLQPGCKNVCYDHYFPISHIRLWALQLIFVSTPALLVAQHVCYRRHEKRKFIKGEIKSEFKDIEEIQTKGPLEGS

SEQ ID NO: 1012372 - protein, 190 aa, Homo sapiens
MARLACGQEGRVGLLVLLSSLRDGAELVGPGLQRKQGTWPMLRHRGPAYRARGLWRELERSTVSVGCSGNRIYQANGICCRRKKALHCLSTPTPSLHLDPDVDIKDVKVVILGTGSIIMDLIKLTGSALVFKGLFRLLPSLENIYKELSTDIEDSVHPGHGDYLGGPSKVYSILNAVLTVRAHQGQLSYR

SEQ ID NO: 1012373 - protein, 214 aa, Homo sapiens
YGPEVRDAAADARLPPLPSHGLSPPQWGSQTTTLWKVIGQAPERRLDEPRVPGHGLYRLSEPAGSGISGDQQHWPRLRDRDGCIQLKVNVGDTVSDAAKSRRALTIQEIAALDRSSLHGISQVVKDHSEQAYQTWPRAEWLTSLVEGLEQSRVTHLHAHGTQPYDTPIQTISEGEQEARYGRQEWLSKWALAEAKAPSMVYTVDGRGNPLMNSY

SEQ ID NO: 1012374 - protein, 124 aa, Homo sapiens
MASLMRTLDRNQPNEAGPVLPDLTETTGSINACMFSQQKTHSKQTNKIKTKRKERAVREVNRQECKRETRDAEEQHKKADDDEHERVLLKITRTYNRSTRAQKAIEHHKDALSQKEKTISSNKA

SEQ ID NO: 1012375 - protein, 161 aa, Homo sapiens
MKKESYSVAPLCLIRTCCYTVSIVLLLGVAGPMACHEHVRHSWTAGPQECTYRQPAGLRHLPGPQPTSLGGGRRYCRHWWSWGLGLLCHLQRSVVPCCAWLTRAHGPLVWRGRVASSVGPEGNGVVSLDSWLLELVVSLTCCIYSWWGSGQRIAFTSCRCA

SEQ ID NO: 1012376 - protein, 280 aa, Homo sapiens
RGPRCVLKHYVSHSLSGVPPWWDSDSGQWRRESRASIQVKSPRPAVGHSHTRGSVRRVDSYLSFTRPIVSRVPSANAFLKPRGKWREGAGMRWRLCGVNSELSRAVGERRRGQGSRRGAQPVGPPGCLADWGGHGGEPECEADFEPHSGDYEEIKLCNKSSVVEVGNRCALPGLTPILEILGEPIRPSLHEWASNGHGVPWEQPLGRWVLLSQPVLMKVSSSEDPFGTLGPLWSQENYQPETPKPSLVTTQRFGATQTIKGPTIRCRVILVLQWEKTFGH

SEQ ID NO: 1012377 - protein, 152 aa, Homo sapiens
MERAPCHVSVTRDRFLAVASGPGYVGRRHGVMLDLVHPCFARIDMWTSALTDAMSSGRLCKGPQREEQGFHSFGAPMSSAAEKALRLNEGSLGRIKAHQGGLNTVVWALSTLHGGALAETSHNPKEYYTSIVCCTPRSSKGGACPPRMGTFA

SEQ ID NO: 1012378 - protein, 133 aa, Homo sapiens
LGPGLTRIGAAVLQGFRLLPVPPECRIEALFLVQLTSAFMGSLAGRRGGDRCLGSRRPAPSRARFAGPGALMTRVEQSARLPVVPVVLPRVACGPGQSCHCEGFMEAPACDRELETPPWSFPPKAHGQSLDLR

SEQ ID NO: 1012379 - protein, 129 aa, Homo sapiens
MRYGVTSLGASEPQEPWGFPQSWPVEKWEIGPQKGYLFVDARLKCGGKCEKGLYTLNPLFPRVNIGSRGSSAFILTSLVGRYIGRTPKRGIAHGGKKARGRLENPGKAPWTNLGETGGLSPGKRLGGKR

SEQ ID NO: 1012380 - protein, 183 aa, Homo sapiens
MLAPLHLVATMEKPLGARSAALRFVLCRAVIPCPEGGELGPLLNDSSGWTIIRHRDRVGSFYLAARSTGVYPGAGRLLVPLISTLELTRRGRGGHAGAPGREASTRGLKVWIGDVEAETMYMEPAVPGVRGAGRGGLLQRVALAARSRSQSRMSLVRADGLLSTLGAFSFSYDPEYERAGRVS

SEQ ID NO: 1012381 - protein, 204 aa, Homo sapiens
FLPVGLIEIPTAALSASFSDIPLGVSLYTPSHICLPRMTYETMFVCPSSQMAMLKHPSGPQPRDCAGSQEPHGLSVPRGSVKIANKGIAPTGQLNMDSCKISPSIKRGGHAGGATSPSLGSEESQGRAKHDKAETSDLGNACQSLVPAGLVRERLFCSLCNCVAERLPRSCLDVSPGQLPGGGDGGRVEAAPHFIPKVLHLCDG

SEQ ID NO: 1012382 - protein, 85 aa, Homo sapiens
MGQQYNTTAKTKTLTETASKTTSQYRQRLKTRVAHTTSPQRYRQETNNSRLNKIQHLTKDHKYSANKHTAHHKYTYRYSSNATRT

SEQ ID NO: 1012383 - protein, 284 aa, Homo sapiens
VLAQHLRPLSPASRNHNAARVDLQQQIMTIIDELGKASAKAQNLSAPITSCITGMPGVTPSMLVLYSSTDTFSPDRLVKGAIIGFHSYTLRYNASSLYWYYRESLIMTVEPLLDPGALVHPMTSAANAMGHGRELFQVLVLQDTERVEAVPTGQLTWPSQKLLKFLNKSLQSVRPRVPQVKQAFVIFARLLLPINIGPLSPSLRATRHSRAAAVDPTPAAPSKVSCPPKRRRGQHIKPYSSSDREWGLPQVLVAQSCWYSRHGVGVIPHPPIQATKTPSREKQE

SEQ ID NO: 1012384 - protein, 202 aa, Homo sapiens
MSVGTNRIQKSMLLDLNKEIMNELGVTVAGDIIDHSQACQIDGAPSGHVAKLPLSQYPAALAPLTRRKILPWSPVLPPEMIIQQRCNHDSPPQSDPPGARTLRHSPRSRSLCPTRWQQRVPRPLQAPGPPASDVSSSGCSCQGGVRVLLLSMRGGTSRLRHALRSRHPVTRRDPASMQRAAKGLHEDVCVLTARAEDQGRLH

SEQ ID NO: 1012385 - protein, 73 aa, Homo sapiens
TGYRRNHAFAYPPGQQCIPGLYAGVLRALGHSEKWSCSYGLASSPQCSLSGKYQPQAGVFTNLSQIYYFHDEN

SEQ ID NO: 1012386 - protein, 267 aa, Homo sapiens
ARSSDCSSSSSSGGGSSSSSGGSSSSSGGTGGSSSITSNNNKKKSSSNPHLSFQCIQIHIFTQARRGKEERGAGKKKKTPTTLSGNFSEECSKTQQGASGWLGDQVASGKPNEGGTQEWTLVSPKEIPECGGLQNIQVERGTSGLQRVLYRVRMGGLWQCLGKLHLVTQMGMYDIWYILLVQTLLNLEPQGKAYQSKESLKGIAKGVTSRVFLAIRRCSNFQRMMAEVQEECIPASLNGEDIAKTETCESQSLRVVKMPNTIYPKEY

SEQ ID NO: 1012387 - protein, 304 aa, Homo sapiens
AGSVVRSCAGLPSLASGSAGCRRPPLRVHFGFKVGSQQVPAGTGHPKGTSVEEIHGGVHCGTSDDTRNPRIYLDGPARVEVWCNANSLTGTGWLRARASRDLGLLALAWVETRGETPVCSAAVGTRVSRCLTRAQAIANRASISWNPPGEKPGEAGGLSDHTPGCMKSRTGEFSLDVASMLTDKRAVAVGLAELGCLGRVPGPGVAGPIRQRCSTLTWARMASLRQQVACIKCLERIGWTGLEPLGTPVENCAAVSMPTGDLVGHPGPAAESELGYRGLGVTAARRPLWTRIRQPLCARTYLMG

SEQ ID NO: 1012388 - protein, 69 aa, Homo sapiens
WHRGGGEMAFSGSQCSLPEFQSVSSLLVIIQGGHPGRTFMISVIDIGDRYSDSRWKPSALRVNFSGPGY

SEQ ID NO: 1012389 - protein, 134 aa, Homo sapiens
LSRVPASSSRGRLHGGALTERGGRSIPETEWQCWPLCAGLFPRFASSYPSAPVVAMLRGRRRLGAGAARARSVVSRRLLPGPGPSVPLVLGCHEAACCGFWSYLAAGGARDGADAGAFALAPEAVAAVHLGVQF

SEQ ID NO: 1012390 - protein, 285 aa, Homo sapiens
DTGMEEVKPAASGFSLQLGLDLRSCASGRWDVWRRFSFNVLGRSLSEQGLRFADRDECWFPSTRDVAWVRSPSQASDTARMECRVGVSNRSGSKWALSRGKREHADVHAAELHTGSLTVKAGPASEACIRRQDMRGASRSPEDSSPDAARIRVKRYQAEHEHTSRACGSLAWRFGTLHGCMKRGRPDLPGSQMRTQGQRAARRSKISPQGLRSPGPALPARGRPGRTSGVVLRAHSRRGLRAPPKWRVCARERQRVQGAHGDRELVGASIPGGAFPGPEGLPSGV

SEQ ID NO: 1012391 - protein, 263 aa, Homo sapiens
ADNDHKMLDASAGNAIYIWPNQHCPLCMSLRLLCSTLMMFAVSKDGMEKLLTMMPTEEERQKIEEAQWPDPDIPLGPVENFLMTLASIGGLVVVYYSGPSSWTMTAWKREIADGHVSDLESGYGTAGTECHLPLIPGYPPSGWANFLKWLPEQSGFELSYLEKVSEVRGHRVRLTVTWYTHSSCIPSVVQDLGLRSAEPSNSGKSRCTVTRLSQGMDLLETAWTEEPWGMRWKRPRNPGGNARKGNRSRLEGKPLGAQNGHWK

SEQ ID NO: 1012392 - protein, 35 aa, Homo sapiens
KQVRLGQAYVVVQCETQAGQAQVLYQRMKLHRVTR

SEQ ID NO: 1012393 - protein, 346 aa, Homo sapiens
MGGPVPRHMTLLASQVFRYPQLLVAPHLAPPHLPQGAEAEGEGAYLLLNLMWGGHGWVDGGCPVGQAWGGAHQEPKGPSWKARDSRALGHTAGMEDGRVCASGHCGSDSNLDCRFCGAIPASVRSSVRQEPSSQALPSCKWVPMRCYVACHGAALLQLGCPLLSLSAACPCAEGLLLAAAARVCPRHRSLPSLPLGTTQRRRAWQASRAAPRCTPPPQLLHRYCATAQVLRTVPMLGARLSDQADAQPPGTAPLLPGRSLRACSSSRTQHPLPLLGSGPSTLTPDAPERPTPPCSLRRRRPPLHSTHALDSPPCSPPSARTPCPPPAPPRRLPPQPPPTPAPLPPS

SEQ ID NO: 1012394 - protein, 152 aa, Homo sapiens
FLLRRTTSDIVRVGDVQRGGGYRGRRRGGAVLPGELHCILISNPNEDAWKGSRLGDSSACFCEESRSVNELVCPALTLPECQPGGDFGLIDVVTPRGAYERGWRLWKGPSDGVPVVAAWRLAWRRGCACESEDGAASRGGARWSARAMAGPI

SEQ ID NO: 1012395 - protein, 213 aa, Homo sapiens
LGLRDGQRMGEGAVKQGFLYLQQQQTFGKKWRRFGASLYGGSDCALARLELQEGPEKPRLCEAARKVIRLSDCLRVAEAWRRGQQPPGHQCLLPGDHGAPVPPGVPCSGSAATGCRPSASVAFPGAEERTLSGPEGPRMSLALSWKEELDLYSERKFTSTGPLQGNFAVHHETYRSRVERCHLRVVLYPPGWGECPVSCAGGPEPGTQLYDWP

SEQ ID NO: 1012396 - protein, 299 aa, Homo sapiens
QLAQGQGDHMLIEWLMAAIRTVWNDAAEIIEIVSKWQSYTDLVQVLQEMGMWQAMFDLNTQGLNDEHFTSHMRDLVLGSAPLSAFGSLAAVPLRMWGATYMKVTTAMAALREAEGLWQDWGTHAIKKGKVSPLQVTTPGDQQGPQRVTLCSMWIDLIAAGVAWEKTDRQPNGMPLALWRQLSAEQQFQNMSERGQNTLDQPSPSQMLYSRTVCSTAKETRPSFDRELAKVPSRGHVWNWQSIGLPPMYMWVLALVDTGCQTAGFVLWKSRGKFPRPSLLHCMVLGGQLVTLTPVSLHLR

SEQ ID NO: 1012397 - protein, 258 aa, Homo sapiens
MCCDDCRVQAVCGGPVMALVALEMWEPVDGFRGVFLAVCILGPGAEASGARRSARPRISEWIALLTTVGACLVKDMKIKSLDGDLSLLPAHSRNQRSFDFFLVGLSQGGGSKIMPVQKQTLCRPAAPGSKAYVAMGDYKCATSGLGVKVLQWRWPPPYLCGPFILCQGSPSSPVLQKAYLGVTNDREMAQMWSPFARLTWPARGRVAGNASSLATQGALGIVIRQPVALKKLDSMMGWESIDCYTSRPGAATDQPFVV

SEQ ID NO: 1012398 - protein, 336 aa, Homo sapiens
MGRGSGTFERLLGFSRRLQGDTFLAKGTSKQTELSQPHRQGDQPAPVGDRLGVHFARSATCIPPKGTHKAKYAVNSINATNSQRQEPTRSPCMALRRSLATPAALQRNLCATHTLHCMQRWPTKHHHWAGTPATDPCHRRSTTLARYNRSANTRSVLALIQRLAPPCLSGNEQQSYQRLAPATRYHTPLANGWSAVYALTQQLQQQQPHCTCVCCASRSPQTTGLAPLQRNCHRMPGQPPPRGLTAPAKHQLPGTLWARTTSLLGTGRSSPKRNHHKQLPKLRPLKATGPAAALLADPPCTTTPACDTAKPRPHTHPTYHQPRSFVLSFLPFPSAS

SEQ ID NO: 1012399 - protein, 139 aa, Homo sapiens
MIVPLHSSLGNRARPCLNNKTLTTQKRKTRKTTPTTHYLLSYHTHTATRQYHPHHPSLLASMLLSRSYASTLLLLPGSRTEQPPDPAKACYSLGTSPSIGTHRVDPEININRQHHRSPAQRMQRMSAPPTAPLGPHQAH

SEQ ID NO: 1012400 - protein, 367 aa, Homo sapiens
GGAVLGGPADRAAAVERSYRRVSMKATSHGCGEHLTSCPRTSCCELFTALFPARQACLLELPLLVLQAYWRGPSVDPSVDLSGIRKVPCRDEALLIYVEVTLWDACSHVGLTVGKNLIVLLLYVDALATKGKHFALRLTLPGRLPLHTEGESVYHVSFGHAHCGIGRTIWEGARNCKVGGQGAWREAGQFPSGTPPRKRKPPCEAGKQAGNKVSCAAAKKLAEPPKGGYTGAQEAPKGPAQGHLGPGVGFSRKQELNRRKRTRVWVSAPGFNPKKVGLPPHWGVRGVYAVGTRDPEHSRDTAPSRFPPMEGAHCGNPGHLCSRPERGTTPQGAENRPAPVRARREKSGRKGVHPQRGVPNEDEIKGK

SEQ ID NO: 1012401 - protein, 200 aa, Homo sapiens
DAGLHSAMGLPHRAALAADSRVTDRYFRIHEVLKHARHFRGRNNRVLQVGGSCNRGFDAFVKLHPKSPYTAVMKNETLRTRKRWTRDPAGQRTRVSLRFCACDPASVLAALGTLSPVPFIPCFEYSDDIMSPRQARLWDILLSRGAGAPANNNGQQKFDLTSYRLLRLSDYYSFSFTKEYNFLLIKKQHPTKKKKKHNTA

SEQ ID NO: 1012402 - protein, 93 aa, Homo sapiens
MAQHLGINKQSDTSETTLGVAPGDRVGKGKDQQHQAHCYTERRPKGTSLAERRKGRLPQGGEGPTQTGHIRTNTGYRSTQYTGNPFAQQACKR

SEQ ID NO: 1012403 - protein, 246 aa, Homo sapiens
MRLTGAKENVADKFPLSVPAERWIVAWDVDGHPSGLVDAYAVSRHDEADRQPWIGSVRLTMPGTNAVLGSQPGWKVCTDDPPRLTRPAQLTDLLTPDLITCAAMEKMSRVTTVLGGSVLTGRTMHCHLDAPANAISVCQLTHAQVVVAGRSIFKIYAIEEEQFVDKLNLRVGRKPSLNLSCADVVWHQMDENLLGTGSPQWRGGHVEPGRPSRNMQDQLFTEHERTVNTGLVSTQRSPRAGTVGPG

SEQ ID NO: 1012404 - protein, 169 aa, Homo sapiens
PLTPAERREGRENRSRRKERTSVGMATNWGSLLQDKQQLEELARAGLWTWALAERSTELEDLDDGAHFLGGGDAMPLVQRSFPSLVPIALVYAEAYAVLMDFNLLVDAVRPRTLPSWRQTLLPSPVKQDDFTARLFDIHKQVLKRGHCPGNHSQSLLRSVTCPSQSLSR

SEQ ID NO: 1012405 - protein, 224 aa, Homo sapiens
MAVGVSHKRPKGWMKKHILVRTAWWTLSIEFVYASIRWDDARGPVISTCETGKLCYVPDKRVGLTRRRPAHRLQRCMERGPLLLSIAYVLKGPTEAPWGTLEATYHGGTHNAFFREAPRSNEHFGTYYMPPSAERSCDGPPVGRCWGRHRGMGHVRGVQAVTAHRGTRSLLITRVKRAMARQGGGNRGESPPGVAHDTEAPEPFPTKAPMVRPTPPKITQGQRN

SEQ ID NO: 1012406 - protein, 78 aa, Homo sapiens
MIPSFNRRLTVHDRFQLVGTRSYATHRPLVIGSACPFLAYLSGLACAQLECNIPRWCSWQDYNGSNLQFLVLLNALDH

SEQ ID NO: 1012407 - protein, 313 aa, Homo sapiens
MLPSGADPSTWCAACTCRGRPVGRPSTVPSSPMMPSPSSIGPFLPALMKLKGPLSECPAALVLVSSRSQLRPASSVSHASGSSNWRYQSARASSGERLDRIGDSSIVQMFKTSFFDHLVSLCRIVPAFSGLASRLVGRGAWRLRARDEGEYAVTTHGVHVQFLICQGHPLLSCSGKWGTFGLPAPHRLFLSSPGLEAPGSFDFTSSYPRTAEEGRWESLPARLLVGRWDPLVVLRVTLVRGGQDSFYNPNKKFLCQRSGQLDFTNACTFAGKRQSSLCSSQREYIPHGGTQATEGVIQHLAPDRLGIEEKLNG

SEQ ID NO: 1012408 - protein, 291 aa, Homo sapiens
QTAAALTFPCAQLFGAAHSSGCEKWTRALRHGLKKRSKTCREGFVIILLPCKPKPPACGPSLDYEESSCMSRPALVDLGQACGAGCGIRSVFEPSGAHLLGALEVTCPLGTGLALPEWNLTVCEPRLQVASPPRGSSYSVGVRAASVGKLQREPQRSEERCAPTRDSLLPLTRIPVLMKSQTTLHKGHPGPNRDRSADVRPRYAPIASGAPEQRRRLAGGEGKDDRRAMRDRTPKGPNLRRLHRPMQPRPTDFHGTEQQDRQTGKPERPKSYEEAAMEVTSGPTVTQDEEG

SEQ ID NO: 1012409 - protein, 265 aa, Homo sapiens
AGTGWRFDEFQELQSGPPGGFRAVVVYLADVWTIMPTLERVGEVPVTRRKLQVVQVPPNRMRQKGTRMPVREQDTLSAIGARSQTVRRRNAETPEVSIQSGNGRLSLLSESPTSSLCPYEHVRVTFGYQLQWPGCKSRWYPSDWGFVGETRACQRGEEGIVLVELLSGGYGPECLDIALGAFGVRGGGDFMGELVITRLEVHGSWLNLRKVRVFLFGHERVRGGFRRQCWERAFGEMVAGEVAVDHRVKGKMPKPNGEVERKASD

SEQ ID NO: 1012410 - protein, 62 aa, Homo sapiens
MAIITTSQCTDLILPLTRSACGNLIQKHATCDPGLPRSKPAANHPRETGPQPSTSNSGVTGW

SEQ ID NO: 1012411 - protein, 170 aa, Homo sapiens
ITSLWLPWADYIIMNYSVNIPNNHLERLVPELCPSRGLLIRAQQELVITYWPGGPKVLTKWVVINLLSSWSQGMKKMYKRGSSTPSGNRSTAHFKPVVGPEQRPLLSLALSELSVQQRTSLENIRRERGGRKQRGTDGGAGREAATDEQLGSPERRPFRERRKDRGNPGA

SEQ ID NO: 1012412 - protein, 185 aa, Homo sapiens
AGEWRGRNAAIYEDWPISRGSPTSMMEAISAVPSWSKVNQVLIRMYKAECREKLRCDPAHSSYGSHACHIASLYHVGLRRGQARRADPRPQLPVPAFARPERWGTTVSAARGTSRIGMSRAATRGRRARSTDVASQGRSETRLGQIGAGTKTERNTGEQKRYGSPCRQGSADAVITREPQERKQA

SEQ ID NO: 1012413 - protein, 48 aa, Homo sapiens
MGGKGVFAHVPDYGAPTPYDRYGHTSRKHRGVSRHGPGENIGRTTSLA

SEQ ID NO: 1012414 - protein, 81 aa, Homo sapiens
GRLGAQLVGRRGLQEHQRGRTRDHGVRGLVAWWAPVGRRLGYEGCGSVHLAGTRPKCGVRHEMNDVCCESTEGRFAHGGLS

SEQ ID NO: 1012415 - protein, 270 aa, Homo sapiens
MVARSSDLPYLIVGVVLGSIFLIIVTFIPLLSCEQRPVSNCNKHTTEPGFSSKMPFHPSMLLYTIGVHLARISPGPTHSHVVQPYLSGISGRACANGIHMNSGLPLGLQWATRGMKPQQHCPGELQQQSDTSSLLRQTHLGNGYDPQSHQITRGPKSSPDEGSYLYTRAPTIVHITSCCSPITHAANAQEQPAAVGQSGVRRAPTVLSGSSVGPSISLRAPMLIWALCQLKEGGQVLTPAKLSWTETGCPQHPDRGPYVGPGNLECQLYT

SEQ ID NO: 1012416 - protein, 161 aa, Homo sapiens
METTHLGKNGTSLTFYNVRNLFTPWLPGRFKGPSPPMGKESRWLLESFALEGKNRCVINLRNGQGGSDEEETTGFPPPYRLLGDGPTSEQAKEVPTSQTKFEPKENHTKGKRPKGNLVADKQKGPQRETKSRATENAPNSREPVTKATGRETWDSPWGYTT

SEQ ID NO: 1012417 - protein, 291 aa, Homo sapiens
MTSYYSPEPGHFLTCFFLFHASLLDRLQVARTDLALSWADCQCCNALLLPAGFSTYDTRVSTLSTHLFSLTLCLTDSDTVTLADRSTRVLCPCGPRDRHFRVSSLSIIIFGPWPSVAFHARLIAFPRSNANFTHPHLPAFTFLTESLPTSCTRCPTASENRTPSLAPAYSPLPAPDSLCLPSRPPPRHSCLTNDHIMDTAHSTSLSRTTSRSTHDSLLHPSSSSNPTFTNLDLTIPLILRVYSHGPPVCHTPIHLVQRRSHDTLGPLGLCATCDETRTPPYPRPAALNPRA

SEQ ID NO: 1012418 - protein, 289 aa, Homo sapiens
AQPPASRPPASRLPPDCDVRPRLAAASGLQFEGDLVAVRMAEARRTFSQSLQVACTRPQTHTVVNNSYRSAQHSPWLCSVGHVWHLTGSAGNHSFAVIAAGWLDGAYYIQRSSSRIRMLVCGVHAESHFHERTSAAVGSDLESQRSRQLRNDGPCSPIGDADSYRMLMMPKNLVTIVQVYYASGAWQLKVLSKVTGDTGGCLPASDPEKLSISAVILMSWVDEENILDVYRLAELFDLSRLTEQLDTYILKNFVAFSRTDKYRQLPFGEGSTPSFSSNRLEVSCETEGI

SEQ ID NO: 1012419 - protein, 254 aa, Homo sapiens
MTAPPFVDNRAAPCRSLNYNDDGGALNNTPDADTTSVTATPVDNTRHHRAGGPHNRGTHPQSKKIDEPPEGGNNKNFHERGIRGVDTTTGSTIESAASPDKQLAAHPARICRARDKTLYYPEAGPMYKKRTRQHTQHTTHKTRTDTRHTRHHGRRVREQGKTAERSSTRPRAPAVTTGEQRQEEQQQTGRPGQHRRDAKVGGRKAPPEERDLCRAGWGPVDTTRHSGPRRDSRRAARPRTRQRARGTQEQRQKQ

SEQ ID NO: 1012420 - protein, 106 aa, Homo sapiens
GVDEPPVFYQWWLVYSSNLPERECICPRWCAKRSATPPCWMPVISSRLASSCAKKLHVAPGLRVLVYELLGRGLSMVCGGQWKALLGQAPELMVLSWLVLQGSSVV

SEQ ID NO: 1012421 - protein, 214 aa, Homo sapiens
MYAVPLLYVLRTSPTTYIAARPPYSLQCVQPAGSHTPHPHLITPTKHSLTSRTHTARHKSTTTPIHTYNPRPHQHSTLTHTHLTINTSPSTHQRPEKPTNNTTRAQPSTPSAQTKATAQDTTAEIPEDDIISIITHKQHHNNLPYQLDAPLTTKTTATRRNHQPTPANYQPPKKQNSHKHNTDPLHKYYSQYQLLIATLANSPNAPNSRHSKPD

SEQ ID NO: 1012422 - protein, 104 aa, Homo sapiens
MPSPAALALILVKLTLCYYTSRAYSISVVRLLTVLFHSDPVIGVEVDVFPRISAVCPAKAHPHFLGARYRSWGHIVCVHRVCISGRACLLCGCQDREGAVREQM

SEQ ID NO: 1012423 - protein, 208 aa, Homo sapiens
MAPARLFALLLLFYGGVAESIRWRLMVIDPHGPPRRPILLRSPYLDEGGCKCGPGQESDDFELSGSGDLDDLEDSMIGPEVVHPLVPLDNHIPERAGVWEPKSPPKPKKLEENEVIPKRISPLNESEDVSNNGVNVHALCRAARSVSRTEVLAASESLGGNRRAILFAVFLNLAGHVPYEERRMKAAMDLGNETHATQKWPQQLSSYA

SEQ ID NO: 1012424 - protein, 170 aa, Homo sapiens
MVSSGATQLLFMSIFSPRDCGHLADVIRSSLGGWRTSLTVPKLRIGFYNFCLLAMSDSQSPYSVTSFPDAGSPGGASGWPGGLDQAGCVRVPGPHASLPRQPLLLAHLQACDEQSVAVLAVVASWLCPLCVLAGGLGLFLSYVWKWVTLSLPGPGLLALGSAQAYSSSCL

SEQ ID NO: 1012425 - protein, 236 aa, Homo sapiens
AGGGCFGGGWWPCGRGGRGRREEEVEKAWARRRLTVGLPAGPSPDKREGSAVDPGKRRSLAATPSSSLPCTLIVSRASDARRRNVNSDADGTICLKAFQDEMGFSSAMVTMMAQKQEERVAAASKLTLSPLMLYGLRNYWPTYYYEHTSDRKELFEQLKIKKPSAMTALRMVETGEILQCKRRVHQIPDSGALAQSEETPAACMQQHVQLLTTNPPFLPSCKPNLNPEASMHQDMS

SEQ ID NO: 1012426 - protein, 85 aa, Homo sapiens
NPLRGPLNLERINSWRFSGGCALPYSDRSLRSILICSVGENCRPKPGVPIQELGSSNSLACLAPYDRSLSPTHRSLFHVLQGIVE

SEQ ID NO: 1012427 - protein, 118 aa, Homo sapiens
MLSHGPRDNWQQSGNLYLSCGILVETGKITRELNTLTTAKKETLGGAWQGVPQTKLVCAPSVWGGVPSQNFLIQVLLHPQGEIIACWHTHNVVGGAAQLKCEKTSGDLEEYIRTGRRL

SEQ ID NO: 1012428 - protein, 112 aa, Homo sapiens
PCYLLASSPSHITLITRLEMAAAASVCGGTRTPAVIALIVFLLVVNDPVSCKVGWRRYLPGGDRLWKAEDEGRRTVIGITGDDECIDETIEYEPSNVNTYEVKNFRKEKNYA

SEQ ID NO: 1012429 - protein, 290 aa, Homo sapiens
CERGGEQRTAAVAKGQPPPALISTGSPVRTGECRDPVLAWRHVECGGPGAAVDEAHAGSRSHQCPPAVHDGAMNIAGLALCPADSPVPPACLAWIGLSLAPLWGNCSSLWLFLHRPRVCAVWMVGVACVLSVPPVSGCAPLPVALRGPRWACVLASKPVPAWVVDLATLGMKTFGARVPRPSYPGQHRGTVEPLQKDERAIQGDPGRDTVQRHLTGTLEISWTALSKEPWLRKIRGWCGLSTGACPASTTLEAFLTTGLTRVAHRQAFEVPVQDCGDPLAAGTKPIREAF

SEQ ID NO: 1012430 - protein, 144 aa, Homo sapiens
VFSKAELWGLSVPDCRGLVRVTQEWGSTEEVALVCCLLASSSRVSCTGGLDVGIKRRNVIRADQGARGGPLHESGFAISLVPSEGGRVLTRVVPFHRCQTILRIDLYEKLVLQGGKSTLACSKTGGCECSLFTRGCWHTFQNTH

SEQ ID NO: 1012431 - protein, 67 aa, Homo sapiens
PGQEGRPGSRKETPEAFYGNDTKTKDVLRCSAGLVQEASASQEHQTDDLSVLAAGSREHESAKALSL

SEQ ID NO: 1012432 - protein, 166 aa, Homo sapiens
MTAGSQMLYQAGVFASRSSLRCCRIRFTWALVLLQVPSTWCSCWHDVWFGFLPSILPRLPDHSVLRGSWEALAYLLIPLPQLLSLDDHVMSPGVCSVRATCISDLSGDLPVCAPGFASAMSSSWPALRDSSRILMTQVDIHLWAERTGRDTQGPLLETLLDLCSRP

SEQ ID NO: 1012433 - protein, 210 aa, Homo sapiens
MDRKHIQQDQTDSKGDAKDPARLAQATPKHVNEPDMPHRLAMMTPNSSHVRLRPLSQWRHGPDGYIHARKRANKQQHPRHGRIETGITTTREEETRRGDSTAQDGPQHEETTPRPQGAGHYTRRQLRRQSVAVNHAPHIHEKRDASNTHKMRHKDSPTPNKQYDGRSTLEHNTLRNHPQKRTPHNPTPGPTSSTPDTEEHRHYTEAEHKT

SEQ ID NO: 1012434 - protein, 342 aa, Homo sapiens
MGKPGVEAAPGSELARFPEPMEHADHHSAPGLGPPSRTGERMIVLRAKALACLELLVAPRSVGQSSLEAEVATEIYALNNGGSSVQISTELVRTFTITRHHAPYMSSTAGLIIVRMLQARADLFCACELSRGYVVAGAAMADVRPCPGCADPQVRRLEPLVQFPSVRLPMSSYTEVPSVPGRRLMTYEMSTVSAQDTMIPENEQHRAGELAVSVAMPPETQGSRAATRDPKSLGISSSQPCVPRKLPGEVKWALEHQEARQQALGDACGNLGRQLQLQPERSPGQPGIDCPHRLSVLCRCQGTGPPGLRLQCPGAAAAQATGTLTPFLTPAPCAGRPWRRPR

SEQ ID NO: 1012435 - protein, 99 aa, Homo sapiens
EMDEGGCSVGRGLPPPWQPQAPGPVDGTASAEGREPSPQCGGSLSEESWAKNVTLPGDTGGDEQCSTLGSLLGALPWLTRGAHSASVLWALGLPALQCE

SEQ ID NO: 1012436 - protein, 146 aa, Homo sapiens
MLEHASSHFTTKETPTSLKRTTTRSAIATNPCAPQKITLKLDTVQHALSYGMHSVSRRCPYLPGRPAGVLSSSSLSCIRCALRQSCARSMRAFVPRPALKRRFDRRANGRSPGAAVSPGLSSFGRRSWFVGHVHPLSWTHWRAEQL

SEQ ID NO: 1012437 - protein, 251 aa, Homo sapiens
LCDASLSSLRLSGSTVAMLPPGCEDVRSFVGVCARSLAMVPVPLRKPGSPWAVAAVLLPHVPVPAGSGNGGGNGRFRTDAVCAIGQAPDEVLWKCRELGYVPRLVPGSVPSSEGSPAAGSSERIRLLGLGGRDGAPVGICSPGPCGLGPRLISARGPRSRLLIRSELVRLAQEPSGVIDWNQRSWTPFPVRGGPGCDLDHPRVLPEVLLSGFNAQQTAVALGIETRRNVGPTDFQRAAFRGYNRTIKPTGE

SEQ ID NO: 1012438 - protein, 107 aa, Homo sapiens
MVARGPQVALRRHCRQRRNPNLVLVEISGAQFNRHKAMARLNVRSEGKLLIPFHVLALCLLSHMSLLVVTMGSEEYTSPQTIWQKYSRLLPQSHMSALLLEHEDNVT

SEQ ID NO: 1012439 - protein, 108 aa, Homo sapiens
MPPLPSASRIDNSWGNIGNKVTKEEYNTRKNTKRKTDNRKRTINVDRKIAQSNINTQKKRQTESIATTPNRHSHTNDHKAENHTKRNKRIALHTESRANTHEKTNKPP

SEQ ID NO: 1012440 - protein, 170 aa, Homo sapiens
MCGREACINTNKVYARTSGRHTHRGFKPPCGGQYLQGVDQRGNPLKHSSSARSVLPHHNIWGQQHLKQLNRSTNIFKQGPLHQRGGHQIHSKKRLVPHEVVSSNDQGRLETTIQPCAPIRSTMYPQALLEHTVLRGPLNTGETNFAPSLHTQNPYSDIYTHQVIIKREIG

SEQ ID NO: 1012441 - protein, 191 aa, Homo sapiens
MAASGVRHSYFYRNSHLRGSPFSVACIMNEAKRRVRELYLRLAIWEVPDITVHQFPAGTSLCKMGRDKVREMFDEDMPMSTDPKGGLIFWSFKGNSIELASRTIKVWKQLDTCYAVLRIETERANGQTDFLSKFYVGHDAMKSFRGKMHVDTIFRATNNLHLCKWVKSDEEDKERTQKSKNINSERQNSQK

SEQ ID NO: 1012442 - protein, 103 aa, Homo sapiens
QPSCKAISMGSPLQVRVHVLAGHRGERRPRGDVREKQLRPVEEKLDPSPAGETSFHVEDGMGPRTVAMSPHHRAVCGGPYPSIITLIGRTVDPDHVTLSITCM

SEQ ID NO: 1012443 - protein, 209 aa, Homo sapiens
SVVHAAGPAADPGPAPGIPALDDLFPPPIFPAEPAQASGPYVEIIEQPKQRGYALSAYKMRGALRGQHSQAMRSTDIHQRPIPTIKINGYTGPGTVRISLGHQRDPFLHRALTPHKLVAKGSCAGDGFYEAELCPDRCIHSIPEPGNPVCDRSGTWRQAISQTQSRPTTNALPKFPIEEQRGDYDLNAVRSDFQVTVRDPSGRPSDLPR

SEQ ID NO: 1012444 - protein, 120 aa, Homo sapiens
AFFQLEALDTTPTRDVTMNVAALQPPVVQLHDQQPLPAAGAPPSPTARPGRADDYPWPSPYSTARSPRDRRARTPRAEERRTVHLVERARNLKSPNQAQKAPETSHPGGTTMGRAKKGNQ

SEQ ID NO: 1012445 - protein, 341 aa, Homo sapiens
IAAQDHRGRTTGRAVRVVLRTVDLPWPASRRLVFTDGDDPELELLGRGPAGHQATNMLLADAATRSGPVVLAKDVRMEVLTTVHFESGAAMWFLRYVDDGRELNDECAQCSPSVSDRASSRDFFKRPVLREVLPCVAGLEPCGNQSPFDWPGEEWSSGWADGCDPRSRKLLGLCLTWWEARGSSHPRQQGRCRVSASELPWCLGLGVDGFNEARGCSESCRTCREVTACRLGVHRWHRASWVAPTWRATGPLLANLQPWRRLSEGVPNAKTTCFQAGLAFVGHWQGPVEDLDIPWLNGGLEGFQAVRSTNAKNRFKGRYPMVFVVPQTPELGSQGRQQGAP

SEQ ID NO: 1012446 - protein, 124 aa, Homo sapiens
MRCRITRCDEHTQTQASFYFTSRKPLIQAGAVELRAGLTYDAWPCRTCTMTSSERWRSWHSPLLSFIDIMKDTTWHMSLPSIVFHSVYRVATNRILTITCCLVTSSRGVAKVEVVTKGRVWGYM

SEQ ID NO: 1012447 - protein, 254 aa, Homo sapiens
MMPAGYGGSWHYGDVVKAVHRPCGVFAAQCHSITEIDPINALQVVPWRAYEVTTMDEACLSEGDIFVNTTGCIDDLILGLDFEQMTDDAIVCNIGHFDVARSSVAVANENAVEKVNITPQVDRYRWEEWAAAIILLAEGRLVKLGCAMGHPRFVMSNSFSQPGDGARIEAVDSIQTRKSRMGLQFSVPKTAWMRQCAEAHLGNPEVLTFEQVYLRSKASYLGMSCEWPPSSRITTATERQVCVFNASRWCLVQA

SEQ ID NO: 1012448 - protein, 311 aa, Homo sapiens
EKWSILEEPGLVSHQPGPEAPALPKTCGQLKKEAKKREKRREIPSRSRRSKEQQPPPGEKKTKTREEGETGIRGGQLPYDTHRTPSRGETNRCQVVRMLDVATDLGMSEARCVPLGWDACRDFFNARDMGVLNVSAGKCPEVVFTECAVPPTNVEQGSLKLGHASVYQWPVRGTPRDSDGDRMRGETYLWGTRGCDHCKVLPTLGGGGEEAMAVSRVLEPAPAGSARPFYRNVCNRGRWQKGDRIYHQLKNAWQRPWIGIGACVTRGTLNSQQLCREAFVRLQEEGIIYREYPLVNCGPGTLNPAIFDIEV

SEQ ID NO: 1012449 - protein, 178 aa, Homo sapiens
HCQHLFCVDEWTAYPYKVKMSAQESCLSLIKYFLFVFNLFIFVLGSLIFCFGIWILIDKTRLRCPYVGLAIRAICRYWSKDPWHISGIFTHGHRPPGIDVEGPQGAHDEHPGPVLSEMLLLLYATQITLGILISTQTGPAGAKLAGRTVEKTHPKVRNTTPAGDRGTEESRDNVQIPD

SEQ ID NO: 1012450 - protein, 254 aa, Homo sapiens
GLRWRRAEAIYGNMKKFIRYLISSNVGEVVVHLPHGNSGPARSPESLLQLLWVNLVDYGRTCHGSGASYPVQTWYIMAEAAPESPDQALISGSGSSSDTCAIGVYVCLATVDCRQPGGLCMTAEGPQINFYQLRNFLKCSEDKPASLPASTVRCSESRFPTMHGLVRARDLLSTGPALYSVSENHSLLRMPPWYEALVCVVAVAMSMALHFLILLVPPLPLIFQVTPLSGRQWVVVLQISLPVILLDEALKYLV

SEQ ID NO: 1012451 - protein, 112 aa, Homo sapiens
MTGKRSLYISSHSMVVAIIMARQSKAGFPGTMGGNDSAMGPREPSKKNRENWTYEGFCALCELKIFTQGLVRSWTRMVLGSWGLAGARAGDAQDPAHWGHWRLGDPGSSKAC

SEQ ID NO: 1012452 - protein, 172 aa, Homo sapiens
MDSLQSSAGGASYLGASGCKGAKDFNVALSISRLTPGGKAAQAGHGLLGDWVLSIRRRECGETSHTSEAQNKIRACGGAPQDVGDPAGSHSDVCQMTNTLHQTEYGGMGRGTVHGPDGTECMRQQKQEPEHVQQNHADTNNCKTPPKTTEHQNKNRKNTGEQQNGGKRNQTE

SEQ ID NO: 1012453 - protein, 227 aa, Homo sapiens
DSLCCHFTFLREDQRPSASVTATLEDRSQQPYSGDEWRAIPEGPYIGHYGCKVVSDTTNLCLLHLTGIEALVLVGKTVLRVESALHGELAIFESMHRCSESIVSGPHDQVTQERCHVLQTTGPPVVDREGKSWWLTLPSYLLSSQGPITSMSLLASISVGGSCLHCFSSPWRPPLVLLSGRIQSVALLSTVSVYIMGVAYQRTVNRGPLGSGSHVVPCGSFSLSLLS

SEQ ID NO: 1012454 - protein, 366 aa, Homo sapiens
PEATNIGKGGVGRGMARENRAGERMGTGQDERIGLGERRSLLGEGARGASVCECAVLCIRCGCTDARLRSAYLRDVMPSCVVVMSWMSAVSRSARCTCMSTAVCWVGSDVLCGLAVSCPCRSPAGGLCRTCCAVRYTGFFLFVLWHELNFHGRQFAYRRWPLLSSLAFDMGPGRRFFSSRAYASPRALRANLLAACRPCAPARPFARACIEHCSSSLAQDAVRDAFKGWGWGTVRTAHHRLGMRSTIPAVLELGATLRRTHLDSCPCGRFSSPGAGGCGAAARPPGASALQASWEACGYFMCQWAPGSWLWVCGAFSPFERPGLACRIGRKWGHVALSFWGQGQRQAAALSSLVAILARLRGPLAL

SEQ ID NO: 1012455 - protein, 126 aa, Homo sapiens
CAGSLTAASSRTAAPVYTVTCMRGPETVPAPKRSRSKLMAPTRIGTHNGTFHCDEALAAHCFASCRSTGDAEIVRTRDPEKLASCDIVVDVGGEYDPGETDIDHHQRSFTETMSSLSPVEAVARPS

SEQ ID NO: 1012456 - protein, 260 aa, Homo sapiens
GSPLPEQPDRELRIARPVPTAPVSRVTGPPRPSWSRDYLAPLRLLIIGDSGVGHEIRLLLRIADKHFLMHDYITTTRMLDFNASRTVEINGEKVKLQIWDTAGQERFRTITSTYYRGTHGVIVVYDVTSAMSFVNVKRWLHEINQNCDDVAEVLVGYIRSDDPERNGGGDRKMPTNSPGRWASSLFETSAKENVNRGRDVQLHHGAWSSEPKTDNLCITMHAWDNQNGCGEAHEGTGKRKEELLLMGTHSTAETALRFPP

SEQ ID NO: 1012457 - protein, 245 aa, Homo sapiens
AGVPRIKLGVHPPSLDHSTAPQVFPNPRDSAAVDRCYVTTFSLRCREGNLQFVAFALLAGQLRSNDLNHRGHDHGFYLPCRLGRAREGRVCLLVDECVIHAGGIGSNVMNSVGMTTPLASWLPVMDTDEYVYRSNCMFNGKTSQCSELNTVIVPLHQWPRYYGGRMHQGEQSDPVVCEYWRPLVELVCRHTMRRKMPLCCTESQRVYPVQQMLLRERCERKMGQNLNRIPFMDTFWKGTTSHSAP

SEQ ID NO: 1012458 - protein, 253 aa, Homo sapiens
MVPYRAWDMLQCKYDDPTKVVPPRGFVSRDCIVAAPTEREATGAVTTLLLKSKSSVVASLIAYGHRDHRDFLICARGIVYTQSYSPSPGREVAEGPRSNDPEMGYPGLKSQALATQTQIQDIEVLPRHWQEGRAYGNCSEAIATEGDPKLVMKGRVRNNQRVQKSFNLANPIVVGGGEETGVTPLLRKAGTYTRGALCGGRHLCERFPELPRAPCLSRPSIGLFGPRFAGPPCGDCGGTPRGGGPFGSGASGG

SEQ ID NO: 1012459 - protein, 331 aa, Homo sapiens
AQAVAQLSEGIEHPACGLTAKPPAHVMVSEFKKKLFWRAVVAEFLARTLFVFISIVFLLLWRSNTQVGNNPSTEDPGTYVIGVSVCPSGLIICHCVAQRCGPRVSGSLSTIERRLVSTLGAAVVEAAEESRSLFPLHLYDTCHSVLEGADCVGAVWSTNRTVRLEAIHRPSAALGELVLCPQMYAGLDRLSNIGELQGLVVRSDAFDRRDPHSVGGIMRSLATYATGMAASGERVWVWGSNAPRLCRFGALLLVSPLWGRTFPLGSFDITILGLVGDVNPVAQGPFWAPAGWINTPSLQANQLGISGRGAQITQEEKPLGCTSSTNFHAWA

SEQ ID NO: 1012460 - protein, 89 aa, Homo sapiens
MQRLTGVTLRAGGQTWIAKSPNGRKLRRDGGTILVSKVRGLSTGSPGLTKGKSLKNAYLPGPKGEWVHLTPSLMAGHENLPGRSLDVER

SEQ ID NO: 1012461 - protein, 220 aa, Homo sapiens
MPTGSGMLTLLLVLNCNWPIIARHHAVTLIGSLVYSVERGLYSMVPISARPFTVGVERPAVDYTWITHGLFDLPCAVSVSGLPCGLGHCLALLPDYVPVCVGHESGNMARRIACLVLAMGLAGTPVTGWGQPLSDQPLLQFFNFLNVHPRGQCLVLGLVPGAVARVQCPRKHRPSHLPDFLCASRLPFHSHKGNESGEHQIPGGAARFHSSHLKSGASPP

SEQ ID NO: 1012462 - protein, 142 aa, Homo sapiens
RGITLGLLAVPVRGLRQMAFGWRSTLLKHLQQPQRGERLYHCPVCGKAFGQSSILDTAPCACTVVCADGPSKCPAFAAKGFWDMRHQRVRPGHLQRCINRAEASRIAVSICAERPSGPIAFNVRPTESDRRRGLPLQRVATR

SEQ ID NO: 1012463 - protein, 167 aa, Homo sapiens
MAGSLAARGPPAVSEPRALAVAAEADAASASGPVLCSLIYLSAMAGANPRCVELGLGTAVEWQCHGQLLETCEDDSFMACGPGRNCAGRDNWIKMSEAPTSIWQAEETRHKVGPCRELPEEVNGVYTVLSLTVSRNHKNCVTLICKSTMVVDLSKVYAPVRCNHGPH

SEQ ID NO: 1012464 - protein, 37 aa, Homo sapiens
MRLLEQTKSVRLEKARSSAQVQTKYPSSDKRLYTNAK

SEQ ID NO: 1012465 - protein, 209 aa, Homo sapiens
MEPVSVWQYRSIFEASGRLGGTDYLGRVLKNILLTCPRIFHPDDLSRVVKASASKRAGGPTPPGRERAVAAAVELRSFLSSSARSEPWTPGLLCPWQEETEAETVSVSAGSGPVGCLSPKSLRGMLSLFPHQIPQAEPFANTSSASSQCRGLAWPGDLQTDRAVDVGCLFAGICEILPRAPSKHCVGGNPSRFSQSIGWVPRRCITSLP

SEQ ID NO: 1012466 - protein, 91 aa, Homo sapiens
GCLGGDTQSPGGGRKAACPMTGDPPGRCALGLQASQGGIDFNQLFGITMDYTRKQGGSCGNLCPGDVILGRIDWCLGQRSMTSCLMRRERM

SEQ ID NO: 1012467 - protein, 264 aa, Homo sapiens
MVSGRFYCVLPAAGVPGLYGILFTIYWMQYWRGGLAVEWLSIYMFETGTLVAYGCWHGWEFYGGASLVVRACAQFVGGARTCLEDSSSAALPPAWPFVLTVRGGWFGCLYVFTTMEGTGQRSTARFDSWRGAFDHCSFLFACQLGFAWVFAVIPPDPGRRCGMRSAPKTYPRSVLGAASPSRLIARQSGHFGASRVRSYALSFEKTPPGPYQQPCPVRRSYANQHRDAGGWPLGCWCSTILSGVHLRRRQSGDPDRKRGPDCMM

SEQ ID NO: 1012468 - protein, 222 aa, Homo sapiens
RSAQPEPNPVLPTLSIGIYGVGKSRPAIPQPLAVNSDHTPDGATQDHTPGVGKWQSSMTLEASIIKGKTTIRVDERETAGGEAASLSLEGLQEPQSSKGFKDKPPRYCFVLVTDESRVGPKCEQGPRMTFRPAVLMGNMTVLKSTSTDCRGAGVVAGRLGVSKCIARTMGADSQSMGHWPLHDRGIKGSCHHGKLTTAAVLHQTDAELERRCLVVDARAETV

SEQ ID NO: 1012469 - protein, 266 aa, Homo sapiens
EAETEAAPAVGCGADARAGAAMVKISFQPAVAGIKGDKADKGVGVGPCAGLWSPRSCLTPGVGRSSPHERSIQRGGRSVGGAVLPVDAWSVLLMGPTMFGLVIYTLQIACFLDTGWARDKLLPAVVCCMRTPCRSQDPDSDGSWKQDVKIYLDEKYLSAVNVPVPLVWLAGDLLQTSSIDFQRGLLRTMSSLPGASASVSRTQHQPLCCPLASFWELLMNVNEGDLPAAEQYIIQEEMVVTEHVSDKEALGSFIKHLCNGKDTYRL

SEQ ID NO: 1012470 - protein, 142 aa, Homo sapiens
PSVEAGEPDARPVSILEEAAPSVEAGEPGARPISILEEAAPSVEAGEPGARPVSILEEAAPSVEAGELGARSSLHTGGSCPICRSRGARCQAILCALHQPFAVGTFSTETAIKLSSHITALLQCALQWLSGYSQGCTDITTI

SEQ ID NO: 1012471 - protein, 105 aa, Homo sapiens
MSSLPCMPTRHVPVSLPDMPLELACCRCCCPHCLCDSAPLPVACPTAGSVTFAQRHYSIPSRALSRGTICASSRSAVSDPEAASAGRRPALHVMDVPTSVRCPAA

SEQ ID NO: 1012472 - protein, 334 aa, Homo sapiens
MKEWSVCQRTQGRLHDGPRGALWGFNHSFSEPIDALLRICSTEEASRIGETVWRALRNRCEDRAPFVSHQVCAGHIRYRFSLSLYVSTLSSMLRGRPRARADERDPNRPPAKMTLTFHMGYAVDLCSFVGYPLRVGVGVRGVRPGARNQVWALESRALRGEGRYRNCVLPLAIEGGPEKALGLAGNWVLVPLALLWGFRRYSYRTFLAMEPVVGDLLARRAPKGTSRVKFDSWSGWGVLGKDLIKAKGRGVVLVLKPSVDLRFRGGKAFTNGSLCREGREHLREGLESFQFDTNWSSKGTQRVVTHGVGHFQGFTISWPVAEISLIKSIRCARK

SEQ ID NO: 1012473 - protein, 66 aa, Homo sapiens
VLALCSVTEGSGLLVDEPQLCNVAMGGASRRVEMWGMGIPEPPGACVRSWSLLGRDRGHVRCWQLP

SEQ ID NO: 1012474 - protein, 228 aa, Homo sapiens
MMHTERKVDVYGFVSRIRAQRCQMVQTDMQVCLHIPRALLEHYLYGDTELEVTSLETHLAEHLQQNPMRTSNDGLEEEFTRKLNRQSTIPGMTTYACTGTTFQATCTKNRVLQIIHTEYNRVIIPAYSGANEKHDYVNALLDVTGYRQKDSYIASQGPLLHYKFEDFWRMIWEWKSCSIVMLTELEERGQEKCAQYLATLMDWCPMEILAVELTDRRRNVRATPSETF

SEQ ID NO: 1012475 - protein, 109 aa, Homo sapiens
LSGSWRTVPNSPRPKSLGSLGSPELGRWLVGGLHCSKNAACALNVVYMLVSLLLIEKWMLAGKEPGSGVQHSDIIGGVIAVGVFLLLIARGWTGGCMSNTHKSLLVLLR

SEQ ID NO: 1012476 - protein, 113 aa, Homo sapiens
MANFTQEPQYMPDHCCPSSGSILMSIHEAGLILPQLPESRWRPGASNGVSSCLPVRRCSLLVGRILWFPFAACTWTADGRLIGSTVGRHSGSHESLQPICWRVLGSSIAMNGG

SEQ ID NO: 1012477 - protein, 260 aa, Homo sapiens
LPSTGNNTMESNVRRHCKQAVVTQANDKLTYCLGPVVSLNGVGAVKEDQSCPVLGGRKQSSTVLFVGGLVEAGEDAGEGLQKLPLTAVGVHRGNRVWRLSTTVLECEVVVISAHVRTLVPPRFEAILRAYSLTEIAWDYRSSMGALRSPGGQESKAISDSDGGELALVRRTPQRAAPCVGPQARGTPKFIISMNEQLLSPASTWAVPVSESNVAKLTNIVPGPELHHWLDGHQCTPANDMISPARRVHWRMQLSTRGEPQ

SEQ ID NO: 1012478 - protein, 128 aa, Homo sapiens
MLEPLRIARLRVIKVNDTDAGSEFQSDWSRIIQPLSTVGLQAKFGAMDDRVDANPRSLLVDHHSSGKDILVSVYGCVMHCERMPLVEQLCHEAFQHSQSLSTGNKPWMSLPRGNGRSTYLLLKERDKR

SEQ ID NO: 1012479 - protein, 128 aa, Homo sapiens
WLVCHPAPDFIERLLTVHGEPVMTALQALRHPWVVSVAASSSMKKLHRSLSTEPPYTVPPQRCKSTKSAQFHASSRSTRSNKSRRVRERELEELNLATSSNTMAEPPGCAHMQQEPDLAHTLCVPSGS

SEQ ID NO: 1012480 - protein, 298 aa, Homo sapiens
CGSLAICRSVVFPRCHSDGEQLDADKPGPALDTICTLLLEASRRVTTMTHLRHAEAVVTPVAPGEPNRDVSSERMCLMALETACEDLPGRTSSGEDPVGQRTRAGRTEETLFHSDLRARGLAVVISSRVFCSSPRVTVLPSRALRREGMLTARHRAKLAVVIEAYEKLASPHREAIRWGHSNVVLRRANASVSFTSRDGLRNSGQQFASRGVQAVARVAFALIAHRGPLGKRTEPRLASQAETGRYGGLRRNLALGPWPGVHWDALVGPGGLWITGSNEPCKQGAEALGRTIEAPASE

SEQ ID NO: 1012481 - protein, 34 aa, Homo sapiens
QAGTVWSYGMGIAAHVELTVTVWGRVRCRRGAFP

SEQ ID NO: 1012482 - protein, 58 aa, Homo sapiens
MCGPSLGSAVLGPRASAGSGVGRRGGSRALLLLRVLFSRLVAAGALAVVARVAVAPAV

SEQ ID NO: 1012483 - protein, 111 aa, Homo sapiens
MQVRPGVRVDPRVRGCSQSSIRWNTGPPGEKLEKAPKELKGLQPYRKNNNMNKLVPPELVSLAAYVAEDGLAAIIGKRGPLVLQTLYAPVQGNARPRSGSGWVGEQSGGKV

SEQ ID NO: 1012484 - protein, 276 aa, Homo sapiens
RESLCEDVNHSVSWLSKRRRWMAWTAQLVQFEAGHARVIHVVTSHDGQTMRPESTSNRCNGIVGNAHLYDVVTPTTVYARLSLEARYEARRVRALMLETLSSRPMDEEGSIIDDFTTVDIVNGDPGHQEEAVRDCIRDAHEEVSDDVMTFEKKIEMSEAGRAVRGQKDDQHDSWPIVARGDSVDSDFPRSAKNAKSRGDRWSSFPVKRRAKRGCAERVQMGRQMSNDSHSAGQVGCALLMMGDVQQLLPERRRTIFTKYIGCSVSAVQESGLRQES

SEQ ID NO: 1012485 - protein, 81 aa, Homo sapiens
ASSFRRPEGAGVRSPPGRYVTMLSRPPEYEHQATQNERKELQDKRRREAITAGNVPDYRKLVGGVTVKCWDWDLGLHVTSR

SEQ ID NO: 1012486 - protein, 69 aa, Homo sapiens
EGLRVASGPCRMLQSMLYRALYHQARKSQRCILERFTIPSTLVPRTLVIATLPKNRTTMSKNTYIRYER

SEQ ID NO: 1012487 - protein, 111 aa, Homo sapiens
RKESVVSGGDRNGLAGVLRADRSEARRTSGNRKARCSSAVLKRKPRADDWQAGLQLPEVDRHPPVTGVSYGIMDDLTASNRKNQTKMGYSQSNEPNDYFHIPQKLWEDRAG

SEQ ID NO: 1012488 - protein, 335 aa, Homo sapiens
MTRTCVLHLSAIPAWVSFENWAAAAECKTGSWDVVGSWATGISEHSSSAQAWGPERVYAVRRPAPFCDKPCARARVVRVQTVAVMWPGCTVLGRGPGGDCMSLPGTGWIAHQWSEWIGASRNYLETERSIAGGFRPSNADWNTEVGLERKGRDKHTFAGTFRHEVYLREATPIQGDQRIAWGHLAGPWGLPLEAQGMEQASKLIGWWEQLRRLGPGKGDLITQLGGPGPPLGAQHPGRIRVGGKGEICQSREREPIAMVARDRTVAGLIAPAEALEDIHSTSDRWHVAKTMWKPCDSGTEEVCCTCGTAQFTGLDSSWQKSRRSGEGRQIAIWGV

SEQ ID NO: 1012489 - protein, 315 aa, Homo sapiens
MYTYPAITGIHNASYIHHNTHSLRSKRHLALQNSIMSSKTYILAATINLPSFHTSLTHQPHVLHPISHLCGIIIKRRFFNIKPQKHTAKSFTSAHIHQPHTISPVAVRMININSLHHSQLPQSPIAPHPATTITYRYYSTNLHHPPLTTTITTTPSAVNSTRTTYNTHVPMREYTHRCHTPAPSHEQPHHTRPRPHGELATTASTQHTTTHQKREIYQPTPPPNNRESNPPTHNTHTHKRTHRHQRSHSGNNQQSQHPTPAAGESIPRIRGATITIQRSTMHRASNTQWYTAHHTDTAAQQVTPRASQPCARTHH

SEQ ID NO: 1012490 - protein, 114 aa, Homo sapiens
DSDESWTTESAISSEAILQAPVCMNGGEMRSLIACPVPGCKKMIQECEWHKVSIAKNGHRNTMIRVRKAITQVSVLWEELQDLAPRDLRIRQQSTFHPPAVGRDALSWKMRATN

SEQ ID NO: 1012491 - protein, 361 aa, Homo sapiens
MGSVTLTGSSMHRKRWWKTYVGRGRGGPLHATRDLFLGTPTSYVAPKKRIGLGATSTRVVELWAKDRVVYNPEKPTERAGPSIEQNMYLLPTSEAKRIMKRCLHLLDNRRLNRLDSVRSHGISWTVENSVPMCDTPYDNKGCVCGGINGAPSVCQFYPPKTIVSGRHGLLVEGIVEKDIDTHRKCGLLQPTPFADHIAGHCVPHFPCGVTPYPQPSRECRHAVICKKAVPPVSSYETESTPTQICDGRWQHHCGVAPKGIEKRGPMSGSNGQGAPDGGDRVARVHENAEDREETPIGEAERKHRVDYGRTRSGRTVDVQDARPQELRGTTAHAAQVPIRVSYKIGGSPTPGIYGPVVGHTR

SEQ ID NO: 1012492 - protein, 338 aa, Homo sapiens
MSRAGGSAVLESLALCVAAERGSQQRSAAVRSTPWGPWAPCSWSEECGPGPALSAHMRAAYTCVSRLGELGLVEFRDLNAYVSAFQRRYCGMMFWRCEELEKTFTFLQEAGAGRAGLVLPPPKGRLNVNPKHRDLLRIQDGEERLAQELRVCGDKQTGPDGTQACTSCKIHDTTVHKASDHRTSDWKAEPHKKGPQKRTPLESKAPPGGADTKDHEGSNIWLDRDARMESPNKGPMPLRAPLHLGRGPSTEEISIICQAYSGEGWEDKPGSESNPPKNRDGRAKTNGGKHQYTTIITYRENEDRIRKHERIQTRIQETSNTTKTSEKTQKCETAEGRT

SEQ ID NO: 1012493 - protein, 303 aa, Homo sapiens
RRGPLVSVGCAQPVSRSPFSAGCEPPGGAWGAGVQTVAVGWGGGSSGPSEFGGRSNQCCVGGGGWSMWSVVPHVPRPAVYVTELAYWCALPLHSAVGAWCVCALWIWVKLGEPLVCAPGEAFPVLCCDDPWVGGLAGVVYPWNGAMWKAQDIWVTISCRQNNGPINLNQKAMDRCAQVPMKTAAPKAERTGYEVLGLVYASLCGRSEEETLGLSHYGGSRGVMSLVDHTAWCRLDKHCFVGTMGVCLGPEDKGGGVRQQASLSGGLQALMGGCVVVPLNKLPIRTTPDYLQGKTLPKIPVHIP

SEQ ID NO: 1012494 - protein, 247 aa, Homo sapiens
AATLSRSVAGGRQGQDGGLQRVVTTLRCVIDEDETLTPTSRHGQSLPVACIRPGCERMEQFHKEKLRNWTGVCREVAKLQRCAVGAMRSTDRQLAGVPRAARLGAWKLPCRPEALADLRQRRARLAGVAITAVSRRLRHRGTNKRAPGTLDTLMPIDWRSSKEAVGTHTWALYEEHPGTGRGTYMYRDTLDGGNEESRNYRTFSAGEIAVHRRKTRASKPHFGRTGFPHRHWGMHQHLIGTMARHGR

SEQ ID NO: 1012495 - protein, 119 aa, Homo sapiens
ISGASAVRCYSAAPYSTRCQGCETRMSDTCSSIQAHKTAAGLSAGQAAAEAGIWIRGHLRIYENPEAALVSNLPVVTAHVAYLHPPLVALQPRIKLRAVPDISYMILSYQKNVRYRHTL

SEQ ID NO: 1012496 - protein, 92 aa, Homo sapiens
MQATRLLKLSVESLDSFEMPQVDQMLRSYQSVLKPPACELLCAYPSDGAEETLKSGSREEPHRQLFSTPHQTFCLHEPDAEPKNDYTTANCA

SEQ ID NO: 1012497 - protein, 81 aa, Homo sapiens
VPPRVTPGPPPVPPTGDSEAAPVPPYRYESEEAQMPAFIRFEGAMSLGIHRLLETVGRSHVSVLLTQILSVFLEVNAFDTA

SEQ ID NO: 1012498 - protein, 176 aa, Homo sapiens
SASVNTVSVSWSFSEWLLHPGGPAALVSPVVRAVAERSRVAVTEAARQTSLEFWPVFVIPLFAPVGVRIPLSPPGVRIPLSLPEGFGIPTLAPEGFGLPRLASRRVFGVPSLDAPLQGSCARFQRGSVLNNGRFHVRRQSSVSEIRDYCYSDDPECSRPTPFNEVAVSKFSMTIDS

SEQ ID NO: 1012499 - protein, 222 aa, Homo sapiens
MEEPQKSYVNTMDLAEKMNLSKAPDPQISVSEFCLPLRATIILVNPYHSFNCGHSILHVTALLYGGHLQRKQNVQNAEKNGKVSPKSDILLRDAIEKSYVPDAIVDVTHCASTVSARSELTVGPQQVLQPFQKLWDMIQIPLAPNTGRANQREEEGDSFAGAAHRFNWMWQMVLPRRITGSHVRGIVKQRPPGPQCCGQMDGGRKSSSGWSSVGPWESSLPE

SEQ ID NO: 1012500 - protein, 188 aa, Homo sapiens
QNFLLHGTKNVTEFKQFKIANDKDSDGGARKIITREHIIDSGDIVVTLAKAIMIHEKHESGVPKYSTPKNGYSSNAYERPHLTGIRLRDWTATTAHKTHDRRRHVSSSETAKQNIRPEQDDQTTTRQEPTDKQRYNKIRERKQRQRKKHKSNITNTRENTNTKEHNKEHRHRNRGTRQQSNNSEKSKK

SEQ ID NO: 1012501 - protein, 264 aa, Homo sapiens
QVFWEEGHGATAACPGPDGMVLQCSSLHVGSDLLKFMEPVTMQESGTFAFLDPKGTAPGQAGSAAGPQGPGWGGGSPSGLCGEGQQGDPRDQSPARGSPCPVLLGKPPLPSASLGTEWHRAASMGFPNFRHLKASPAALGWEGTRWPQGGCPCEPRPTPLCGGRKCSVPLRVPQLSHDANETLPLHLYVKSYGKNIDSKLHVTLYNCSFGRSDCSLCRAANPDYRCSVGAGARAGACMRPCATTAPSARRPVITGSNLNGTPGR

SEQ ID NO: 1012502 - protein, 185 aa, Homo sapiens
LESGSPSACRLELRTKSSEGAIDISSSDPWTHTALDDWSLGAWQVQSTLGALAAWDPYTQCTGKDPSEEAPMPTGPLYPPRDPWYLTGALRHNTVALSSIASYDDHCGSFSSTGQNQKCRWKHVKLLFEIASASHLSETNNVSKLLVIREIKAWRDELIHGLTWRAHVDSYQNQTRRCPRQSDML

SEQ ID NO: 1012503 - protein, 275 aa, Homo sapiens
EILEGPMHARDGWLASGVPVDPLAWLWQCGWILACLRLPEFPQPPPCCVAACEEMGWGALTFVVFPAPGASDEPVSSMAKLLGVRCSPKQPDQPLASRVLAAVMGLPWGQSHLGLQMLLLVVDTVSGPVLSLELVPYTPQITALGPVKGKVTATSLLPWSSRAVIFDGLDQRLADTVWLVVAFNNASRGLPEPGDTGLTFRAPHRMLTDGHYMTAAPVSGPVCSCGDPMAGQLEAAPVLRVGTMNTAVTSSPSCNAPILAWTLSGEVPPDGHQGH

SEQ ID NO: 1012504 - protein, 212 aa, Homo sapiens
MRGTWLTYGLVVSGESLIVECQRLQSPRVHDACPASKLRHRRDGSRRVYSAAEHELGRRNGDVSDGRRTLACSRQTLWKHARAPRWSDEDYSAIAAASVSREMLDLEKQFSELKETLFRERLMSAAVAAWTEVGADESPWIHGSPLGVLQSEPQRSRFTVAVDLHSGFCLDVITEKYECELQGAYNMHLESEKLLLYDTLQGELQERIQRLE

SEQ ID NO: 1012505 - protein, 290 aa, Homo sapiens
IDFTFEQGVGICTSFLGISWALRRLPPGLAHSASPPSPSWCLCSSVIYVLWNLLLLWPRAPSCGPVLSPLPQYVALHFLGLWLGTAALGSASRHRLHCWTPVPTYPLLSPGSTWLTATPEAGSTIHLALPPAGDRHSPAWPPVVIYSPWLPEPDFHLQLVAACRSADSFFLGLAFSGFVVLLHGYHPYAWLLGELQARDHGWYMGPMDVLAFRQEPGYFWLALHDVSWFIVRRSEAFVVPPKARYSGLRCALAIPARAHSADERGRILWSYPPPAGPCAPDSHVPDHEPM

SEQ ID NO: 1012506 - protein, 488 aa, Homo sapiens
VIDHCVPELNLFSHEAKCIPLDKGFSCECVPGYSAEALLQTDNDDCVAHKLPATRDPCAWHTTQLRLHMHPAPTGPSSCDRLPDAHTPRIPLAPYLTAPTPHCRTQPTDAMPSHTGDPQACHSACAATPQASYPTHTAQAPDSPTPVHSRPPAQPPPTAPHNQPLHLAHSDPKHTHPTATPTTATITNHRMANKHRQHNSTDPTTRTPPDNHPPNGQAKHQHTSPTLRNTAGPRHPQHRDTPTHGNPTPPRPLTFPHLTPYHQPPYRSRNGTREPGQTHTTHHAEAPNPHARPSPPWALQTPPCSRTPRGNNHTWAREVPLEGKTSIKISTKPLGPTHAVAQRHSSPRHHNYCPKKHPPEPRPTGAHHQTPGDQAIPGRTRQKPKRRPRRKPLRDTTRPADTPQGDQYTSHTDTQPHGAIRRPTSAPPYGGHLRTRGPHHLPTRNAPRDKATSASHDVGPTQTLRPLKRANYIHPHSGEADHRTTITK

SEQ ID NO: 1012507 - protein, 338 aa, Homo sapiens
HRGLHPSTEEKRDSRMAEEKKLKLSQHCAALGSSMKVVAESMGIAQIQEEHLPDCYRMRHALQRFMHTGEAAQAHPPVTLDLRLERPNRTVEPLYWLSTPRHVHSFSAFRLLRAGPGELYLRTERTNLDGLTPEPHITPIPPLAPGVPPGTLLPSQASLALTHRSGCHAHAIPRETRPPASHKSKPDTRLDTPPRNTPLKRSSPKPQAHATAHGPGPPCNPATPGSQRAHATARTRHRGHPRTAKRGPAPTCHRARGGPPISRTRCNTPPRYTNPPSNIGAVARTANPEPRYVNATATTQPRTAPLPLAALPRGTAQPPGPGKPPLPTPPYSQRAPPG

SEQ ID NO: 1012508 - protein, 303 aa, Homo sapiens
RGSGAACMARGLGAPHWVRVGTCCRVGELVASGWLDSGRHDDLRLTDLREDVPCAYVPTCALTCKISTMVMGMPMVMAISAHRELSGMDIHHDHDHGAFTIEAIYHTVADRSVAYLPIESAVLLTMRTLDPLTHECTTCNGRPNGGDLGAPSAFHAWTLDAGLVYWRLDALVVATCAVTLQACSILWSSIRYTRRGSSRRLSRAIRLCVLSGLSASTFFAFRVVLLGTKCCPCDFISFIASLNSSILYHECLEQSPGRLHTSAPCVTIWGRISGHRWDVAGFLKLRESDGACLVAEEHCVRQC

SEQ ID NO: 1012509 - protein, 132 aa, Homo sapiens
MAAPVDLELKKAFSSSFTAKRLLTLNMKVKLQTVQIEQLNRRKSMHILQIHEIMIVVVDETRPCTERCTEGTVFIYLHVAKGRGIFSTSRSLEKQTYKQKNTQIKELEQKKSYLERSVQEAEDNIRADADVH

SEQ ID NO: 1012510 - protein, 259 aa, Homo sapiens
MPSPHLMNSPLKRWSSRLQFHRLELRNGTNTLGYSLPFGQRITCQQTWLADHCKIMLLAVLQTLLPHSWLRDHTKKLIITIQSTKQNSGYRDAHLVTNSRLLIPNSLMMLAEEVNKKLPYNTLNIEKKRTIKTHDNHIRGVEPLSSEVYSSQAGAPQNISHESFMAPKTYFVGMHTSVCVPPLDLRVMSVLPFIVKDGHEDARGAQRASSIYTHKRLEKNARGEHEGALVPARGGEVLSWGPKEHTPLSYDVSSGGARA

SEQ ID NO: 1012511 - protein, 156 aa, Homo sapiens
MTTSMRLDMTRTMNRERSLEKRHPVIAYHKPLLYQNQLSCHERHPSCKLRGFGNPKRMIGRRTIVPNQCGWARTPKSRSGGKRRLNCERVVNTSNRLAGQLIHNLYDIKVPSKCNKIENAKTRLGLQLMAHSPPYMRGTGRVGTTLKRRNGVKANT

SEQ ID NO: 1012512 - protein, 176 aa, Homo sapiens
MSSKVGPKYVSARGFELPLGKAIRRMNDNDYRADKTAGPPQVTHNRLISRRGIQHLFSSRWIKHRCKIAHREECVRDNRVVDSPKGVSDISSRNGGGSDQGLTEELSRNWRGRRHQLSKSTIHEAAGRMTDQHRDKRAEEISSRRSENSGRGRLGGDKAQFTQQSERTSSAPRDDS

SEQ ID NO: 1012513 - protein, 393 aa, Homo sapiens
EPPNPVPQAPLRPPVPPTVYFRKVVRLSKFRHVFGQPVSNDQCYEDIRVFRVYLGTCTFCAVNPKVPGACLLERQVEGVPFLVAPPNGKTSAAIEQGPYSERMYEASTETVFTVTIERALSLNELTQRHTSSWSRELTASGSIEIAVDYEFATEDTVGLYPSSRRCNMEDSELGIGYLGRGDIDANDRTVGAKFNPSRSGGPLNRDTRTKLVGFACKVVTGIAGGDTIGLTPICAEVSRGHHDGNGVGIGTQGLGNKALDHAPLNPSVRNRELGVTPLGKRYLTMSDSPIDYYSVRAECQKCIPKEVSFGRPISYSGDPRAGVPRGVQPPFGLGDTNTRRVARKSGPSTLLARAVSPLGSPNCRWRGTTIPVIPLWHTKLWSQKGGLHCRNGD

SEQ ID NO: 1012514 - protein, 257 aa, Homo sapiens
MEAEPPLYPMCGGCGGLCGDGGPARGPGRARGPCLDELVWRVPRTTTEERGCELPVTYLPASAFGAVLKERAWLPVACGAMLTLRRLRWPSCRCSLILHYDETYREVEVLATMGLALNNRAAKIAGWAIPTLTPIAALALTQPCAHSGFLERSGLMFHRLLGILNARRMVYKQTTWEQPTKHGYVATSDVAPMGQLSPIVGTHLWEPSNGGKHTSSPKCICVKNSTEGSTIAHDTKGSKELVSRGNRTQRGFRWEYT

SEQ ID NO: 1012515 - protein, 94 aa, Homo sapiens
MLRTKSYAVGERAAERQHTQSTNRREAVRPQTPQNDDVRTEDTNCHAPLTPGQRKDQSASTRLEQHDEARSDLMNNKPREGNKHTCVHTLTHAD

SEQ ID NO: 1012516 - protein, 75 aa, Homo sapiens
RPHAAEQCAREVRVLRVLEHAGGEKTRDLNCVCGAMQVSSLNEVKIYSLSCGKVTFLSGFSDYDRNESAYRDGKM

SEQ ID NO: 1012517 - protein, 237 aa, Homo sapiens
MTGWVDYNSSQGWAGTNAGFDTLLIETSPYSGGNAAAQSLSGSTGPRRISDSRQKGTCMKIGLVRKACKSHQGLAHPIVELDPNTLWGNTCRGTPLWRKDALAVARLQPQRLRRFTKAAQKGTVHSYPSHVALFRHSNLRPKRSYNNMLAQWRMPSRGDHGACGCGVGDLGAWVLASWILTSFGPVFPYSSSRGPFDTPGLVVYPGGPNSFLFLAPYTLGVTPLPCSTQEPTGGDFH

SEQ ID NO: 1012518 - protein, 427 aa, Homo sapiens
PDPRSDSAGQIPRLPVSKPESQPAAALRLRAVSVLRTRAPCPFRDPCPAGMAANLPAMDDPVPAAAPPDSGAAGQLHSAVAHPDHPAADERSDLHAAQLIAWRSTSTVCARCDRRPQRLRPRITAVSTQVVQPRALSLRIDTPAYAGRARGHAPQRPLTPRRPRAAAPPPVPQPGRPRSTTSRRATLYTGSSQGAGQITQRTARALTPDSRCLPRAPGLAGPPASRLLPRTSHTAMPAPCHHCLSQLAPQPLRLAHAPHPRLASSRAPHAGPRPTTPPLTAERPPTPSPPSHLHDSPPEQCLSNQAPARTHSPEPNPQPFTHPNIPHRQHAPSSTHRPVNADPKYPSPLSTHLSNQPYNSYSTPTCSQPTPPKPKHHHHPHKTHNQPPQHTTTQHTHTHNTHTTTHKTPTTNPTHTHTHHHPPHTHY

SEQ ID NO: 1012519 - protein, 174 aa, Homo sapiens
MPSRHTVAEEPNLRCRNRCVMCSPLQQSQQNGPPQTPFGPHDRVEQVFKAFCKNTMNSARAQLQDLLRGRHICPTEESCALNYQESCVCPRVEPGGCAVGCRSEAFIARRLTSSVDSALLWLLARKTFIYLDVSTTSRVLQRVALILNLVMVGLVSRLWVLYKGVLKRLILLYE

SEQ ID NO: 1012520 - protein, 189 aa, Homo sapiens
MVKLFIERPVPVEATESSEIRSLFEQYGKVLECDIIKNYRVLCIIEDKTAAEDAHTATCSHYKLHGVNIKRGSPAMNNEQEPLTKLHVGNISPTCTNKELRAKFEEVMVLVIQCDIVKDYAFVHMDRAEDAVEAIRGLDNTDVSSDNTEMHRACMSSQSGVITAPGMGAPAAAAIGAVKRRGTGPKSVR

SEQ ID NO: 1012521 - protein, 134 aa, Homo sapiens
RGLGVPGWVADPKPALGRAVGCPGQRKGQVQGHAGRGPWAMNRCPLRCLLQFFRLQNRRDHGPFPSVTPGCLKSRPHHWSNALLSSLLIPGMPVPSANARPMTCSRCRHLLDSGMVSSPDNISRHHPPAFLRGV

SEQ ID NO: 1012522 - protein, 112 aa, Homo sapiens
MPKAKVQNPEEKYGYTCQPKASESGMLDGSAAPADLNGEGAVVFRSGQWASCLGRVREMTGSCDVYSLPGSFPHPDMAVGPPLKSVRQNLARDGGWPVDPNRAVPPLYRERY

SEQ ID NO: 1012523 - protein, 169 aa, Homo sapiens
MRHGELELKEEWQDEEFPRLVPEEAGDFVKILKTPKGDSARLAARYPQALQPVCGHAPRVLLSVLSAPRVAAEIWLRGLEMMELQPNQSAPSSPDGSSDLEIDRIGDDLQDSEQLVAVDMNSNWEDELPRAEGLGTMLRQLRRLGRGCMWDVTGERMDITGRVFRMGPR

SEQ ID NO: 1012524 - protein, 194 aa, Homo sapiens
RRAVKCCLVHARRHAVQGSACSSVQVFGTLLRQRQLWRTANACYGLIKVNGSAPCEMIEPRTLQYKAAYGATCCFFWRRERFLEGRLGLYHNPVVLVVQGVCCATVARRLYAYPGRRPISQSHVVAVLTDEDLVDRGLASEGGSDRASVIADSDRQPCVGRLTLDRCESIKVWEALVPALATRNPTDKPVVTQN

SEQ ID NO: 1012525 - protein, 361 aa, Homo sapiens
PPKRLHARCPAPRRCSSCCSCWGRGVDGCGLLRSRRCPSWSLPSLALQCRTLAAPTTCGSSGAGWITPGARDGPSGVPRDLLMWNNNDKKYACRSWLAGLLGDRSNGCVLVYGMSSEELKPKGSTPRLKHEVPNAIVDAKERSPRFLEWSSKLGTGASAFCQRSWALAETYITVRARPRRRNDSWTQRNQALVRGFSSGGQWSLPCVDGPQIGMVTPQNLAISKQSCVRITHTPMGLHSRSAPKCRRVRIQLMPNESRHYVPVWSLLFPDGHPKWITTSLNTIDYHLADLAPFDGVLPWTNGVRRKKTPRPLRGSSRIEHVDAKQYHPKKRKPNDAGPPYIAERGKQIPITDDFRARQLAL

SEQ ID NO: 1012526 - protein, 204 aa, Homo sapiens
WNEWMKNLPKHNAKLLILTRQSSYVEALDLDEAQCVCQSSSVCRRYLEETGHYQRESLSDVYSDCCNHCQDHSTRGYRFHERAPIETHSVNPDRVVVVLSKIVVTAKEAGEEQTGGSRDIVPVVEWEGDLLHKLQCYGARRRTQEPEISGTMLCQSIVANSRSQPMALGTVARWGYARCPVGPVDRSMMRYIMLRRSKTYLKGQ

SEQ ID NO: 1012527 - protein, 140 aa, Homo sapiens
MLGRVPTSHLAARSNAWSCINMLLASSASSSLFHSHLGDNGKVPRGQGYALWRYSTVSILPRSPKVARADECKRNPDVTILERGVFEKRCFERWLHRVGGHTINSSRVATVGFKCNSGSLGCGEHFTRYIGLLQIYVVKV

SEQ ID NO: 1012528 - protein, 133 aa, Homo sapiens
MSDAHTTEAGDVRDEELRYTMAGLSNQPTEQYVAPETPRERSTRGSPGRKRRPRAEGSRSLEECLRFLKEPAGPTLDNRDCPQSNCGTRYRKRDFTELVATVSSRTGGRKLGEKAGEDSGEIARKEGIGRERG

SEQ ID NO: 1012529 - protein, 177 aa, Homo sapiens
LLPLRRTVASREEMRCFALKPWDAIVRAPCNVGWSSGDLELPRLGGVLGRPFPASSHLWLVPVSSCAQCWTCLGCPAALSPAPRSDPGLVTWAVCCFPDCRLGDSRGNTQGLRPRRRPHGLAELLHGLPDSPQCDPGRVGNLPSEARYPTPEGDGATADGPGIGDEKTKEKQSENGP

SEQ ID NO: 1012530 - protein, 227 aa, Homo sapiens
TLVGPQRVPGCQAVRCVIKETAAPDTCVPETFWHRTCALQARFDDVPVFRMHLLHALACLQGPGVAPVLRCAPDPRGSVYSNCERSAVTIERVLSAVGLPMPRPASALPRWGQTRLYYTAQALAQIPPRGTPALKPACVLVARGQIHLGAEPIETHHEGVRAGLGASCAGEYRTCQTFLAANAGGLARMRSERAYLTKSLRSQRPSEETLPSAYMTGRDNLYPWAIP

SEQ ID NO: 1012531 - protein, 99 aa, Homo sapiens
RECQNAEESTVLCISTSPRLHPSQEPANPLLSTMSLPSSRSAVSGSFGRPCAALLGLLLLLTPPGPLASGDELLDTRGALPGRLRGRCVPVETLPVNLP

SEQ ID NO: 1012532 - protein, 256 aa, Homo sapiens
MSAQESCLTPHSSTIALRLYKPLSSSSSADLIFCFGHLESLTRRSYLRFCSRFCLGVALFRASCMDLCPSSPGPSLVTLTPVGIALLGCVGALKELRCLLGLYLGMLAAPVCHHRSPWVILISTQRAQLDAKLAGRRRENHPISTAATPEETAGRGRAGTMCSSSCAVAAGTTRRTGSNVLILRGNGSEAQRVPCILLQLVRRPTTSTILAYGDLCPILSRAWHPLARPDYSADICAVPCKKSQHLPGGLAARASR

SEQ ID NO: 1012533 - protein, 110 aa, Homo sapiens
MMVTLLSKNEVCAPEARTMMTRCKRRQEEWEKVRKPEDPKKCPEEVIDPRSLYERLTGTRRPGSEQELQRNTSKVQKHGQRLHEDETNFLDEVLSTARNYLAHCSDEKTT

SEQ ID NO: 1012534 - protein, 332 aa, Homo sapiens
MCLCNMHWGLWGLGRLNVIYQLDEEETRYLVKIPVPAERITLGDFKSVLHACPRCAKYFFEVYVIMDFGVVNGQKFHDEQRPCHPLLQLEGWYPVLRVLMSNSRKPKTGHHPGPMEPSGHELGSHPCSPSQFSPFPFMTNRVTDEYPKRSTIVGELPSGAAISIHVSPDTVKVAVFARPKTPYCKRKRFRLRKVTLGRELGVKSPVSDSKREEDWVPRRGTAARCVQAEGTHSGLAWKRRATKGRRHGTGPDLCAQVAMQNTSAAPIVGPPTYVTMDAPGSLGNTVRVSIWRKQPHREIAPTPQDGTLQFIGRLGSSRRLERCHTRGWRVRN

SEQ ID NO: 1012535 - protein, 118 aa, Homo sapiens
RLSPPRDRGAPGSSVLRAGGFYGPEAIEARYDVRIDARSREGGVLLDANYYGSLTQAVTVSLGLDADAMRCSYPSARCCPWLAAPIDLVFDGWDISSLNLAEGDAALRRCLDWGLQEQ

SEQ ID NO: 1012536 - protein, 111 aa, Homo sapiens
GRARCYEHQSHTHGERSYGCPHCGKAFVAELQLAISTCASHGRACLRLSVLFQWPFGLEAHDACSSRPCTCDSGLSVPSAVSSAVKAFGQASSLTKHKRVHEGACRCVQMA

SEQ ID NO: 1012537 - protein, 122 aa, Homo sapiens
MVVNELIRNGDEVTLAECVSTVLGAKRLETGFGTWFKARTVHSDVPMSPLEVQGVVNYTLELTGTRNEMRSSLEEQVLDFESLLFSTRHGEVPAIKGSAEQASPLEYLCGRFHEYTHLGLAK

SEQ ID NO: 1012538 - protein, 97 aa, Homo sapiens
RPDLVEARFWSLLHLTWYRFPVSQGLRGEVPMWVDSSLLIFVRVLSEPRDGAMLRCVAGDTLEHYLDKQLTLVRGVLLHCSSDHPSRGSAPYYSTEW

SEQ ID NO: 1012539 - protein, 108 aa, Homo sapiens
MILEKERMMREVLAMNACKIFQPVDYIMEPSIFDTLEERIFRLEMGLQRIVYPGSYLENYTRVCARDLVKPLLDPHVGLSFKTMGWLSPVPGFKEHFVCISHLDRGLA

SEQ ID NO: 1012540 - protein, 286 aa, Homo sapiens
LSGRNFRACEGGRLSSDTDVSSGGTLRCWRQHLKLPGPPEWTGQFCTEDVDECQLQPNACHNGGTCIQHAGMATADNVCQLAGQAEKLQIRISDDWCQQHSVLSMGATCHDRSGILNITDDTGATMRQRTWTYQMFTRGNALTLTLNKKAPGQQHDMANHREQHDRHRENTGTGTQVLTQPVDTKRKRTYQATDTGRRRNYTRDQRGTCIEHQNSGAHQPSRQPQSTATSRNRQPQGAHERSEQNRKATQPSSKEHKHPRENRQRQRNQDGAKQHVGSRQTDKAEQ

SEQ ID NO: 1012541 - protein, 84 aa, Homo sapiens
SDVGLWGAGRRWKLVSDGCSSAGGVLPLIPLAVMPRAVRPLQCLSSEEGTLFSTAVFSSLWIMVTCIPPHPFRISGLQWDSGFY

SEQ ID NO: 1012542 - protein, 294 aa, Homo sapiens
MAPTACNQAYRSAAAGWPAAGLCWKEPSFSLLLYLLEGPGGIPWLHPSLMATEGHSTSSTVDTACSSRLSKNDPRAEANPSRWAQSLLTQPAYRECFYPLVRYNPIGVSYSCLQGRHNTHSMTHMGANSHPYEPRPFRASPPGEATEKIGGNSGAYGEQELAHFSVSYIQFAGLRNSQNRLHHLRAPIVTTFTRQRTLQEKRLLFVVLFWFETYFPVVSSPVSLPYDKSGPFCADYDELSSEPFKIAIPTLYVCVIQPVWFPNPQLNYVAKTPSHSLPSGYDIVGALLSVVSIS

SEQ ID NO: 1012543 - protein, 127 aa, Homo sapiens
MESILHSLVQTGCLEENSSEDHCILQYSNRGQEFLTEFAPLCNHLLLRMVKNILCLDLVVRKDRYLTRRSDMKHLLLSSTRPSYCLSMEYTAESYLERLASVRSLVVTLRESLIGKDKIGHKPMRGG

SEQ ID NO: 1012544 - protein, 184 aa, Homo sapiens
QLYCLGFRIAEEAAGRELLVQWEALAENRQSNRWCAPKFYFHEALRAFRGSRYGDFRQIRDIMQAYAVYWPLGKEHTVSRLLRVMQCLSRIARKAENLDCSFDMEAELTPLESAIKCAGDDYTRNFTLTEGSGSNPVEKLGQGKACCSIILYQENKRIVNKASQNFEQETYVQRTPTKLMKLSK

SEQ ID NO: 1012545 - protein, 104 aa, Homo sapiens
MVSGRREHTHQYYACGRNIDRALGSTVAMGTRVAVINFTQELRSYAPCLETYTSPATTIARENYCRSEQASLPHNHLCYSKRVVQLTNNVCVGRQLNSLLFEIR

SEQ ID NO: 1012546 - protein, 145 aa, Homo sapiens
MHLFTFPKPSPASGDSGGSAYVAYYIHVNGVLHMSGALQPAPGAATSTLRQGVWGQCASCIPPKSKLFSLTPAEVEQDDDASYENVHASCSARPIAWEQGDFQQFPASGTNRRLAGGPHSRQVSLEVLLSSGQKVLVNVLTSDQY

SEQ ID NO: 1012547 - protein, 189 aa, Homo sapiens
MKLVRKNIEKDNAGKVTLVPEEPEDMWHTYNLDEQVGRQTDAHSNQSSKVQTEVHPTGTRWDMQTGDPTLTPHSLTWRDIEHIDLYKAMTRHDGINMEGPNTPNEDIEFMSRMGGLTNNQSETWTTQNDSYQTHEANESQGENKTKDTTDNAIEARAQMNPSMEDSRKTRGLTDQYSERAIEHKSAKNT

SEQ ID NO: 1012548 - protein, 174 aa, Homo sapiens
SCSVSEVSHRGVTSDPPSRFLWNNYPSETWFHPYPSLELGRAATTVLARRGTVFSGSDNTLTEEKEEAGQMGPSDGDYGSEPAYMFWSFEKGGVYLHHQLLRSIRTETTLIAGVTPCSSDTRDTVNDPSMPLWHHVRGSAAQLPNQIHLSSKNSTSIWARDSMCIHERGTNTIE

SEQ ID NO: 1012549 - protein, 31 aa, Homo sapiens
MWLGLLVFAALSVFIISSFVCVLDSVVAPAC

SEQ ID NO: 1012550 - protein, 253 aa, Homo sapiens
RSPPGFTGSETLLQASSGTAPLCLLLLQVSTIAAPVALLVHSGCCPCASPWGRLTGEQLLCASLHAVVMQLNRGAHPGQGRHGGAGHPHSQVSGPVLLALLQRSHGDLSRGKKRFSQSFPERWPAGVLAVWSGQTKPCMVCQCIGARGMSDQTSELVQGRAGENLSKEAWSPKVPDVLAHGSRVRAVSPGVKTPCGHRGMTRSKVVMARFRGTNWDSKLTLTFIRNPSGVVVPGSQREEHRAIGQKETLTRTR

SEQ ID NO: 1012551 - protein, 146 aa, Homo sapiens
MFEKEALSEQTRSSAKIEAKRQTSNICRALGMGRMGELDGVALVKKLDREQCSKESQFTNGKLAFKKAIKVTVATKKPTGGQIIHIEFVRKKRLVSCRNLRAKANHINSEKATAKDHRHLSWFTLLNVDWKSFSKLYTWIGTKTIG

SEQ ID NO: 1012552 - protein, 185 aa, Homo sapiens
KCWYWSGDFRIKNRTEAECEAGTQSEKERLDIERRKKSGGTCTQLRERETVSYTETLLKCTRQGSPGRAWEQKLKEIDDGVAGCEWVAGAVDLELSIMEVKDNLKKAEAGPVTLGTSRGHHSYLDECEPRVPRIAVTPASDPELYPSQLWLDSSTRRTGLSRSVVTGEKVDCTPAKPRQWSEERS

SEQ ID NO: 1012553 - protein, 175 aa, Homo sapiens
MPGAGENNELMDRLPVVCLCEKAYLLARERFAGPPVGFSLDVLTATPPGLPTLRCRRSLNMTFSSRLDSRKNILKVAFLNLAASPGMAGASTIVPYHRTGEKPPLLGSVTEVISVDTVVAGTYATCGRKQSGPDSPDVLEKRLDGMDRAETYHILQAPGTINSKLLELEPSIGKV

SEQ ID NO: 1012554 - protein, 95 aa, Homo sapiens
MGNEREWDATLNETQHFTSCMKTPIILSKPPAERSKQPPPPTAPAAPACSSPSVRSPSVLMKPLEDGEGACGRDMVPLPLRAPPTLTPEDPLKPS

SEQ ID NO: 1012555 - protein, 310 aa, Homo sapiens
LDLPGVDWVGGGSSQVDQVVRLAPWERSPGPSRGGPGGWPALPPVDRVGAGSAGRSPEARPGLHTCFFASKPRRGVQEKALQPRGKNSQSRQEQERGRGGSSAYARKGVMGISEGQERKREHLGKRRAGVGLTGADSHPWALLRSQGHLPALTLEAPPTPKLPAHDVQLGGLGMDVSHLSCTDQRKPRLKGPRSFLRSPHGRGLFLWGSVGPRSLLEHAQGLAVPGRPGQLISPGAMALFFASRGIHWDPCNFSGTLFESEGLLLGLRRLMEAALWALGTFCVPGTGSFQDGGVLLFRGFRAPPFQKGHI

SEQ ID NO: 1012556 - protein, 124 aa, Homo sapiens
MCKWARTSAQSKTAGNPGVQQGTPATTMTKTSGNVPSDSQPPQTKGETGHSRERETGGRRSGAQGAARASAARRRDPDTRQQPEKPRRDPEPSTQSPGARVRRRENGGGRASHGERRRRGRAEG

SEQ ID NO: 1012557 - protein, 236 aa, Homo sapiens
MSKAAEPQSVDDRRRGLSAFERRYAHYWESTAEHARRTSTRSLSDTTSTSSNRDDHPKQQAQTKTTDQRVGSRTRQTRGDQPSDNRSERKIGVTRKEQVSGSDSTDSKPEATNRSNREQTKPETQAQVTRGPHPEADGRSPQLNLSDGQRVNRTETRTGQVTKSRQGAPETRQAACENGDNSQSHEANAPKDSYSERRGSNHASAAENGTCTGTNGSTRHEQPRGRPEGGREREYT

SEQ ID NO: 1012558 - protein, 223 aa, Homo sapiens
RTCEWSRLQWKEPPTPPDHVAEELVLERCDLELETNGRDHHTGDLCLGELLVCADVGQPFWLTLHFELAATTEASVDSLTFRCRDLAQPLSQEAGTKARFPQEMLWSEGDWTATVVDQQDCTHLACMLTTPGNCPHRPVSHSAWRASNWLPGIQLRCWAHFILLFQTPWCPADAGSTLDSGRRSGRSMSSPRKGFIYQGSAKFIKNIPWNFGQYDRWDPRRSG

SEQ ID NO: 1012559 - protein, 270 aa, Homo sapiens
ARRNGHACAEPQCRVSRGGWGCSGASSLGQSPAQQLRVTCAAQCGPSHLAAALRVPHVSWLSSSACLLGGESWKEERQIWWSGMDVSRGTPLASSAPFRCPELGCHLLLFLVIPWTPSKGTKGNMLWVQLPQEWTVRPFPTWGQVSLPGNSRFLGHQPACPVLMQGCGHELTLGKSHSQQWTFVRVQGKELASQTRPALQEGTFVIPGTVPHQWAGGLSGIFVNRVLGFGRRQQLRGLRLVPMGSPKWTGLLKQMGKAVIEKFTLKGQFK

SEQ ID NO: 1012560 - protein, 224 aa, Homo sapiens
MCRRTRVSAQLRTRPDSQVQGRFSVLSAILGASCGLRGWHPKPMMPMCLNIACTFKGRRLGLQRNVWHSAWTLQDSQIIRGEIITPISLRAPSRRESYQLGELYTSAPLKALKQQSPGARYILVKTVLKEFKGDTAVERTLGAPKRKQRIVASEKGRDSEMGHKFFPQLQNALQYGDVSDWHECAGKPAPFHIDKFYADNFRDKPSPLSRTRLFKGNIGSEHQR

SEQ ID NO: 1012561 - protein, 333 aa, Homo sapiens
WFLTGAHLWAEPGARGGRVWNCPGIDGISLAVVCCCIYPEYIQLAVHPARNGPCARCVLPDTSVPNAVTRWWFLCALVWLQVCPPRGGWTSVCPQVERPLAAWQLPGRPPPLPVLRKPCLARFARGDKNESKFPNRGSRNFPRRRLPPAPVSGENPRALRVSNAEIQMCGSGMRNGMVAAGWSKGRPLGVTQPGPGVETARRKGGHRTFLNNNAKLPRPRGPVRKKYSKGWARDAPGSEVRQRIKTGAKRRQAYGKKGMPEEELGRVERRYRARAGGQYRRKRMQSEQGDTEGPYGGRDTGSHEKEADGENAPQSTRNTRGPSTEPSAQRRTK

SEQ ID NO: 1012562 - protein, 300 aa, Homo sapiens
AAPGALFASLGSCSYLVQRLDPQDSCVQHGLASGSRGPRGGTRAAGGTAAHLLLVSRSDAHDQPGDKLAVIERRVYDISRWAHAAPRGQPPHRPPGAEGRHGIAFRAFHQDLNFVAQVPTGPCRLESWLRKNPGQDGARECAGLVEGLTEPLHQAQAEDIEGCLMPVRTFYAFLTGATILAMGGAGLAPYLGSWVLGWVPSALGGFIPGHRLRAPVPWLSAGMTWASGSIFKKSLVESDGGARRVRVDWGGSLEEVALRPDASRDGKVPGKFTEANQAEGPKESYQAKGTQDDKDGRPAF

SEQ ID NO: 1012563 - protein, 80 aa, Homo sapiens
APVTAPGHGALGPLWLLLLGVLLLAAPIDAQCGVCACLYPRWWMVMRGNVCHSGLHPYGNPRPLYAGMVPYLTARELAPA

SEQ ID NO: 1012564 - protein, 67 aa, Homo sapiens
EHQLLRLPGKRMILNKALRAGGPRSDHHDEPCGGEGMWDPPLAPCSFIEMDRGCKTKVEKSDSEKGK

SEQ ID NO: 1012565 - protein, 265 aa, Homo sapiens
KVSPVTNSDAEAVTLEDYLRRSKQKSLMTKYNISIHIAQYSSKESTSYREATQQISLSTRKMEVLEEKCSSLTQYFGWTGVSKYHGYQTSCENDHPGTIKINLSPLEAARHPDEYKIAALVYYSCIFIIGLIVKHHCIMGFQLYHQEENQGNHLYDECGMELDLHIYNDFTLSEVYHYAEDEWAYGEYLLADSWSSHSVVPKQWFMASGLVLVLTDTWPLYSRSTPIELKNTCKAVLACVGVWDNDPDHDTPLLLVYKDPDKDSS

SEQ ID NO: 1012566 - protein, 208 aa, Homo sapiens
AGLLGGAGEDSVRRTASDGRAEGDRPGRLLAIGLHELVTELPAAALMDEAGASRPLLRGLQGNEDAILGRPTTCDRWYSLYHEKSVERACTSGMPYQDSQVCEIGQVQRRVVRSAMDEEGYREDRGCFAPRKAWGLMLATLAGQVAIVGFTGVHRYKRACRHRFVNACVPRWRLRSMPDSNFSGEIPLQEVIHNSRRIDHGGLNPGVA

SEQ ID NO: 1012567 - protein, 135 aa, Homo sapiens
GRLRRRLSADSELARSPCLESGIMDVLAEANGTFALNLLRTLGKDNSKNVFCSAMSMSCVPVPLCLAWRAQWDNMRPAQDGPDSFLSIKVAVVETSTQRRSSLFIDPKDEHRLGHAGLALRIAPTGLPVAGRTSL

SEQ ID NO: 1012568 - protein, 267 aa, Homo sapiens
LESERVPLCMKEAIALPEPVRSSEVRKTYRPCERASCLLLLLLPLVHRLCEHSYNLVSLDDEDFRVRLHTSPIPQPDWSEAFQCVSAVEVEIHAGGSLDLEPFLKRCDADADPSCSMLTTGQCALLRAVAHSGSRTGSCSCYLVRRPAVVLAYSLAQGTDVLEDLKITGYHASGASGKATGVALSSLRLRNCVVGDRAYLAAELAAVAQARPQGTEPLPKHTRLPFPANRFAAFPGLTSLDLSGQSWTWANGGLMAGLWSQQGSRAS

SEQ ID NO: 1012569 - protein, 247 aa, Homo sapiens
MRRRLIPGASGGDDAAIRWPVADPECCLSRPRCARAPRTGPLAVRPCHESGEPVAGRPAPSRLLFANFNHGQHVPICWIRKSGYKFFSLSSVDKLEQIYECTDTEDVCIVERLFSSSLVAIVSLKAPRQAKGLPLLRRELRSANYSYSNTILAVKLNQAEADYVCLEEIPVHPQHYGDMKVAALRSGRRLETLAVPCVALVNSTRKTCYLALPQGKRRPIGRGAGLQKPINLKKLETMIPRVTESSI

SEQ ID NO: 1012570 - protein, 208 aa, Homo sapiens
SSAGSTRRRVSMDRNLVADGAEPGPRSDVSPPQAPPPRSPTTPSDSRRPCTCRRQAERSLPRECWVTGSRLLPYCVSYSCRLSVLLSLVPGLDAVSTGWNAVCAVLRRQDAVTKSPSSKMRVQTVAVSYRLAYLSEDIDRHRLKWAENHARCRGLYQNGVQPGLSYNCWVDEKGQRGNRYSPAVSMFLTCNCVEYRNKYIQTLGVQMS

SEQ ID NO: 1012571 - protein, 121 aa, Homo sapiens
MGTKVGYPLPLEELKEFFANGRAGSVRLIKVVIEDRAARAGCLAGASNAAGIRTMTVAVLATCWTAQQPCYLIYLPRLTELLSGFDGSYLDMVALITYPLLRLERLLYRRDTAECHQVNIT

SEQ ID NO: 1012572 - protein, 119 aa, Homo sapiens
MQESYRVINGLRAVNKRARGPVGNPQDLESSRLLSLEEISGGYRKNVLQQENARKPKKGTKTKLIVVQTKAKSQIRWTVDRREKQTLPSLNLSATHFPPRVVVFRIPVKGPLFSLAIIH

SEQ ID NO: 1012573 - protein, 91 aa, Homo sapiens
MASAGGPPPGGQRDPLLWGDVGGPDSLIVRVGCHLRGLCALDALVARMGLPLSEPRGHPVLRKFAGGFMGWMAPPPRAGFPDIPTFAIGPS

SEQ ID NO: 1012574 - protein, 101 aa, Homo sapiens
DLAGSAFTSERPSPWTSQAARLRQSSRVHAPRRQYVYLRAPESTDLAGSAFTSELPSPRTSQAVYLHGNWIEALTFKSWLLLLPSRQRAHPLPSQTPEAPT

SEQ ID NO: 1012575 - protein, 295 aa, Homo sapiens
RRSPAARRPCPFLPDQQLEALTPGKSSEWPGSGSRQVVITNFYPGHGRANCGQETAYWKNMLFGSFYLLEFYPGLSLANSRGSVGCFTREDLRSPGTPVRTCSLMHRGRGSDLSCVLVLPTRLVYQFSGNHLADMGKSRARLDRLPLLPQHVRRASTSSPCIELPTVSWRIVHPVKSRQAPVGPVYARPGPVPSCGWWWRVVHGPAAGVAHRTVLDQCTRWSACRLYREKASQHALVSLAVAFTFAVHQPTVSCYLLIIRSLRQGPACWEKRLKTKEVRMIAIVLGIYRGHASVP

SEQ ID NO: 1012576 - protein, 34 aa, Homo sapiens
AVLTLPFDVVKTQRQVALGAMEAVRVNPLHVDST

SEQ ID NO: 1012577 - protein, 224 aa, Homo sapiens
VVASTALQDPRADSRRPEFVLEWQLFFCQLIARFVHYINIYKTVVVVSTLGSQPETKPSLWDRLTWMNDRDCLALSSCYRLAHMTCEAEMVALYVEVELSTEERRRSIPVLNGGHELAVPGDETDFIRRSGVVDEERDGKVGWRSPNLVTHTLGRLSMYIIAASDCASAPKSIIWVGESCQYAEARMARGISVEGYPAKYPVRLMESLKRSLHWERLCLGWRAS

SEQ ID NO: 1012578 - protein, 260 aa, Homo sapiens
CQTQVQPSSQNIFCILKASRWVHPSMLMDRKTKTSEESQRSSCQDRKESPEALQRVLKSRDCAVWGQALALCFRTGNPGVQTSVRCSPESCLEHNGCSALLPEPHHLQRGSSSQFMDRKTKTRGGGLSSCSEETFNSFTCLDLAPSQETATKVMKIASTHHPSSVTPPINPSLRSHPLSSRRLSPEKRQAPGSSSIVGSCLPWSICNVLKSFSLLLIQEIQDRVSPHPCSRKPPFSGLGFHSLSLTSGLTRKAPSLANAL

SEQ ID NO: 1012579 - protein, 370 aa, Homo sapiens
STPVLALLGLGSGSLPRVPGLGGLSWRPAGAQQPEVSGPSGATLAGPAVLVWLRVLWLPGRCLSSPPQWSPSADYSMYFPGLCLLPALRGMLAVGSCGLVPVALPLAQANLYFGGMTCRVFLAGVLALPGCAGLREVRGTWGCGARAPLSAPGETPCGTTLGQTEPMGRHLGHTVKAPATARELPEEWAEQAAGRRKGNYGKAPPKVGKEAESWAALARHITRTPDVALPGHPPLSDNPQRRPPEAPGITPPRGGAKGRTPTGASRARPNGARRHNPLGPTKDNPRKVHRPPRKDLRTRNALSNATNAKAGHDEFENKLWPRGNPFNKRGRQPRVSATRCALCTPLAERLWRFTVRATHLKRTPLYFDPR

SEQ ID NO: 1012580 - protein, 78 aa, Homo sapiens
LAVVPHSPMERPPGSRGAPSSCPAPSLGSLGRLLPPGSRPRPRVGPLHLESNLSLNELLSNDELSVGDQTVNTLLRKR

SEQ ID NO: 1012581 - protein, 401 aa, Homo sapiens
GVPDNSPKTNPLCSSPSVPSLGKDGPMVPRKGLDPSCALGPSALFRQKPLQASLSGSPAPSFRAFAPRSIVPRATIPRVRGTEPDRGKVAQYLEHMGLAENRSRVHNISDVNTGGPGGGTEEIMLPISNIDHQRITSAGIDVVRRHAAGGAVKKLMNVSDGAIRAVCVGAERVKGRLHGIRLVIGLFHEMAKASEGPLRTLLYASVPSLPTRISPCKGIRRLDRTLARSSRLPRGALRCPFHPRPLGGDNPGRTGALTCARSFDVGQAARQGPAPGGPPPRGGAPTPGGRAFVLTVVLKGAGSISSGVSRPAPWWGSTLVGALLGAERYRRGEDTGDDLPPAQSLGVTCFRDSCGGWGAPLACPRCWLQSELLCTGVQTSGVLGNGGGLEQWRLVGPLGNY

SEQ ID NO: 1012582 - protein, 157 aa, Homo sapiens
GVRWLLARAPAPVVSSTPREYDIFCSHRVGTACFLKSPGCVLAAMSRATLLRCTELSIQVVTSRKDQWDEYAEAIDKDEADYEVNAGDPSRPCSNTSDYCQSDYERGRPKKSYSVARPLVNKSVSQSTQRAEAILSESMDTTMNDKLPTMKIRGSHP

SEQ ID NO: 1012583 - protein, 288 aa, Homo sapiens
RGLPYTGQRSGLRSLAARLLPLGRCSPSPAPRSTLSWRRHGARASLAGGAAASTTAPCGALPCGWLPAARSRWAPLSAPVARALGACFTRCAAHPAACSLRLVALSEPALALLGLGAPARALSRRAEAALFFSGNALLPGAEPAAHCYLRAPIRPSPAGQLGRPAPPCTWARCCTVTGEPLGRLQLQGAAGPRPFSRQADGRKVLRSSIREFYAAKPCSTWKSQTTARRLGHVRIPTVRAPNVFYDWYSQILNNATVVLALELTTFHKGMKSLGDFKVLRIDTNGVSE

SEQ ID NO: 1012584 - protein, 162 aa, Homo sapiens
MWGAPWATGPRLEVHSSIHLACPVARLPCSRPVPSDILRPDSSTEVPVQALICWMAALAGPGLGPEPHFHLLSTSSASAAAGPRAPRVQDPLAQGEAASPGAALSTFSPDATGIGNRIYYGQQVRPVMGMSPAQHLRCMHRQATHISNQLTNPGGWRQVEQG

SEQ ID NO: 1012585 - protein, 36 aa, Homo sapiens
MNVQKILRYNKLCAWGPNALSSGHPKSTFGRRKALL

SEQ ID NO: 1012586 - protein, 70 aa, Homo sapiens
QLDVWMNYWKLLSVLQQAISNPEEDLLEEVMGGRVLTYYVKLLFGVGHELHVTLCHSGNVSWMTNGDLDL

SEQ ID NO: 1012587 - protein, 289 aa, Homo sapiens
LGVWEEESGAGRERTRTGVTAGQVAPGRGEARGLEHHRTGGSGVASAPKEAIGEPGRGDCVDGPLASWAPVCQRYEADSIVLLLLVPVLAGSPPTVTDNKYPQPLPGAPRAFQARRATMAAMGLAGPRWPRRPRRTRPGLRERKARAGGRDCRELEGTPGREGEAGPAGPIGPAGECSVPPGSDFSAKALLRAGCLRRLTRPLPFGPGCLVNEQGTITDAGHRPSSPARCLGSTTFAVHATVYRGQAAVGSGEEWRIHWLLRSRYSGRVAQGKPTSSGAALWRLEPEGP

SEQ ID NO: 1012588 - protein, 353 aa, Homo sapiens
GQRSETLSSLRAGPSEPTAREGGRRGPWLARSAKLDPATRKGGGGRSLEPDPAQTGPLAGQSLLGYVESAADRGLDYGVRESHVRLVALESLALSAAPVPESTSGSKPPGPSWRLAPSPDTHPPGPVKEPQEKRRRGWVSGLSSTYGSSSLTYSPVLAWVGPRSAEGPWTPTAVPIPPDVGALEPFSELEARHLHLLRTEDTLVHLGSESMRPQRCCICCPGFACPRRVLERFTHKHLHRSALQSWLYHLDQTGGSTVRRNWVHDRVEAQAKGNYHGTGQMGDHEARRSSCLGSCVKWDPSPALLHFGGPRLARCIGTWAVAINATVLVRNDSTSCLSCGTIPVLVQIVGNGF

SEQ ID NO: 1012589 - protein, 135 aa, Homo sapiens
MESDGRPGRCWPRWGSMRLELIRILFVPLHLAQPEKPSEALVGRLEEHRSCEHLERTGVSRTHAVTSFSYWRRLTQLNGQYARLMREMIGNSYFTPIILGEIIESSASACSCSLLGVFHGTRDLNHYAGRSWQDG

SEQ ID NO: 1012590 - protein, 149 aa, Homo sapiens
GRAGSCGGSAVKSCALSVPCAGTRHLRAGRVLERGPHGASPGPPGRGGCDALKAGRYKGSWVLRRWRGALHRAAEATGVSCSRVPHCPLPSRSREGSTWGTPRPEGRGLEWQGEGMLEWAEASPAAARPALLWRLALALRRSPCVASAP

SEQ ID NO: 1012591 - protein, 294 aa, Homo sapiens
ADSKEGVLPLTAAFHCPNFIRLHSQRPHGGSAGPTRETCAAAISGGEGFLENRGREGCCICVKPQEAPKELVIPFDPEWSSQAGTSPALLVPSHMILGPCAGWGGVSRHVKELIAESKKSLEEREKLRVSDPTLAIPMIQTQDAPPAGKGQTAKPWSEYSVQQRELTYEASPRGVPMVLDQCCGGMGWKPGEGIGRTFNQVVKPRVNSTEAQGVGLGANLTEDQALSPNGPVPPCQDQMRQHGERIRKDQALGLGAWEEPDGGFFLALTEGLYGKGWQVPLIPDDDRAMGSGLA

SEQ ID NO: 1012592 - protein, 170 aa, Homo sapiens
MASVPCIRVPKCIRGAAACRKLVATHGLSVYLARVDQMRGVCVLEAVDLAVLQNMRDSKHLSPEGWSYRGPQSDIDLSAHLVGPLIPSGARDCGNRLDPGSKWRTNRCNSPKQGSTVNSTMRENSRILREQRKRLTPNAHTIEMRPDNPVDTTRIHGDVQTQYPIGPGTL

SEQ ID NO: 1012593 - protein, 243 aa, Homo sapiens
TWRRPEPEPRWGPSDPPAMGDEDDDESCAVELRITEANLTGHEEKCELCENFELLKVLGTGSLRATVFLVLELPWLGTTLGKLYAMKVLRNAALVQRAKTQEHTAHLSCSVCWSWCCQCALPGHAALRFPDVMPSLHLILDVIVSCGWWRLFTADFYQAPVLQGRAEGALVYGGEIVAGPGTPCTSSASFTETLKLERCAAGTPRGPQFVLNGTSGPDAIEVSLRDVKYKDAGNFVTLLWHQV

SEQ ID NO: 1012594 - protein, 207 aa, Homo sapiens
MSGQVRVTVQGYHVNASVLQGRVIDARVPTQGISPCVISTLVSYDRVLQRMTPRDEPSKFAPTEQTRTKNSQYDIACCSTDGEEYALTRASTEPRVISAERYQRQFANVRMKDLEAPDMALVHGGDVEGRIVRTIRGEEAGQGTFHKRVTGGYPCARCGGLSGIPSEAYKAPPGPKDFEGQGYGPLGEGGTSRGYWIEGGPYSVPSR

SEQ ID NO: 1012595 - protein, 75 aa, Homo sapiens
RVSLGRGCCRVCALRTEGGCPWAWTAVSRLWREAGTGAGCALVRGTWEAAGTWTGSLMSAQPDCVPEMVRAPLRA

SEQ ID NO: 1012596 - protein, 127 aa, Homo sapiens
SYSQSCGPTAAVPELKLREQDVECASALPSSSLSQASSCSRSPQEVLLHSEQSVRADNQMSPNVTHGVPHSGPTEHGRSMGMRKDKPQWMKFNEAWSFHVPQFMVCAPHGMKRGGLIQGSRGPQALS

SEQ ID NO: 1012597 - protein, 107 aa, Homo sapiens
MFAAAPAPCAVTVLVCFLLLLLVSDELLACRCGDCSCGPVGLVLRSAGGCPCAVAAGVMVWLFSLHCMVAMMVLGCPAGEPLLDVIFVAYLLGTNTKCAKAYFRFVT

SEQ ID NO: 1012598 - protein, 216 aa, Homo sapiens
MVQVSEEVGGGEPGEEAASRWDMSDRGSLSDVLEVSRTRVRLSHSHTTGSVCHNKLTMVPPNIAELKTLDGASICELINRKRGKLVLTTTQCKPFSKRHERRSEIPLAVIEACSIFWRTTGFGSLPALEVRDLTYNNLSENSLPGNFFYLTTLRALYLSDKIFEILPPDIGKLTKLQILSLRDNDLISLPYGNSGELTQLKELHIQGNPLTVLPQN

SEQ ID NO: 1012599 - protein, 300 aa, Homo sapiens
WRRVGGRMESGDEAASRGTCVHLRSATLRDAVPATLHLLPCDVLSVDWALPLVWALLHCPAILPVAPDVDSERVCFGGLLSTVCEMDVLAGCLTVASLGYCDVCQKRSVSDVVKPRTPMLGFLVTRLTQRGVSRLELLTIDTAIHMCSQLPNFQSSAFQPLMRRSRRPQFLLSTSKLPKIVSCRVAITTMGPKPMSCKAEYQTAPMCCPMEEKLDVKCSRSMAVCKNNFFHEYDPRRKFRLFTELTVIVLQRTLSAIHYMAATPVSIHPVRTTRKFNTGEVLLIRRRATRGFKRSGRADR

SEQ ID NO: 1012600 - protein, 241 aa, Homo sapiens
MAPWGKRAGWLCGGVLLDISGVLYDSVRGRRHGHRRARCEAGGQTEQRSRLKSEVLHQLSLQKSRAELVVAASGGWDFDISEQEVTSPVEPACLPDPEGARPATIPASSMTGVRSEFDQDEHIQPKLCGNLQDAGESLTYQNMNNCLPGAHGARKKAVHQYHWEKGVTTRRALDLMLDEGPQMKALDMPVGIQRRRMEGGSLTPGGYDKDKPMKPNRQWKPSKCDNGNADDIDGYIEEDTT

SEQ ID NO: 1012601 - protein, 202 aa, Homo sapiens
MPAWESTRGSWARCEYLDEPIRERMRIDIANSRIIPTVSFRSKVGYKVSFMVLPPLGELKLMSLRVQQPIRCEPWEGGQVTPTFLSLSRTGASIGISNLWGPPAPSGSRPPPPSPPPDPWGLWWSEPLEGWGATGRDGLTAAGSRREGWLVHEALTIRFPIRTQGQGTTFDHSEATPQHTLRVIKVNDRGLHRFAQVERPSV

SEQ ID NO: 1012602 - protein, 187 aa, Homo sapiens
MGLSSIPVHWDLASGGGDSKVHQPRWASDYLLHFAGSCCLTSTVSVSPWPMCTDAGGPSVPWMECDAFQWMSSLCLPWTPYGIASIYEVHSVPCAVALASVAMGMIHISSASRDQPGHSCWDRTRCSCGTCSPWSVFFSISHLLEPMLLNVENNTIRPPGRLIGPDSHGHSWPHGEPCAWPSDSKPS

SEQ ID NO: 1012603 - protein, 287 aa, Homo sapiens
GALKSQVQAGKEDPVRGTGSVSWMPPEVYPLEKTEQVWISEAGSMYPEINDVCSPGSVLSLLADGLPRDDLQYSVWESQNEQLQFYSEPVCNVLACWVSCLGLGTWVTFGGQITDEMAEQLMTLAYDNGINLFDTAEVYAAGKADSVYCGQHHFTTERMDARSSLVITTKIFWARKGWRLETGPVQERTYIEGLKASLERLQLEYVDVEKPTVRSHNTADATETVRSHDPKFINRREAMYMQGNINASEATKEEPWEALTPEGPGNHNPEPAPICHQSKKTTHMTQR

SEQ ID NO: 1012604 - protein, 202 aa, Homo sapiens
MGIGVSLLLAVFSNTWGLPECGPKQALQPRKYPQEHPQDVSWKKPHPQLCSLQGRVWPLLCSQSTPQHVSARCVPIPRGEREMAYSHILGVFPCAQFLTLGHAGPNVYPEKRAVAALGDIEHVSVSGSAVEPCPQEVGPIMGSRKLVFPITVRFSVKVGLLCSDSPCARTPVLVLWSNETLEYNVWQQPWVTAIGGMDLVAR

SEQ ID NO: 1012605 - protein, 262 aa, Homo sapiens
AGAGGRNGGAGWVSPAPGRLHPHRAPGQLALYCHVCTSAYAKKDTREVVAIKCVAKKMSEQGIVWMNLLTEIEILKVHSTSPHCAAERLSCGDSDNIYLIIVSFCSSGCDPVSLHPYPASDSCLDDSVGCSVFMQAITLCCPAIPAIERNISHLDLNAKNILLSSLEKAPPKTGRLWISNNNMSPVGHEKHCAPMEFPPLHWPPEDGVPAGSMTARCGPLCQWRDHPVLNATHQGQSPPYLTVHKGYDTIRETSHKQETTTR

SEQ ID NO: 1012606 - protein, 190 aa, Homo sapiens
PLYTLGVNYPDENVDSSCSPVYIAIFYTAAILGPRLTVLALIVEGCPCVENIYHERHCVHRRRPVRRDSSERAPLLVFGRLWMGSCYPGALCVRLRISYTGTFPIHVWCTSTVMLASVSTATSARSIESGWRTDDADCNGSKQPSEVKRLTPSLKGSYGEQSHHEDLDLYSYSLVSVLISRLTNSYIHAC

SEQ ID NO: 1012607 - protein, 328 aa, Homo sapiens
LALPTLCSCAWQSQRSRMRLVRSSGPGQLARGLAVEGGSRVSDPHAPDAGLGGVPPAPGLLTVTYHTHSLSKLSSGAVERINDPWNGSGGLPFIQGGGLCMCVHRQVAVNQQAGALLESRSDVGKVDLDISAALYETGPYSDIRHELQDQICWGLVQQHANPTLRSDLEAAIKMGQAPRATKPQAQEATNYTVTPESLMQLGGTAGKLGNPMAFLSFGESITGDNRPVQDGLGASGNTPGQTEEGWSNANYTQSRWAPKCNKTYRKRQTGKGNERNGRQGKTRVMQCIEKTIGYRRTAGTYMDHGAWGNAPGSVGPLCSGKELALGLT

SEQ ID NO: 1012608 - protein, 187 aa, Homo sapiens
MPPTFPLKRQTGPYKLGRENGGQDDLFLSRPKTTTLQLERLCNMVGRRRQETHHVKRNWDHEVYYGPTRWKTYPSGLPRKQLRNPSGDTWRTFRRWHPYTREPELIFHHQQAFLIHPRAKGPIIFLHTINIDRGAEKVGRPRLPYTTLNANTAWRRHYPYARAVDVALGLCQTAAHGLNVSNSSITP

SEQ ID NO: 1012609 - protein, 220 aa, Homo sapiens
GGLHGRMTQNTVIVNGVAMASRSHPESTHVDVHNATRSQTLTQLLKAGGSLKKLSFLTLEVHVCRIRSSQDWLGGMLCSRGDSSILAGGFVMLVVHCEEVSRVLGPWTVLSAVRLMPSGRGRVDDRRQELGPWSMEGTRDKTVLAIYPDLHRNTGDGLCATAYGLPVVRRAGELSVYIWQKLEPFLYIDDCAVIAIRTLSFPYLLGVTSMDAGRSPTRNR

SEQ ID NO: 1012610 - protein, 285 aa, Homo sapiens
RRRQRRTLAPSGGARACGVRVSRVRAGRDVCAFESRGRNGARPSALAAVSLSIRRHHRLLCPTAYLLPTWMYAQEAVKEGLLTAVGVRRNETIVVLGCRERQSVRSNCRMKEQMRKICALDDNVCMAFCMASPDDARIVIKLVALGWTCHSHLADCRSDPVSTVASTFTRYICQVLNATLYAEQWAQRQFWHLCPHRGYLTLMALLGSIRLTPRCTYHAWKANAKSRGAKSRALSSLDEELYVTKPLNTDDSDPLNAGDQGTPAKLVQSGGQNIELADHEGKQSL

SEQ ID NO: 1012611 - protein, 341 aa, Homo sapiens
MLNALPARPVRISEVRKTYRPCERSVLLCLACLTCCATECDSRLQYTQQLETLDAALWTTGTIFACAVMRDFIPPSETPDVVVAEDTSHGVMLVTSLGWTVIASDRASIIQTLAPLFLKRDWIELTGDVPNTLRRESNAVHQRVISHPTDCCVRSQLLGEAGNTGIHDFKAIWLVTPLSLLHKRYSLISNGTLTARMYLTDLPGDSSAFRHVLLGNAIRVVERLFTGVCCPYSIACSDGGDKRTGSVRLCSDALYAMVRSNGPGPLDGYLDAIWPNSIASTLAFVLSETKGFRAPFPVTRYPIPLEALVLDQIPWIMGPKRRDLGMAGLLLFRKGFPGHST

SEQ ID NO: 1012612 - protein, 67 aa, Homo sapiens
RAIQHCSPQYEDRHGPERACSRDQSTLPDCDHSAYKDSRSFPYSCKVFISPGCVLAMCACLTLSSCG

SEQ ID NO: 1012613 - protein, 30 aa, Homo sapiens
VTGLHCVGDTYPSNDRCCHECRPGNGMVSR

SEQ ID NO: 1012614 - protein, 259 aa, Homo sapiens
LGFAWTAPASRRATCVPQRRSTQAQLVPHLHQYLKKWGLTLPASAIWNGLVCTDGKPVCGVVCLGGHVGRGPACGTSALELTSASSASCPSWARRLVSPIYGSPPRTFRASPLSHDAEALPVPLVSLPALRSSMLGTLLGTSFGLMPWVQAWLGALAVTSLACGCCPGPWMVSRAPRTPLSPSSWTPAMGLCVEPELLQDREAPCVAAVQATSASSSDRGPSRRVSALMPLQPGPEGAEGMHRESGSPVSEVPPGDLLS

SEQ ID NO: 1012615 - protein, 265 aa, Homo sapiens
MFAISNVNEETRCMARERISLVVGERVFPPAFFRNARLRRSRRLRPGPSAGSGSVSARHVQARLPWRPWCPRHALRGRSVPRALPRHWPFPSERIMAKTSEPVRPLSPGLERQRLDGSQGKKLLNLTARRMTLYDTPLPAPRLRGAVKRHCSVNSELWKKQTYRDWAGWQNRRAQSAAGQNTLLLQSYPSQNGRAKTISKGRDKKKAGPYTAPRNRATRPQSGQTLGAIKHASNDIVLTTTAVADGLHIEIVGQTRSQEPNENKH

SEQ ID NO: 1012616 - protein, 38 aa, Homo sapiens
MAAEQTPGCALGAACLRPWPPLRPPRASFSPSEVQRRL

SEQ ID NO: 1012617 - protein, 310 aa, Homo sapiens
SGGGGDSVRALVALENPAGAARRRRRAPRSGGGWCPFPAACRALTSSPGEETSRPSQDGRYMPASSTHGSCGSSEPLCPMAIWWREEPPASWRTSQYLLTLLETDGGPPGLGGLGTWYPLSSTMVIFAEACNNATLCGGLEATFMNPLRWRSTERVLRYAWRMRAGARRGGGALAVGRTGGERTPPIQPRECFQRISRRLASRPQAQSYPHWKLLETWEERLLRFFSVSAQAVYTAMQDNSFERLLLHAVCQYIDLNLVPVLNLEGVSGRLKGQVIGSLDFLSAGLLLAGYLEQHLVMWARRNPVHLASS

SEQ ID NO: 1012618 - protein, 237 aa, Homo sapiens
MREKIFLELVVFVLVRKKRLQSRRPRSSELDCSWALTPVCGIAFRICILFRPPPSARSFQPVHLCKSPSSPSTPLVPSRGKLQEEVGPRGELNAFTDDMEGRAEPWTWACWLMTSRIHHDTRIFDLYAGKGGVERQKPSRPPLTPSPIQPEAKTRRTSGDLHRVELAWDLRIGFGADYHVLAYYEGRSDYYHLSLYQGRTDNNTWCAYLNAWLWQTVVCLFFFLGPRSSTLAPPSGR

SEQ ID NO: 1012619 - protein, 411 aa, Homo sapiens
MPLEGLTCELRFLLCCLIFVTCTSFRHAWRRDVLMAVAHRPFSSNVRRTPYSAQFQGSNLDFFEKSLQLTDGWGTKPRETTGVCVYWACAAKIKLADLTRMIWTFVRSHLQLPFGTNEVVTPKQESFRGKFEWVAYPKCGPIECVTFLQGGKDKPPKRSGGKLPLHGRWCHQLNHVKENFLPRLTGGALSPHREFETPPRQQRQGPEFLMPMVGRASVLTSKGDRIENRVVKHMMTGVFPNKSSLRAIYFKSPPIFGTLQQCCTNVERNVATDKRRIPPPVDNSRQNLIEMNPRHIMDCADLYMGVRTHHNINEDASDTRDEVAHRCLIEEHNHQLYQTEVPFYGYAIGRAKDAPDLSHRFGGSKKNNERRGILTEEQGDPATHGASSYGSRQLDSWDTPVVGEEARQKRK

SEQ ID NO: 1012620 - protein, 213 aa, Homo sapiens
DAAEAATAFGASGGGRPLPRALAAEEIRQMLQGQRRWPTAMRPDSAAGLLRGTMQRLVATEAYPCVRLASVADRTEESPSAVIRVCGPAEAAVKNRLWLTIIVAANMRRKHSIRFVTSESAERRCLSTQMNDAHVVVDYIPPEDSKHSAKKRSRLLSNTWEQPIRLFLNSSEDSVRIPSKNLSRTLTFLTWNVGRSLLIGGQPLENPFLPGQR

SEQ ID NO: 1012621 - protein, 201 aa, Homo sapiens
MTPNLRSLWLPHWPIINYVDGERTGVQPRGLHFRAPGEARPGGVHPACEMAERETKTCLCVHGTIPLRVNCDAGQICIFMSTAYCQNTENPAGPLGAPDEQEVDNQEGTNHTKKDKKYYTHTGTIMKKDKHIHGDKHNCETTITNRHSRKNLAKKNRPKTERKKASLARFKTTTNTCSKHETRDTDQTEHDRKREKSMTRM

SEQ ID NO: 1012622 - protein, 185 aa, Homo sapiens
MWDSLVLHYTNVLASDVLCRRIFLHVVFTLYSTDSLHGSLTSNRHKEECRKFSRYEDRRYVQGVSQCILFLLQMPLLVRYSCTTGILLGGLHGHVSYLSTQLEGKYSYVECLAKEPLWMRCQNSPRSSGTSSTRARTSVIGVERTRQNHGCRQTLVSEPKPRPNCHICRYLDNVSAGYRSKMLQS

SEQ ID NO: 1012623 - protein, 325 aa, Homo sapiens
PLYTLGVTYPDENVKSSCSPVYIAIFYTAAILGPAAGYLIGGALLNIYTEMWPDVTDVYHRDAHCGSAPGGVVLPGLWGRCFLHRRFPSLVTLGSCQVPSATRLMKGGGQMHQIERTAAAGEASQPGLLGKPFRVLCLSPIWLLLEEPPTVHSVLLLVAWGRLRPLVIYRHVQRSGAQMFLAVARFSLSASEAATLLWVPGAAYAEWRRHLPGAASLCEPSSGSAGSACHPSTALFCTVVHPAGASVDLLTALPQWCPWRGRHRQLRREPPARRAPEPQRLPGNRCLQLAPENLQPCDGSEGPMKTQLPTGYQHTRKRMWNGRRH

SEQ ID NO: 1012624 - protein, 219 aa, Homo sapiens
ALREPRTPCCDGSLSQRVPGAAAAESDAETRDYAPPSPRLLASRSPYPRVLLSFPRSPHLPAMATLLLQQCLSRSWATSVSEQGPRANDERLCSARMGSHGGLRHDDGGGLRRIADRRSDFEAACQGLARLVHSLKARVVKLLTWGLRSDMKADTDRRGMIDSNYSCSRAYRDASVMAAPSSDYQGLTVGTVGRANSCGEPLTKAQEITGSADGRLANQ

SEQ ID NO: 1012625 - protein, 318 aa, Homo sapiens
TRPRACSPSRLGAAYTGTSPACSPRIRQKTRPRRGRRPAVVTCELPTAAACSVSHARTAKGEQRPERSASFQGPLPGWRTRGKAASRTDARLRALRVERATPEGMAARVPERLCAGALLAARCAPLATHARWPGSARLPALQLHGVPLHLQRGVLCQWARLASAVLPDFLPPSALSTSRRSSRPDPAPSGPSPRRFSGTTSFRCPGRHDAAAVRKPLQTALHLHPGPGTFSLIIATLAAPMRLYLRPGGLAHQHALLAQEFASGLPCCGVRNWLLGLAPFPAIPSHTACRLAPNRGSSGRCRLTTGEHAASRRVPDTR

SEQ ID NO: 1012626 - protein, 136 aa, Homo sapiens
MYINTFQKGARDYQYIRYLSSDILIGMMYLLKLVHVLATHTCNHVIDDCLLVTVSLSLCHSRCVPISLCIQALKLTSYNLEASRFYVLDKSFLGERGTPWSWCLTVCECNSSSTLTRSVLTRRVPPRGQPCQRGHP

SEQ ID NO: 1012627 - protein, 187 aa, Homo sapiens
AGGTSARVLAAPRRAASAPQPGSRPPLHAPGLSPALTIHKASKQRSREIDQSMTRDREHRVRETIERRTRKTTQKPRAPSTGNTKSRTDGRQQKAKSTSADKSKEEHTRNERRKRKKKRNKETTEEDKTHRDEATHAQKRHHSTAASDENKHSNKTRSTSRPTAQEEHTTTEEAPHGHRGTDGDRDH

SEQ ID NO: 1012628 - protein, 188 aa, Homo sapiens
MRVERVRTLSPARNLLTSRIPRAADISVSQVRHPESIGLYRRSSVSQAGTPAKSNLPGKATISHIRYNPLQDEWVLVFSSPDEAGLAGSSGAPCFVKTVPRTVTLSTPLCPGAIRAKRRGDIATGTSSTLPCLSKRRSQYSMAAWVPPDPWTQLIIPFSKQSLLEELCKVMCFHPVVGCNAATRCLVP

SEQ ID NO: 1012629 - protein, 391 aa, Homo sapiens
MRTCMAPLVDPVPRARGELPEVGGIVPRRAESSRHAAFEATVSRRTALPEGGRMNAQAIAYARASSGDLPRSMALELPPAVCLVPWVTWDLLGRTRLWLPLRTHSGRRPGYLQQAGLGPGDQFRLARLDGSPPDGSPNHGRPGEGRKGSPLSLGPRKGPRTPGHGGEPWERTPEGTTKRHGPQGAHIQRALEHLTAPSCEQRRKDTSSPNTEDNHSKPRNTSRHSRLGTLPNTAGKTTHAITLTTPQQLRGRRHERYKAEAKYHRLRSPNKKRTNSTQIREAPTYAKKPHNDDKITKRRRDPPITLTHGEITPERASTIARANERAHLSPWLTTRTHALQPSDTLKLETDNNLLATDIAPSDRDTEPPTDHTGHTARHATGRVRDLPRNKR

SEQ ID NO: 1012630 - protein, 121 aa, Homo sapiens
GASRVLSAASGDSNRRSSWKEPWTTVSVASIAIKPDGVQRPVLWDEHYQALIAREEKDSAVVGSATFMSSVSDRYSPRRLLSLSCKDQLLFFAGRGVKSTCTLAVRDSWTSGSVEGTECVR

SEQ ID NO: 1012631 - protein, 438 aa, Homo sapiens
MSVPGAVTSSGDLTAYDVVLELNESEQRIRHPEETRYQVTNRLLARERRVGMDLEDTRCIGAAGRALGDSKREHMVTRQRIRSVIEGHYTDHTGPQQLAEATSFSYYVDEQSQTIPNPNELTTATAGPRERYTGPNEGPPRETPTPTAESTHSVKRRAKNDNQEAHKERYTTPKNNKAKHQEEHPEQDNTEHRNTTNDPRKTTRQKRTRYPTTHKRRTEQRHDTTEVTTKGTAEALKPQNRETRTRTHPDRHTPKTHAKHKTRKHRTPPNKICNTKGKRTQEKGTEKRHTHKYETRPDESNDTTNPTDAQKEPGHHIEQETRQPTNRNRHNTKEMQQPRKEKPLETHHKTTETGQPHKPHDTTPIKPTLQHTVRPKTQRKDTTTHKHEPTTWEHNKKQHQTNKHNHMQRPATTLHYDTDTIHPHTHQNTHENTDNTTQ

SEQ ID NO: 1012632 - protein, 214 aa, Homo sapiens
MALPTSGAHRCPAQAPCFWLDSCPTGTPMMATQEMAQEDRGVTPGHDRKGPVAPVPSPQGDGRVTRCYEEEDTGLALAQGGQLWFHYYGPKPLRQVQEPGTVSRAQCPSGSGEGVQPGGPEQGGAETGVTTSSLSRPAGLHPLPDSKGHRWEHGVDIVPPASWIHIRKDSKVKEAGFTPAHSRGGGSLRAQQLAQSAQECAGAGPAGPGPLTLP

SEQ ID NO: 1012633 - protein, 91 aa, Homo sapiens
RRKLDTGRLVRHETPPPHCVHASLTRVPCLCLVPRRSHMLVSSGYNIFTEDEESVEDSIIEDDDDEAEVEEDEPTDLGTRYQRTKMCLGEP

SEQ ID NO: 1012634 - protein, 179 aa, Homo sapiens
GRRRVGALWPHACPAGFALKMDTGRGSPDTGWCEAGGVSRLGQGGRVCSRSSWSLGAKGQGAKLPATNCKADAGSLRPPGASCGRRCYPVVQTYPMRLTGSMDLRLPRGTIQLGLAIARLRLEHHSCRVTYPNIVLAPSACRPAVSTLVKRGIRMRDYGESEAANEAPTVAHSESAEVR

SEQ ID NO: 1012635 - protein, 107 aa, Homo sapiens
MPPTPRDPPPPYSIRQDGAAPIERRECVYYIYRRERRGARSRTFYNQHARLLAQVRESKKRCAHRWRRRTTNLVSAKQRTHLLICVVGWESERKIEVWERTYPSLEE

SEQ ID NO: 1012636 - protein, 258 aa, Homo sapiens
AGWGGRFFLLRGYEGPSLGKDGPMVPEGPSPTLCSGGLSLFLNLPGPIWLQPISTSPVFSSRLSPIRVILSGDWLTSFNKGLERTIRDNFGGGNTAWEEENLSQIQKDSETRPWVEVLEGVCSKSDFEATALLELSEELVESWWFHKQQEAPDSTSSGFAQDSHEALLPPAVHRSGPIAALSLVLGGTETALTSGLRRRSDQEQRDTEGGSEVTVDQHNAGYRGSEAMVASVALGYYVRQKRNASHLRMFGIVKAPVP

SEQ ID NO: 1012637 - protein, 115 aa, Homo sapiens
MDESWFVTPPACLRLEVLDSVPSAPEHVPLEDLLIEHPSMSFTSPASTIVLEPGSPLPAPGLRPLRCLESEPLDDSAELRRPVLVLLSSAGARCASLLLSQRGLALLEKGVCQVL

SEQ ID NO: 1012638 - protein, 33 aa, Homo sapiens
MGRKRTKKRGGPNDNNKMKAAAQRNKRHQPLHQ

SEQ ID NO: 1012639 - protein, 124 aa, Homo sapiens
HKPGGGQVEVKSEKLDFKDRVQLRRLVSLGQYHPSSLAEEITKIETHKLTFRENAKAKTDHVGLEIVYKSPVVSGDTSPRHLSNVSSTGSIDMVDSPQLATLADEVSASLAKQGFVIRPLAAVN

SEQ ID NO: 1012640 - protein, 186 aa, Homo sapiens
QTGIGEDPGVRVMAYEAWGPPTGWAVVTADGTDPCGALVDGSDSCGSVTDLLLTTLHMQDLPLGAQSYQDTRDMKFPRSGPAGLAPVAMARFTRSIWHGHTHVSRPCVHSAVTDLAPWTDRPWITPMRSPLPTRMDMESCTIEAWTMDGYGELGLQGIKSGAWSAVISLGLCGCGATGADLMQALI

SEQ ID NO: 1012641 - protein, 182 aa, Homo sapiens
MAGSSASSAVLGRRTSPRWGLMPNSDIDLINLERLEKYRELLTSVPAAEQSEEAAGPALVADLTESISGRMTDPKEKIDIVADSMPKSLRTQQLSGNGIQVHPGVFEANVVQRERGCSCSPTTCQMSLLGCLCVADVWKGPCGPIPQVSVWLSITASTETCSTVPPLCPVVPLHVGYAVGDG

SEQ ID NO: 1012642 - protein, 232 aa, Homo sapiens
RNPSLGCTRVQPVSCRGASPGPVFLVRTPSRAPVVSRVSLRRRLSRPRTPEAGGPMAPALDPQLVLPDPVTRHFMSWSGPRSSRSRARLSARSMEALQVVPGYCCCSSWTGCSPSSRSILQQAGGGAWTFSSFTRRSRISRGRQLPISYIETSDDKAPVTDTNIPSHLEQSVRYTGSRRTMNGNLERQGHVWNICFITRSWKHYSTLGKAECKFLIHTMFLGISTCINVLRI

SEQ ID NO: 1012643 - protein, 81 aa, Homo sapiens
WIAYRRRHVRHIFMPALRSRATIHQTPELLSTDMLALCTCKSCRQLMLACESSCGDYDAEPQRQSCPEPWEPTPCVSVAWM

SEQ ID NO: 1012644 - protein, 312 aa, Homo sapiens
GRKCLGGRTHSGATPRVAVVRAMRGGACRVYSRTGGALRGRRATRTCVVGPETGPEAPVDELVGVVRPGIAKRGRYGRSAAYYALANAVLWSVLNDTDAWIASVRGRCSPTVVYLVLRARCISESLHVRTRLLPCESEVYWTTVGSVPIIDSRQMLMEHQRELPVASLCSYENHGALIEEFGMANEVGSHCSIGLVRHRTARHLSSYTIYWELLLQPHLVPSDVDLRLAIVASILRTLAWRQNYNHLVSGAGTYHEYLPRTKEPGWAWGIAIMHGFTLGAPARPIILDRSQGLVVLSGFVSIVRLRLRPRCP

SEQ ID NO: 1012645 - protein, 240 aa, Homo sapiens
MGRRRSVRPPALPGPACGCTTLCTLLHCTASSAAATCRCCSALRVGEVSRLCLVPACAPCCFRSVVCCRLCAGCCGWPGASSMTGQSLWDVSEANVEDGETRYQCGRLQEEAALAHAAALPRDAPWAACCSCHSREAILELCDDYDDVQREYYFDRNPELFPYVLHFYHTGKLHVMAELCVFSFSQEIEYWGINEVLHLTSCCSYKLTMGRKVEPEQEKWDEQSDQESNQSPSDEDLAFY

SEQ ID NO: 1012646 - protein, 90 aa, Homo sapiens
YVPFPRALGVSRFLRPTMGYEVESGPRGGISEDVERLGHMIHLHTLLCNAYLRRPVNHPVSALRLSCTQIGQSYRIVAAHNKCPRAWPYT

SEQ ID NO: 1012647 - protein, 164 aa, Homo sapiens
MFGLANGVFAYSTTGGPHMVLIRSWAGVLRPNGSSTSLFRIKRGPPREGGSPERFAIGGPPGKCAYEHANLGVRLNAWSMAPLFNAQREGWRPKRATPKKQGICEGENNAPLFPNFKPLPSFYLPSTDDRMQPFQTLDRTDTCGCVSAAHGSDHDVKCKRGGDR

SEQ ID NO: 1012648 - protein, 228 aa, Homo sapiens
ETSLRGLPEARGSNIFREPCGKNKPTSKMKENKENSSPSVTSANLDHTKPCWYWDKKDLAHTPSQLEGLDPATEARYRREGARFIFDVGTRLGLHYDTLATGIIYFHRFYMFHSFKQFPRYVTRSLLASFLAWERVKKPPKTCVRYLFKHESAKLIITMMYNLGQFGQHDPKEDVTGSGRESYCRPSSLILPVEHPYQFLLKYAKQAQRCIKTKFNKLVQHGMDILST

SEQ ID NO: 1012649 - protein, 106 aa, Homo sapiens
MQWDFVTPQDPCTRIILSRTTDYARCAKGTTQTSRHPLFYANKKNKTKNNKQQTQKYIKHNKQIKYNTHQRHNTTHNTTQDTLHHNKNKHNTNTHTHSAPRGPYYP

SEQ ID NO: 1012650 - protein, 344 aa, Homo sapiens
GGEETRETHCRAGISFRQSLTGDGLKARLSGDAAQKYACGCDAGPGLGAPQPWRCRQDGESCVFPLGLPPGSGCLAIRSWFSGADVLLLEPLEAVLRWPGNLRGRVLTLLEPGRLVLLDFPWSGPCPWPVGFHCRRRVPLACCLLTPLRPGRYRGIALGGAWVEHERACAHSSPSRGTHFERHAVNPSAASRDEPNISPIWSGKDVTPHQWSANHPLMEGTDLLLAPWCDLFTSIDALTQDYYQNLTCGITHSILPITQQTTNSSYYPRKPTANSSPSQKHQFTFNQPPYFTPHKLKTTPHYSTLTYSNNSIITTLQLIAIGKYITTYPSTKRAATDNVVLHTK

SEQ ID NO: 1012651 - protein, 264 aa, Homo sapiens
AAARVGPGEPGPRLQTQLNAQADPVRAERLLLRPVPLFSPPDGVLGLDGPLSPPAAPAAALGDLGMACALWRCLGSDCGAADAERRFVPDECPRTVAASGDFVLLPLRGDVPRRPEVRPPAMTSHSTFNCARGKKDMLITGMHHGSCWDVRKRSDVFVNIPPKLAYATLHGVSCCDPPPNSSRFIFDVTFCMGIISCNFLTLIRFSIHTYFKPPDRCPSEPIQGVLDSSVTGTHFNTGHVPWDWYLCSSSESPFAFILIINRYV

SEQ ID NO: 1012652 - protein, 127 aa, Homo sapiens
SGIHPPLPSYSLFWNKWWVRYHCLNGNPAMIGSGIHLTTYGFASCVPGLSVLRVRYATSLQAYARIIHGLPPYLILCNNSHVLSGDTTVACSYTNVCINISELVGHEHHSFSPTIMRSVCYTHLSPS

SEQ ID NO: 1012653 - protein, 121 aa, Homo sapiens
QKEARAFRFLTLSPGVIFSIQPRLASHSASCVRKHLQIFMYPLAGQLGIQILSQSSRSTWVRSYITVEFAPESDWTWSGRSGSMHSPRLGTSGIIMCGAGGFGCLVLIRVLHKVHGTYNDC

SEQ ID NO: 1012654 - protein, 86 aa, Homo sapiens
MGVTNGPLARWRKAKVGTVGLLAKNSKCNTQVQQISTDEATHVPTLREGANLGVRQHNFREIAAGRTDLTRPRTQDETEDDETSER

SEQ ID NO: 1012655 - protein, 129 aa, Homo sapiens
GLQAHLCPAFTPLMLSQCFLSLSFELGTPVPDPDARGRHPMTGGPVEQKTWPYQPVPGLRGGQPSEATATPATPCAHPDFSHMTLLFRSPLGASVSWWCECEASYRRLMTRSRRELLTRTCESWPSRAL

SEQ ID NO: 1012656 - protein, 289 aa, Homo sapiens
PEALRAGPPRLAAPCSPEPHSKSAMVPRGPVSPREAPVGRRRAPLAWSLRWSPCASSPRWCCWPWLGAPGGAWPGAQLQGDVGCAGPLGGPPTSRDPGTHLAPRHDASYTHDSMPWLRVGPASSRHRTGILVLPRGTLLRPSGETADGAARLASRSGNVRADVVPAIRLSSERGHPEAAQATLRSRLLAAIKPRRDCLGTPALRARAYDRAQREARWPSAVADRPANARQYHDSNEQAEILGIHGDPKRDSSAANERGEPGTRAWTSLEGQYYLHAQHKKALSRTERGT

SEQ ID NO: 1012657 - protein, 113 aa, Homo sapiens
MVAPRRRPAHLGAPHALRDPRRPPPAGREPRVQAARTGLRQAQPAGAAHSRWPASPLGVRGSGAGGGAGPGAAVFGLTQRSAPGRGSALTSDAPREPLEEPGKGGGAARMNGA

SEQ ID NO: 1012658 - protein, 305 aa, Homo sapiens
AGRLGRQLPLARQPVGRTPHSLPPSHDVFIVPTHWLRVGPFQIGGPGVPQLPVHPQSWGCVPPDFSLTEVDFSQGCDGSQYPGAVCVETGVFQSENGPGLHEPSLVSPPGCWEADSKGRIVPMLATLPLFMSHEVNQLMSAHVNGPPLKLTCARHPCQPQIRSPEGSCKKYKILDTSKKASEQLDPKVMSSVGPMITFTIFATSETRGSAWDAVSGSPYPSPFLGPLAQSMVQQRSAFIHGPAGPMSSYLLPHCICVAACPNACLALFRRLCQGSRGIAIANHEECPGMPGSPGPSSLLAFPDIP

SEQ ID NO: 1012659 - protein, 50 aa, Homo sapiens
MRGHSFDSSNDAEVVAPTCYTVEEGAQHVGVPHITEHRTSARFKTRGKSP

SEQ ID NO: 1012660 - protein, 321 aa, Homo sapiens
SSRGHAGKSASGGIGIRVCFCPQETQNPGSSVSEAVVPSPAPVGASTCSASVPSSVYSPMVSHCPTRNPGMMALRKASGARLRTLLWARRLDGETGTRSSFPSIAGCTERFSGEQQAVLYARATIGASLVAVGPCAERCREVWGVDREDRWSRVTEHRIGSKLSLHPRGSVFRGASASKSMLAASLRSIYPSGSRGSVGIRLSVEQMGGNPKGSSMGPKTKGAPDVPCVGVPESIWRRYKAYPLLPPMLGCCLGKLCAFPIRNSIDTGAIARLRKVGAPGNHDPQEETLVRRLRQNGLGALGGASIGRHWTLIVAKGSAQF

SEQ ID NO: 1012661 - protein, 354 aa, Homo sapiens
MEPPDCTWPKCLLRGPAGCCCSQSCWRAHHRCPVLECALCLVPPLVECDARKVCHSGLHPYVGTHDHYMLEWFLTDRSGARPRLDLRLRCRALSSRSQCTDTRGLQYPHTSWTPRGCLGAVLEAQVGDERDYVCVVRCMGGQAHADVPLRGSACMQSQRPLRSPTNEMDTVCEMEDSAQEIATCKQRNGNPAPKDHDGYRKRAAPWRCPERLSPEGYSDQTGKDREDQRGLIDARKPLEHTEDRQSHRQRTGPENGAERSKVAAGPKKARLGPEESTAQQETAHRNRATTDIYQPIKPPKKTSREEGATEKQDEGVGARAEPKPRQRGMGNRKRERRGGTGEGRAKKETEKQQE

SEQ ID NO: 1012662 - protein, 401 aa, Homo sapiens
LDIASRGPASSLSATLLLRHNFTASLLDPADQGRRRGSHRRQPPAQPSPHSGLAKLDRSQGLQAPHHPHHRRHRARRSQSQIPAVPSQLVSSSYRVGLPRAGAISTRLGGRQPVTSPPLTSRSSALPQGPAPLDTHRTTSATTTGRPRATSPGAGSSEPRRTIRARPIHSPHLAPEAPQHRTPRAAHSPTPPPTHAPSRTTRPPQAPIAPPRLDAPYDSHPRTAAPRPPPPLAPPVPPPTAHPHTPPPPPLSPATPAPQTPPPPPYTTPNLTHAELPPPFTHKPAHPALPPRTQNWHPSSRTNNPPGSPTRTSATSLPHGPPHTRPQHHGRTPHRTTQTRIAPQTPPPPATPRRTRPPAPSTTSTSARHHPHPPPKSNTHRGPRQHPSTDPDPPPRHTATR

SEQ ID NO: 1012663 - protein, 127 aa, Homo sapiens
GLGVPGWVARGPKPALGRAADARVMMEGGRSNDTRVWSWAKIPAPRPGPCILVFRSAEQRGRGPFLICSPVVLEVIAPIAVVQVRSWVASVSQRHRAAASAGLNCHRATCAEHVDHRKALPRQVSSR

SEQ ID NO: 1012664 - protein, 229 aa, Homo sapiens
SPLTEPVVVLEGHTKQVGIIGVAPHGPENVLLECRLTTTVVLIWNVGTAEELYPPGACLHPDLILQLISWNHNGSLFAQHCKDTETCGISRAPCRGHPGGRAGEWLNEGARPMRAIIPGSDGKVFTRGFRRMSERQVALWDPENLREPMGLQELDSSNGGLLPFYEPGNQVWYYVCGKGDSSIRVHSEITEGAVPRSTFLKQVHQAEEPQRGMGSMPNCGDLEVRQVTE

SEQ ID NO: 1012665 - protein, 244 aa, Homo sapiens
SAWAPRLLQAARGPECGLGGAGLRAGRRAGGRGRGLAAVHGPGDGCAGVQQPHPGGRNPVIVAHAEAVSWYSCGPSVYESCAPWPCLLDSVRVGYHSKDPNQGLSDAAIVMVDGYYEMYDDEESSNRANEMKYFPPLPVGQLFMRKTFKAGAWRALEGSPTPRWYLRVTENIFRQSNFLSLKRHHVLVGNRLVSNGQRGNGRYFESDSLGGRTQYGNDWIGSGSRGSKSGRCQAAPPDKGVIAQ

SEQ ID NO: 1012666 - protein, 133 aa, Homo sapiens
GSQLKCHLLSEAALTSVYKRLFSDFLSYLCIMSSSHSSLSKISCFFLSFFFFWKGSYPDPGGVGGDLLGPVIPNKSDSPASASQVAGTTGTHQNTQLIGYFSRDGVHHVGQEGLISGPRDLPASASQSSGIQT

SEQ ID NO: 1012667 - protein, 256 aa, Homo sapiens
DPRAGTARAGRRLAVLPAKGSGGAAQKRADRALAKPRDSPSPCGGGAKAVPSLGGPWAAGVTALAGSLLRSSSPVAGLHRRAARWSARVGLLLRRPCSLLLVVATLDAQPCGSRLDGPVMLRKWMCVRAFPRRKYGIPQIERGPRKAPKLPLEFQRMPIEKRFHVWCPRLTLVKQGGVGTGANPAARIDIVPLHAGVTGIPNRLCVPWGLEKRSRWTLIMARTTREAKELSAVRNRFWPKRQRVKQSGYKGQHPSS

SEQ ID NO: 1012668 - protein, 288 aa, Homo sapiens
RTAGTCQELFLTGCDDKSILDVGQWKSYIPYWRNWRRSILQDRVMKSIPTQLLFRLDQHSRKETNLDETSEILSSSGKHKSLAGAARVYYQYPGAQLSTVKPKSQRNHHRLLKRQQLLSWMKASMGELGRPMQAKVAVRADAGKKHLHRASRITRPPWTQRLGGLEQELQDLGIATEPKGHRASLPETDSWEGDAMLIGQSWNPEHVVCTHCKEEIGLQIPYCEPERHGLLPTDIPQITHPTQLHEGTSTHPGIKLQHSNRQQTMEPQKQTYRPNRRTSEKGAQSNQE

SEQ ID NO: 1012669 - protein, 264 aa, Homo sapiens
SPGWSQAQRVGLGAWALRLLLSGGIGPPGECVLQPLCDAPWSGGLGVVREGWLHLDELALTNFSVHDNVGVYVRRSCGQGHACMGASGGRPSSVLSGLPLQWCFKDDRIVFWTWMFSTYFMWRNVAPRLGPEHACSYVTPGSVAYSGYEERCETGTERQLSPEVDGGRCTESGLQEAARPGDDLTRAGSESVCLSLILQKAGLHGDLCVCGTPCWRLGTFTVRKKKSQQVYASPVNTPMDEKGEESQDSYRQHRSSMIDELRGQ

SEQ ID NO: 1012670 - protein, 170 aa, Homo sapiens
GAPSLSRRGHPRRRARSRPAPPPLARSVLPGLPERRRAGSPQALMKYRACPCGISRAPLRKLRLAILCGGAGVRGVDTRVCAPAAASGALGWGRSRNVSGCADKRNSTIKQNMGTQLYEYQRNTFREALPRGLHEMAVTPRSLHRELLCPTRVRHMLEEHHDYKGDVTSL

SEQ ID NO: 1012671 - protein, 325 aa, Homo sapiens
GDNDGGGSVVECKNMVMSLRVSDLQSAPGFRWAGSKSWTVSDEARHQGPPAGAVGLYALSCSRKIKELYRGPGTPKTGTRSLSPQAQRVPWSPLTLCTPTIQSGAWRLCLQDIRMVKALQVLTYPRCIVRKVLKTDMGRLVTARKDTCKGHEKVLLVVEKHSRCVLSNCLDCRTGMERPKPKFSAPSRDQSEKAFTRMERPVSILYGTLERTKEGGDGKDRKPRRPNPSGSNVAGTREDLKEPVARRCRSREGKDLLVNILGSKTNAWDPSPTGRGTQEHKTPDARNRFRKLSREGGQDTTQGNKRELPRVPMEGVNIKDAITKI

SEQ ID NO: 1012672 - protein, 126 aa, Homo sapiens
MPDTFVSYLLTAHRILLTVFLKYVYHKRDEHLKSKPCCVIPSRQVLNERVQKLCKPSQNCTFQRSCAFIFIWLGMKAKSTGLPGSGLNSLVHLLTWSFRAMATQGVKRRQSTVGPLLIGQSEQGSA

SEQ ID NO: 1012673 - protein, 130 aa, Homo sapiens
MRPAEDGVAVQSCEAAMSQPVYLCTGMHLAIGSAGCYGKRDETSGLGAWSAQLERSWRLLALAQARQHCQPPHVNAHRGMLAQTRVDDGAWRKRAGGTLDKTLEINALGRKRCSKASRMRAAWVSVPGPQ

SEQ ID NO: 1012674 - protein, 259 aa, Homo sapiens
MAERVGCSPGERGDSDHRAAPSCLLGQLHHLHLCALEPRRGKLQPRVTEELLASAVLSTLYNAKPDWTCLYPTTLNYRPAGGLAAEPCQWLMPVHIQPPSENWPNLSYNLRDYGSVYTRPCHAPWDTRHYGNGTISEQWRYIGTDDQAREGVLYGYHRTHVDPIGAPGGGRYYHAEHGIINPPRTQERSQDICRHTSRQERRYWSMRQRNRRSSEYQHTPDLGEQINNSNRTLGLCETPERESNKRRCAPEQLETGDIG

SEQ ID NO: 1012675 - protein, 157 aa, Homo sapiens
AAGKGRRLQETEGGAGPVGPAPTACSEIIASVDHIKFDLEDRGGAAAGGAAMPFPGMDKSGAAVCEFFSESCLQAKGGMCPYYATSVVRRQLCANTWHEVAYAKTGDQCEFHALSMTLTKNCPECYFITPSTGTCSTQGTVPYWHIETESKIREHEA

SEQ ID NO: 1012676 - protein, 77 aa, Homo sapiens
MISFQIFRVEILSGRRVQSSMWEIEHKLALHANFANPWRTRHILQSMHSATPPGSNPYRDGALPNWRTGSPTTLDSN

SEQ ID NO: 1012677 - protein, 96 aa, Homo sapiens
LVSLTAPVCLRLGTASCVPGQRGPGAAGGMSACVRWSGADAADLPGRHGYAAEFSHVPSLGRLCSEPPEQHYGIAGCGTLLILDPDRSWAKALKKL

SEQ ID NO: 1012678 - protein, 217 aa, Homo sapiens
NPGAGAMVLLHVLFDHAVCYALLALKEVEEISLLQSQVEESVLNLGQIPQHRTSGGLWSPLQLIPRLLVGNMPTASVLKGLFMRIYRLLLEIQLPSKREKKSTLGNRGSQDWCRNTSDGVQGTTARPGRQSEPEILARKFVCDFQNLVEGSDRSVSVVKAQSGGWGTQASYPLSIELSSNCELRVGHIVISPRPISRSLDARWSNGQSNYRSSDACQ

SEQ ID NO: 1012679 - protein, 314 aa, Homo sapiens
AELEGLCKLVSCWGINKVRQSNAYYLLLRRWPWPGFLPVALSPSGAQGSTVGPRTPCRDSPSLSPKGRRALRAPGAPRRSAGLSPGYRRGRVRRAAIALNLAGAVCRGAPGAGRTQRRRRPHNARGLRGSHAHRDYPSRPHPEERPDCRPLVTRAKRGERDEKSRRRDEGERPPRHGAKSSREPRGRHSEHETPIATGNIPQTTREEGTPLTRKRAGTTHRSRPRRGTHLGSPTFRARAGQRGAHTARQTGGNPQRSHEEKSPEEVVVRLREALWGAEGTPQEETPRDLPEMRERRTAADHKGPVWKGGRDHGV

SEQ ID NO: 1012680 - protein, 131 aa, Homo sapiens
MNQSDDISMHLEQPKETESTNRTIPHETEAHNPDQRKDTAIEPETEDHTMKPDRRNEPDKAQEDETPQPETTHQHQRRNKQHNKTRTNNKQQTTTIKTHKATKTTAHTPRKQSKRTTTDNHHNPTQNNTHQ

SEQ ID NO: 1012681 - protein, 203 aa, Homo sapiens
RGCSGSVRSRRDLTSAGVGVLLLSECCSCHCGHGRYPVQLKFTGSSWRSWPGRRRTDSSAEEASEEGPSAENVSVPVCMPRTPSARRTNGVNWLRMASRVTQWPPRCRTAVTYQGGDPKNMAQVTKALDWALSTMDLQKVSSCDGAGSSSEVQNPGRPYIGDGGLHELGSILSTPQEHGGQAHHADRRGRNGWRCWYQLSQLH

SEQ ID NO: 1012682 - protein, 237 aa, Homo sapiens
QEGWHRARSDDYLSLGHPFWRGTGARALVSPRFERCGWASQRSSARTPAANRDLPGPRPTPLACRAGGPRVRSGYRELRAIIPAPVAASSMLLSFRDSTLWGGLRYPFEPLAQSPCRPFPTQRASGLTKGLCGPVTPLGLPGPVRCRYRAGRKPLATDGGSYEAARKARPERGRKAFMAGAPRERKQRMTRLAITVATEGPQEEKRQMGRSGNALRQGERGDPCGPTTERTHEGNHN

SEQ ID NO: 1012683 - protein, 77 aa, Homo sapiens
HLLQWLLLLLPTLCGPGTASLDHLILEPVAQLALEYLGSQEPREQGRLQMAKQAHRGQYGQYKSTALGGTIGWGSHE

SEQ ID NO: 1012684 - protein, 314 aa, Homo sapiens
WPLRAHRIPTPAELRAMRPIRRGWMRSTTQVANYPHLFCLPSAGRFTWGWGIQAGGRGRLALVGKQPRLKVLKGPLVSDAKARLPARASVHAASLPHGATVSPGPQRLGTLLFDGPCVIVCIENLETTTSKVQPWPQFAVHNPRGTTLENRGQKRTGIEPLNPEGELLESIRETAEEPWVHPVHSGFLQLELSEDGGILKANHKSNSYQAARQSSTIHDQPVKKNLADEDAVSVPGAGHREQGAPGAGARGLHILAKDEPSQRPVFLEGAGQFDLLSSGLPRAGRNGYHLFSEKRLQAPQVLLRAERQLGDLCG

SEQ ID NO: 1012685 - protein, 161 aa, Homo sapiens
TARLLWVRRTSRGGHGGAAGPGVAGPEAGSECLGLVCRLRGPRPTNAWVLWLREIQSTLRERRPERALAKTAAPSLRPVTWALRGPVLPDILYRDVAFLQPGSTPSPMTCYVNLARDCKCPKKLPKNPMLTAPARCPAMSIDTAPGCVAVTSQRTQTPSHQ

SEQ ID NO: 1012686 - protein, 146 aa, Homo sapiens
PCGPFLCSEPICSASSCRCRARHRVLARRSQNTRSLPPPYSVRPPLGHPDHPRRLEGSLSREASAQHSGSFGDLIWSLHRKRGPQHRQTSSSPDVVPYNGSNHGRTRSGQISQAFPLTLKKIYMWCGKMGRRVSWQSLQPQFICTL

SEQ ID NO: 1012687 - protein, 278 aa, Homo sapiens
EHRCTCCHGGPASWPPCGPGAAAACCLLLLLAACRSPALAVGPRGCSPVQLFLLTQACGLQLFCCRATTSCLNEVLFQMRGLPAGLHDTNITAGECNGCQEEAALLSQEFADGLGAIMANGAVLNLILAELHWTLQLAVIIGAVRTLGSANLPLAKRHACTTALLSNMSRIYSTWPRSASPTMTATCWSLDPDLTNILASSAKHTPCSCLPGRAVTNPLAWHSLLKPLYGGSHCPQQLNAYKAGTGSQDTGGLLALLVQIPHLRGTIWNNSTKDRALY

SEQ ID NO: 1012688 - protein, 186 aa, Homo sapiens
MKPNSRVARHGCMRRKRARRKQRKEPQEQNEESQGELKGNVVLAKSERGDWITAEGVQVLQMMLAVATGGLSSQEALSKLKTFIKKRKKRLKNEGGRFIRNSTLPERSPNGHTRCHPTPFLDPATRWAPKIEARPRYVIHARGTTATRPCVRNKQTRTTGANTRCLKSLGREIPLGRKRSTIIIHP

SEQ ID NO: 1012689 - protein, 131 aa, Homo sapiens
MSRRRDRLRSGIDIKYAWTGDEVKKICMQRFIKIDGKVRGELSQYPAWIQWMSVRHREDEVNMFPWSYDTQGPFCVFTGITFGQRRKYKLCKGEEDYCGSEEESLTVVTHDARTDPGTQILSSKVNGYCAD

SEQ ID NO: 1012690 - protein, 305 aa, Homo sapiens
RASPFWSQCVDSARTSARGKQSYSYPGRRSRLTALPPPPSFLQTPKSQGAHGRAWRYCSHRQRLAYHLQAGRARLLLALGSGDTSVTSAWVSVTSRVPMIRNVRTAASWVEQQVNDLYCPPGMSITDGSTKAPCEEAITVESSMILNVLEYGSQQSGRLDPELGSIIIDAEHLGDFHEDLQEQVRTLRSPYCRLAISHDLSMSSAEQANVSRSPTGRFPPATAREVDPLQDSSMPSTHQSAASPGVIPWARVMSGEKTLTLFGPRRRVGMTCGSLRSGFPKSPLLTLPQGSERIPPGAVPPGLGW

SEQ ID NO: 1012691 - protein, 146 aa, Homo sapiens
MGFGRDLGRYGLTIFVLSVVALIICFTCSCCCLYKIVAADQRPVVDHHHIHRAVVHAPYPHASISVPPEATLDQATRATTPCLAQTRVCQLAPYPMQYPRTVSPAQPMGPPAYHETLAGGAAAPYPCQTGSLQSRPTVDAPIGVVL

SEQ ID NO: 1012692 - protein, 103 aa, Homo sapiens
KRNCTSGHAIVACLLRSRPPGSALASRDSRAMAHKYETVSAGSILGFQGDAYRQKTAHLLIADLAWRPHPRSPRGFLGYITYDTRTLLCPRELQSPQVVNEIG

SEQ ID NO: 1012693 - protein, 100 aa, Homo sapiens
RGLDEYPHSPNPTPTILCATSAPLFQPKLVERGNIPNDEQCSRWSWTQVSPAPCPLTPCMITKALKNPHSRKPQYYFWDASGGTKHPLRFRIIHFNEDIV

SEQ ID NO: 1012694 - protein, 203 aa, Homo sapiens
RARGISRRNWHKRRTTGGERKPYTRSGSMRWGAQSANTKMAPDGSITAVCGEVTKKYRALRLDVGKFLAWGSECMYVEEQGIIECCLAMHLDNRAGSYRRRLVKELHCARSDRLHSYADEWYESSYAAVPWARKKGAKLTPEEEEILEHNNIYREIQKKYDEKEKECHNQQCPGGAVPAGTSCYACHRIQGPGTGWPSRMAMC

SEQ ID NO: 1012695 - protein, 124 aa, Homo sapiens
MPFETRGVTIRARKVPVGGPFVINLACRMHPGEFSRSPFTRHRCWCFGNNTHCGSRKAAAVSLLARSWNSPIAFGPFFRIRRLGHWHPLSGLWALDLAPSPEPRSWAFPIVAFGTLGFGAEDPP

SEQ ID NO: 1012696 - protein, 136 aa, Homo sapiens
MDPWLALAGPPIFQKGKEGRKNISLRNGSTTPGGRNFPPPSGSSHRGRFPTQPLTEGVSPHEVVPRCKPAGFPRVLLPPHGCFTARRGLSAPEVFLRRGYTLVGPGMVGVHTSRAAPLWDTSPSVVHCGAQGWAVH

SEQ ID NO: 1012697 - protein, 195 aa, Homo sapiens
LIKLKSSCTAKETIIRVNRQPTEWENIFAIYPSDKGLISRTYKELKTNLQGKNNPIKKWTKDMNRHFSKEDIYVANKHIKKSSTLLIIREMQRRTTMRYHLMPVRMVIIKKSKNNRCWRGCGEVGTLLHCWWECKLVQPLWKCVWLFLKDLELEILFVPAIPLLGIYPKEYKPFYYKDTCTFLFIAALFTIAKTQ

SEQ ID NO: 1012698 - protein, 116 aa, Homo sapiens
VAHSLFASLYRVTLIFSFFDAICPTSGTSSLLCAQRCCAPRLACFDITATPVLLGSGDSPWPDASQVAGRTRCAAAEPSSVSLFPLFVFAHLFLGLPVGFLICLFCKHLLLCPWEP

SEQ ID NO: 1012699 - protein, 415 aa, Homo sapiens
ESGYCELPGDAVAAAVIRRATVPQQHPFPDTGTHPPYRHAQPDPTVPGSAAPSSYWPRKPIQTPDHAVAQIGKKSLMPELEEAGTMDLTNNWALIQQHEALARCHGDIPVQRPNQTCGCGQGTIEADCWSFHVWIKDQRRFPSETQLVTGSLWAIERRSKKSFEEFPTYHTRQTEIPSKLSKRILRPYHVMANNDTFKQDKDVYDATAYLQYFIPCTTAFVKEAQTRQARDPCDIEPIALGYVSVDHRNEIHVGTGNPRGDERMGDAQQPSASCTPQLTLETETYIHRVGPLQRESDRRIGSRREKGPNADGTTGNMPPDGTPHRKTRQVTGRRQGNPADCPRELHSFPAAENNEVIPQSIPQIRRPSVFTKRAYRRKQRERTAHYAQQYALGRTEGASGKARFTHFGSAAISVL

SEQ ID NO: 1012700 - protein, 175 aa, Homo sapiens
MDLRALRPGRPRHMKLFDASPTFFAFPTGPHPWPWRCWSLAPYLPPWVLAGVPSALAAFILAISQGSVPGVCRMTVGHASIFLYVLVESRWPRSRDGAVQGFSAHWVGTYGHSSSHAKAQHLSTEGPRTVTGVAATSSSIVGVDRNVWEECKAIRNPTKQDANVYIPERAGGEIT

SEQ ID NO: 1012701 - protein, 132 aa, Homo sapiens
MARASSDIVSLAGQCWAVQLCRGLSRRSSVTVEERARERVPYGVSVVERNARCDQVVVWARAGSREAQQLKDKAATGPGIRAKDGSYRRKWSLDFSCIHSLDRPCQRVPPMCKLGIGGKGLRGWTRLLWGKE

SEQ ID NO: 1012702 - protein, 248 aa, Homo sapiens
MVTPAELYDAVPIQSSVVYVPAHPHQVVRTQTESSTPPGIPGGSRQGPPVDGTAAEPRPGAESLQDAQLRRARKKLCLRTSAFGNNPWGRLFFHGCPWLEKLGTSREYATKGQIIRGNSAVRSPERAHGEVRLVRVQTFGLLDAKVYQRCGKESQAIPSLETSILYCRKIIKLEYDVSEKRFFHKCKRTRGRKIGGKHATKAESAGDETIGPDTGPHKEHNTCDYQSPDNVGATLHQTERRPEDSPAN

SEQ ID NO: 1012703 - protein, 182 aa, Homo sapiens
TVAANRAAAAAAVAAAAAVTEDREPQDEELPGLDSQWRQIENGESGRERPLRAGESWFLAGGATLAGALEDESASVLTCHSSMKTGSEDCEARYVLSKCLALPGQLVWSESMAAPMNASHRAANIQRSSVPSRTAVSDMMGNLTRSAATIYGYCAVGRSVEPETRLGKSKSGSVDQIGLRAE

SEQ ID NO: 1012704 - protein, 115 aa, Homo sapiens
RAAVGSAGRGVVGPSTGLAPVIAPRLLSFRLFTESLQDTLPRWTSLASDTTPDSYSIRTCKMCPVLRRATCSPVLEVTTREARRLRVMLGRARWVLDVGFDHLADGNGLSQFCSL

SEQ ID NO: 1012705 - protein, 105 aa, Homo sapiens
MREPSGLAMRLQSLMRAQWSRDPGWVTGASYIAVMGRQYSDWAVTIPGRGTRIVPSRNRLRCWSYSGRSWMTALRQAYHAWSQACSQGPFFTMACGNQDNIGVRP

SEQ ID NO: 1012706 - protein, 69 aa, Homo sapiens
MTASCTEGPESARRDANERIVETRSPSSANNTAIRPVTRNPRWIHQRRKGAHQHSPHRSRLPPQSHKAR

SEQ ID NO: 1012707 - protein, 168 aa, Homo sapiens
STRNEESSEHDLLGDEPPSSTNTPGSLRKFGLQGDALQSRDFHFSMDSLLAEGAGLGRGRLSRASRMKEYERYELLGDQVPPVRNGKPAWGLPSFPGASVRQHAPLDVNRNWEPWATEDGPNAGGEELEGTWTFTVPQTYCVAAEDASCCERCMKRLCWTEETPSSDL

SEQ ID NO: 1012708 - protein, 485 aa, Homo sapiens
MKWPKGCLHVLNKPQAAHSALTSGQFYAILTRTQRWNALSVTAQRPTRPQQASRSAPWYATGPLTRRHPHENSPTAPGPRHRENAHTRGKNPLSRPSPPCHHKTCEQTNSHPTRTLPTHTQPPETTRPPHSPHPTTPQSQPQQQHTPTHPPPQHNRTHTERPPPPTATTPHGPPANTPPPHPDRPHTPTQRQRQPPLTHTSPPKHRSTAPTPEHHATAPHTPGQPRTQNQATPHHRRRKPGPHHATQTGNQEAPHTTDARQPRTRAAPPAQPITPHATRRAHTTKRGQPQRNTTPTHHPPHELHTTPQPRAPHHPAPPRAPTTPPPPSPQAANRHRQPNRQDSTPGREEIRSALESDEPPNQAQTTTPAETTPAPPRAAGKDHRHATAQPPPQYTTSGRRAQTARRARKTGTEHAPHTAVRGESKTPQSRNTAARQRGHAENCAAEAQPPPGRTPRPPRQPHSHTARDEEKRRKSGERRTSRRKH

SEQ ID NO: 1012709 - protein, 129 aa, Homo sapiens
RGIGPARQVSKRVSGSREPSEESEQRVRKTSEAKGSRGEPLIGSRRHFPLTASDFAFPVAADERMLELWRLSAQAKISQLVDKRSCPSPEKGVTKAPASADTHSCVASRVKLVLRSEDASTRVMLKKMF

SEQ ID NO: 1012710 - protein, 204 aa, Homo sapiens
RDLCTRWKDQHNPHSPSFPWCARWLYAVLSPAGPLGSGQTSDHGKEVRDSLLVVRVKAVRDAPEMISSGGWFPAGTEERVISSASAVCKVMHPEGIMRRKAVFRHPLVNDRKTNWWLLAMLCTTGLALHQSQSNCFTHCDRSTTLRDSFGLYFPIAPDLMPRLRPRATIRRSNSKHLTRRFNKRASFHPVHNCTAAAWQMMTVF

SEQ ID NO: 1012711 - protein, 302 aa, Homo sapiens
GPRLALEGGHKALRPELARVECAVALLVEAQLGGLRSVCAGGSASVARPAQPRVQCRFPCPGLHPQEGSWGKGLNSPRAALGMQPWVPGTIIQDLPPPQPLQTWTRRQCAVGPPGNFRARSCGELPKEGDGDGHYREPQTHVARDICRGCARDLHVLTMWQQAQATRPSEDGAKGQGLAWTRGGDGHRQHELRGQPPGGDSWFYWHNCARSAFRLPSGGNPTSRGAARTRRAIAPRERSEVKYLFALRVPSTHEPGGPDGPAGYATSPSWTPKSDLCAQTSRFVDHIGSAPSSRRWPEARQD

SEQ ID NO: 1012712 - protein, 109 aa, Homo sapiens
LLVCCITLETWLWCCVKRCLCGSLSSLVGGLWSACAPSCSSAVFSHALPACLPASVWTILLGDVPSVSSCLPIAEWLWKEQDAVPHVCPLELLCSLCTVPALRPTDYAV

SEQ ID NO: 1012713 - protein, 73 aa, Homo sapiens
HARCHILPSPRCYVRSWRLPPEPSEADPFSGPGAFQVPSVQRTVCFMMRLKASFHIIIGGEVGIVHVLNHRLR

SEQ ID NO: 1012714 - protein, 172 aa, Homo sapiens
RGDCWGPSSAAWVPGGPVWINGDAHPLTAVPETFWHRDRALQARFGWTARFLEHLLHALACLEGPGVAPVPCACAPEPSQGLSLLNWQRSAVFERVLMAPWPPYATPVSPVPRWAIGVLRTRAQHLRERPHCRHSGVSPGVRTVLVGRSPWREPMQRLTGVCVRLSASCAGS

SEQ ID NO: 1012715 - protein, 379 aa, Homo sapiens
LEQRQQPDEHAEAVGSDGEDGGWRAAEAALCACYYGGGSEGVPGPLSGSRHDNAWLTSTEAGGGGGWRSRWLAGGGGGGENYDDPHKTPGLPSCPHQGCLIELVMDGRQDACGRPLTGEVMEPSQHNVVGNAVREEDKHVVEDLKGVLEGLQTQLNYVRPNNQRYTVAGSPSRCRSNYVIPATDRYPSLGDWIELPGAVEQVMLFIVYAVLKPRVQFRFTHWMFLVTLILLSLCWALVPGATWSLLSSRKERWDSSRDAWVGKFWTVRVSQGCTQAGAREGPLLLHTCERQSNRSFIVRWGEVAGRRSHGKRNFTDNINIARGVPLTQTGPYVRIVLFSTDTAAQPGLCSTLMRRHVSKRVGAQRVEVRTQELVTHRAF

SEQ ID NO: 1012716 - protein, 153 aa, Homo sapiens
MRSGLMENLRQDGSTPELPKRFSLDDYSLCDRQDLSSLSPHKILVDPRTLESELRLGQPWRCRPLCEPQCHPWGLLPVGVLVSRERCELVAVGGEPSPCRRELSCDLPDPSAQAVTYTRLNAESKTLLDIFRTRQTRAYRSRSRFDELYLPGA

SEQ ID NO: 1012717 - protein, 435 aa, Homo sapiens
MPCPTHSYPWPTPAGSSNHGMAASSLAFCVWLTHDRGAETPGLQGLVTLVGSPSRTSFSCVKCLASTVGLTIQGFRLIDLEIDPLYLLTGVLVTDYQTDVCTDQSDIRVVCIEKFSGTRSATTRRGACYSICVVAKHLRIIEALVFVGCHKHIQRNRAAEVTALLPMDVAPHGGKPSLAHDDSKLLKGPHSAVHGFYRINTGGGFSITLLGAGFGIAHKRAGKGSPIEPSGAEYPVVVNAKNMGNTTRLVGSKTELVETFFLPPGPLGHKRSGTTPMLTGFASDRPMEPAVYLPLTVAQYCEKARHRAYTKGEPPWAGERNGKVPQTETDNKPIRGPRKVGVAGPIDSPTERSGTTISETTRRQGEIAKDALDGRRQRGMSIRGRKRVKQDRAAHHGGPRTTKPSCYAEGQQQQSREIGTHKRPQKEVGRHRTQR

SEQ ID NO: 1012718 - protein, 133 aa, Homo sapiens
KCRRCYRPPRSYGMAGVRPPAGPGAPSACLVHWDWCWGLLTSWLLSAQDPVRRPLPSVTLLGRTPSPASAARCSSCRARSGAPFSPLFSSLLFLLHFCARGDSGRPLPQGCSNLLELTAAPVATLPEVSWKRH

SEQ ID NO: 1012719 - protein, 425 aa, Homo sapiens
WIFPAIPPLRSLLFFNNPKEQEKNVPALSCYADHPLDHAPGEGGGSLQSGNLHSGLPGTEAYRATRSRDARNCTAAARLGALSSMSSMVAAMTTLGVSFFAVEEPTCWWLHGWLAAGPPDAALTRASDGSCPPRGCYEKETSLMRGKTLSRHGKALGQCVMRQSGAAHSRRSPDGGRFWPRNNSQIAIIWILCEELTQSLGPGLDLALCEVPDVGALRIGKVVSQNLLVIAVVAAPVLRGLPPHFPPPVDSPVRGWIVPWGALQASSGTGTGPASVLGQQMACPPFVHRAQIVPMRFFANYYKGPNQEDFQSRMLIPNWKASLGLAAHLPEVHAVWFPVSHKRPFLALPQGIPLSSNPGARLWACKPSRPLGKSFEAILLVGDTAGRNRSNVYTHRKRPSFTIDSFDPPFLKTVLRHFNRRGLGH

SEQ ID NO: 1012720 - protein, 216 aa, Homo sapiens
MAAGLTGRLLPDPSVPAWGSLGLRRLPELHVGLVAAPEPRASGPRCPRGGAPPRQRYGGGAGVAVARLPTRRKASEATGSPEGDLGASQPRTEGPGRQKRSRESRPSQVAPRLPPAGRPWLAWSPGGAGHGASGPDSGGRSGRAELAANASPEGPPGQDSPGGAQAGGPPREGLASSRLWATGWAACGGANPREGHPREGHPGGGKQAAPRGRPPQ

SEQ ID NO: 1012721 - protein, 349 aa, Homo sapiens
EYRECSLDNVGWFVRKLSVLLILRGALRHLAISCSASSAPVHAGTRACRRARDSGPGLRGAPDRWGAAGACPDDWLTDSPCSCLLLTEAAAWLSGLTCLDMLAGWLAGGRGRRWALDPSCASEHEMRVVSPVFLQLPSYEEVKYLPTYEESMRLQQLSPGAGRCCQLSVLGRPRGAGSPRSPTAGEGRIPSYLSARGDRRPGCKGCGAAGGYAPAGGACRNCAQTLSGTLAYTARYPADWAWRSLVSLAFSRDLLSLCVSFPVPSDTLVPLRWPRLRHARRLPLLGRSRLDWPFSFASCPIALRYLQSSPEYRSPRFPTFTRAPPPAPSRCLPRTRPPSFFAHSSSDRL

SEQ ID NO: 1012722 - protein, 217 aa, Homo sapiens
HSYLSTSSLYLQSPMAPIKPEPKKDDSQGSPLRSDSSSPTPPEPERPKEVEFDCFHRVKIGVHYTEHDLNELRREAIQCCTSLQRSQRCEYDRIIRTGHVWCDVLTGRCGLGTRTQGKNSAPDVLRGKPNDMRRSSEYHRNDVDVMNTFPCRMHPRSTFHKKQRDEQASAMKDLIVVGELAGSIDKRGGIGHWSMELARSVSHTWLLGPTARAAEEL

SEQ ID NO: 1012723 - protein, 164 aa, Homo sapiens
MDGYSLIHYSDGEQGKYTQSKILTLEISAPSINIQELRSIEYTPMQGCRDNKIAGNKSDQRKIFRPNDQRGKQLNAGNRDGTKPQGQSETSENLKEQTNTSAKNCEVATKREKNTKRNHRRDTGATETMIANEGVRTRQKRGGVRQLTSSAHERGHHEPKERTT

SEQ ID NO: 1012724 - protein, 108 aa, Homo sapiens
MNERLAQEQGLPRGMVDHREVSSSRPALAEHGERRTSSKNSVYLGVSSVFMCAKGVFSEEFKGDTIKSEMEQTSAIQSLCRSEMLQREGDSVYAGNYAGKSTWVAGKK

SEQ ID NO: 1012725 - protein, 296 aa, Homo sapiens
MRLRRLETLIATTLYAVLEQRSLLSLYFTDCNLRVQCVAPGSRRMAVLTCRPVRLTSFLPVEKPNAASHPVAVGTTYVPVRGAVAGAGEEGVTGMDCAAELASDALLADGSIGKVLAPPCHAGPQAETGRPPACAHLARPTHGFTGASCPVAVLSSFLTPERLPYQEAAPAETFQPAQVGDSLRDPPGWNLLVPGLAADHPSRHGMTHEVNLSLTKVMEHRLHVTLMEKPCPTVNPKRADTHAATLHDLDRTGQDNKEPTTRLTLPTDGKIPPHTELHDESHTTATTTHLDTSHKP

SEQ ID NO: 1012726 - protein, 237 aa, Homo sapiens
SCTLGYGIPVRPRLSDLELSLARLPILSDPPHYRAVPLPAPAPAAAAARAPGRSRLSAPAEPSPSPRRGPEPELRVAATARPGGPGTPPRFGSGAGWSASASSNQRCGRRPLVTRDYPVLAPRSYAQPQGSLVIGGGKRPFNRQTSVIAVPMRSMTADQYQGLKTIVSPDHEWAFRCGKGMRQGMATIGGCATGLETVGQALRMDVREGLVGETARRPDSGTLVIRKAPKTNKSVGR

SEQ ID NO: 1012727 - protein, 117 aa, Homo sapiens
MVVRAHPGAVPLTMLFDNLVHSEEFDNGGAVPLGVPVETSFPWLAPGAPLGGPGAPVLLPPAFAHRLSEPRIVGADGRIARRAPLCLARGRQVGAWRCRTTMHPGGIDGSWAVLRPS

SEQ ID NO: 1012728 - protein, 215 aa, Homo sapiens
EARPEPWMPRRCPGPAALRLCPAAAHRLSPAAHGALPGRRAGSRFLLLLLRLCLLLLAGRSGRWMSSWMACCAGLDTWMATHQKDCSLPYATGIQRIAGWCSEQCCHSQLDGACTVPRASALANEQDRMCHDTHGDNAQPGGHIIVKRCCHCSTAEGRRPLTRDQRLQRYSLMVGYSVDMVFRDMQCQEPQRTEQISMSETGHPKTKRAIQQIRV

SEQ ID NO: 1012729 - protein, 249 aa, Homo sapiens
GCTSVNGIVDTLVAVLERDTLGIREVRRVQCLLSAVSWGLSVSVQQLQVTPENRRKVLVQGPGASFAFPAHDHRGVRCSVPAQYGTSWWTAEVVSLFLHFTVNPKPQSGVHMTWPRLLTCDGNGVQAINLHSTHGCEDVRMVCNMTVDHGDLHQGIYRIRQRSIIQLDGDFAARNGIHSHWGPNRPTNVEHSKITFNTRYASNRFYGAHDNDELRHIKTSRDTSIDDQGNTNPCRFSVPQGRPAFGIVA

SEQ ID NO: 1012730 - protein, 183 aa, Homo sapiens
MDECSKKDQARFDGGLERTLNKVYWLVAEKVAGRVIVEVCASNSCQSRLGLLACGAGVKCCWMQGSRARWRIQDYRQYLALCKTRLLLVRAMPHEVAEVRTGVSGDPGQSNYEYNVSAFELPQGSSWEPILSHAQNMRVVIALNVVLTGLRTCNQTESKTNVPEDYRNNPFEGPVDLGDTGPS

SEQ ID NO: 1012731 - protein, 185 aa, Homo sapiens
MPADCRIACGKATHGLGQQESSRSERTRPRLGVPGLSGCSLEGGVSNARVRWFLGPTRGPPNVQTRMTGSLARPKMRSGEFLASPCWPPSGAGPFGPSRFGRVPWALLGPGPRVRYRPPFWCPDVPIDDPPLPWTLRLGDPFGVGQRWNHVVRRALLWGWAWALGWFPPFQFNGGPKPPVTTRTP

SEQ ID NO: 1012732 - protein, 104 aa, Homo sapiens
MSAAHSALYSVMPGMLGTSPSQEPAPYPTLEPVAIQRMPWCNVYLMTIAPKPGGTRLLHHTGRNSKSVYDQKVSVGSSQFSHGSEPNPDICPISQAVTSPGNLN

SEQ ID NO: 1012733 - protein, 235 aa, Homo sapiens
MVRGGGTGSKAIFRMLTCGAVSGLEGKLYATHSCSPVRDSSFDERLAKSKVKRENNKVREARQSESVRFRSVCCSFAIPQAGQSPDSPEGRAFLTQTHKKMLNQASLSCDLALHFQYVAFVSHPSVAAEALKHKTPVDSRQAQEQANCCAGGDRSSRPKVAKLSSLLGELNKKQERDWVSVDMQVMELESNSKRMDVAGSEMLQSKYSEMNNQIDIMLLQAAQTVTQNSADAIYE

SEQ ID NO: 1012734 - protein, 217 aa, Homo sapiens
SNPGSGEARLAAGLGPLRKSIRAAAPRRRRAASAAEKHSAARARTATTRRTDPPTQASGPADLGAASPEAEGMSPAGMWYRKRRGQTQDTNEKIITREKKRGEPRRQKLRNEKMFTKGSSSYTETTESIRRGPRRHRAEERKQNDPEGRTMEATKRKPRKPYRRHPARESMTRRNEEAKQTQGERPQKIPSDMEDIRQTDRPAKEEHRQEKYTCRIS

SEQ ID NO: 1012735 - protein, 282 aa, Homo sapiens
MKTVILKATISESNFCASVYHGQTEHVENDHRDQHSIILKEYFAEMASAKKLTRDGSKEPSSIKNRSTRYTSHVDSKGANWSERGGGILGSRLQFGNAWHTGFVSYSFTFGENLLYLSTLTHFGCQVLGTFPSFPSWENPFSLTSCPWPLWRAPRSCQPASAHRPETGRLGEALHHDELLALALHLVAVGKRQYGPINCAAILQGVARRQKRRPRANTIIYEGKNKEARSRGPFLQSGNTTASYATIPSPRSEYTSGDSIDVTKGQMVEGLVRATRLWRRHT

SEQ ID NO: 1012736 - protein, 225 aa, Homo sapiens
APGHRARQPLMFRSDAYLTLTTSELQPTVGRRTDSARPAELKGELYCLPCHDKMVRPHLRGLSPSPLEGRVCQAALGNAGAHVDARLSVPMCEQAIPGCTEHYDARRAWPYVTRVIYRASSFGDCLLRDVRAECDLRRRMWCQAPSNRGPWCVSMLRPAPTCNERSSTLKNKSVEYGRLKPVCKRCYEKFPLELKKRLKKLSELTLAEKAQSEATVAQLWLRGPS

SEQ ID NO: 1012737 - protein, 108 aa, Homo sapiens
GYRDVAANAALQLEGGLTAFWRVAVVEGDELAWPVSLLVPMNRDATSEGTRVAVEGLIVFHVSTSSVTCRRRVSGTSFPPDPSGFPFPGTPRGRLAATVDRERYRSRT

SEQ ID NO: 1012738 - protein, 34 aa, Homo sapiens
DGSRCREADGPNVGGLSARVKRATAGLRRPAGGS

SEQ ID NO: 1012739 - protein, 229 aa, Homo sapiens
MEWPSSVDMLLEEVRAVRPAEWGGGRGDVQECAPPSAPRAECIPTPSTAYRQNGAAESLMLCVMRPPIVRGSAVKLKGAIPQWSRTPSVYQSSPCRSHALVFLVHTLKVHSGARGLMSTCLMAPGHFQSIWQFKRVTLLWFSLLAAESDLHRRDARSLTPLELALQRGAQELVDILQGHMVGPAVIWGSPSPATRTPWGYVSDREGEETLSLLVSPAHCCSRGGAQFCG

SEQ ID NO: 1012740 - protein, 103 aa, Homo sapiens
MRVYTFRGQELGTHNGNGLEKEKQEDTIQINIRILHDLADIDTEERYKYHQKNHEIESNEIGENRTILRNSEEHHIDNNREQEKLETKIEENNQQIKATENRK

SEQ ID NO: 1012741 - protein, 152 aa, Homo sapiens
LMFDAVHCGGELLYEKLNRAEENRCEASWPVHRPTFGPTGSDLVNYLRMVEYDGLTGRVVLSFKPDDIGAENARATCLRKSKTAVPCQGHREIGVWYSNHSTLVMNAISLDIKHGLQRLAQIKTLCGRLDHRVENRNTSMRAGPNIPRLLSG

SEQ ID NO: 1012742 - protein, 75 aa, Homo sapiens
LIRPRFKRAACEYQPPLPLGIGVDYCYAILSRMLVINNSSKKCNGVLSPPSFPTLLTLILRQMPLALKVGFNRRV

SEQ ID NO: 1012743 - protein, 200 aa, Homo sapiens
RLLVASTGAQAGTQVAEAEADAVAVASGTAVGDDVGCLGAPPARKAQAGHRSYNLQERRRIGSMTGADARHCCPGSPRMRIECPELLATGLTLDLMNEYRFEDVPGVRRRLVRKNAKGSTQSGRYGREPGPTVSGPTPGPRQKPHEVFVEAEVSCSMDKNQEPQWPGDELAGSHLKEDVEEETERWGKPSCGLPLLPQSP

SEQ ID NO: 1012744 - protein, 312 aa, Homo sapiens
QAGTLGVRDRRARVCGRRGGPYKTEPATDLEADWRLNCERGRKTWTYLQDERAEPEQTGLEAYALGLDTKNYFKDLPKDPTDFEGALNGMTFYMGLQAEDGHWTGDYGGPLYLLPGLLITATVDSIPLDSRIQRRDCSGYLRSVEDSLTGGWGLTQLKDNSTDVSGLRSTIVSLRILGCRGLTDPDTGYETRNILHKTGWMLSDIPILVRRSSLGVGMILGNWLIQGMRERPVKIPLISPRRKWMGMGRQEHGEAGTKAPKQKNTGGPTWHGQECHREPRKANGIRPDAGHAAARRKNTAQESKNKQGKQRK

SEQ ID NO: 1012745 - protein, 196 aa, Homo sapiens
LGRAAGRRPRAQLLRSAPCSTRPDCGCAACRTCSAARDALFDRLRARLAALEGDASPSLVDALLDQDCCASCGCELRSAWMGWRLSMAHDAHIEIEECMILSDRRTKTDEGDASSAEPVPNTRRVRRNVCLSAYGEVRHGLKGGAVAPGADQLTVLCRSLANETHQLRSDCLTRPPYHIVSASGRKCRGLKRRAVH

SEQ ID NO: 1012746 - protein, 271 aa, Homo sapiens
MPESLVMVFSTVKTFEPPELTNSCAPDGHSWHWTVLNDVHRTYIDAHASSICTASLGYRRETLSLNKRRKNEEHDNIVTIMYLHEINSHSEFPTLSGVSLGTLSTVLVGLALSPMEAMERSLGPKAGASSLSTRRPFCRRPGSVWLLSWLVWHPRAGGEWSRDSPLAPMIGYDSSAGRTRSGYSDMSVEQKCPFGNCLQRRKPGVSSLDLARDKLPGLVNLLYWPMPCAQFFGHYKAQRAKEAVEDDAETAYKPGVGPTPVLYFGGGSLSA

SEQ ID NO: 1012747 - protein, 268 aa, Homo sapiens
MGIKTALPAAELVPLRLLVLSGALAYAGRGLLEASQDGARQEGLPGVCASWRGSTVAGRWMWLTFEWVSVVHRPFQSTVNHRLPHLRDMCCLLKRLHDGAPELRSWMYAVYGALAVMGTNGPWYLLLLLGHCVGLYVASLWGQPWLCLGLGVGQPVPPSRWTHLISWQSGLVTGTLDLQEVLCHGGSSFTVLRSTSFALEELCPPMSDDYSLAELVKYKFYSMTLLPSYGPISDLLDRHSMLRVSQVEPVETRRVSCGKSKPRAGYSV

SEQ ID NO: 1012748 - protein, 302 aa, Homo sapiens
TGIAGRRCRGWAGAPQHVGGVLVVLAAGMGLGAAGCARGLCAAAVRVHAMDFNMKKHVLSVTLGIVHSPGAVQFTGVRNFGQAEKTELDAHFENHSGPGHDSTKNWTEKILSADRGAVLQPNPSARVEEFLYEKLDSEVSPQGSPTGEAAGSGTWTDADSELGPDHPRYGKTTDQGWQKLRSKLGTAERDYNPTQTVTYSFTHTTCATSMEGGLEEQSRPQRADSSKTGRSWTLACPATSRGADSNGPRKREDRPKGQRKRGALTLTTEDLEANGREHKTNDESERGRHEERHGGTAKSSRN

SEQ ID NO: 1012749 - protein, 214 aa, Homo sapiens
DGVGRSRPRMISFLDCLPAFSAVPEDETQEIPLVTLPAGERQRMGQDPLLLLQALQTLWSTRERKQRRSLVLSPRLECSGAVSAHYNLRLPGSGDSPASASQVAGTTGSTMLASIKVYRVETEYRMCSTDLSGTPELKPSGCLVFSKCWDSGRGHCALADAVYLHAHRLSCVRPVTTVAPLSQVACWLTESRVPRDQRSCLYTLSGQLTRGANP

SEQ ID NO: 1012750 - protein, 120 aa, Homo sapiens
RLLRSGVNGLYAQSIRTYVLGTTDIVLMSSQWSSGWETETSCVGRCSLPLLLLLIMGGMAQDSPSQILVHRPGPAVPEDPVALARISCLRLSASQLATIRMVAEWAAPEHGAPRPTPPPA

SEQ ID NO: 1012751 - protein, 107 aa, Homo sapiens
MDNRGKNEMTQNQKKIQDEEKANDAKKGSRKHKRRHNRQEYGDKNESGKHTNEKKKPTKDQQREERIQDNQQTNHPRKPQRRHQHMHPTKRTKKQREAKAKPDKRHR

SEQ ID NO: 1012752 - protein, 289 aa, Homo sapiens
APPDPENARELRPGGDGAERLRVLVDMDGVLADFEAGLLRGFRRRFPEEPARAAGANAAASVAREQYRALRPELADRVASVYDSPWVFFLDLDAHPGMPWTLCGDDERATRTRRSSSAASPLSEVPPLLPLGGRSTLVPQVRRHRIILTRDKTCGLGGPCSLMTRTQFEARQEDPKLGAHLVHLLATIGTWSCPRPRRRACFSLAVEQAVRAGSWISNARELTQRGNCSGRFPCEASKALDAERERRRAHRWDTRKAQSREDGNRAWFPSGPRVSEAQADTREALVNRG

SEQ ID NO: 1012753 - protein, 245 aa, Homo sapiens
WLYWPGILGCLALSIDCSLTATSPVEEDEEDGSDCWMTEELRVTCEACWCEGLRTLLTEDEESGVSLLWRCSQLVPVQNDMWSRNWLSHEGPCVGSRHNYPGSGWKRDWQCGDTAKPEFLQNMRSGFLPNGCFIEDILQERGRDNYDLLEDNHSYIQLACFLCEEPGVELGNAKPLTLREVEVFRSSQEIQERLVRAYELMLGFYGILVGGPIARCHGGPSTWNTRRRFQKLNLAQPQQPPHHTH

SEQ ID NO: 1012754 - protein, 200 aa, Homo sapiens
MHVTLESEQPLCARFRRIVRRSGGSTVRGLSPLRGRGWRRSEGGWPRVRGTLDALQLELGEPWVSSASRCLRCAVRTRERQHPHRAWQDKKGDRRFRKLGRDHETRELPPKHGKPKKAETGREGGTMGRDLVQDGPNAESLQPKIQAYETDWMTRIDVARIPKQVMPANRILGVQVEAATVPGHHQRRMVRPLEGKLPEG

SEQ ID NO: 1012755 - protein, 112 aa, Homo sapiens
MAVNQCGTPTVGTTHVGKSKRGRSERGAMPRHHEESGPARPTCGEPTKGHNKRALMEESSKIREQLLNASQTRTPERNTSHRGRGPTTRYLEETQKHTHTWGAHSDLRQHLG

SEQ ID NO: 1012756 - protein, 153 aa, Homo sapiens
VAQAELLPGPGPPRAARTPEAPPGVGSGAAGQLCERPALACPADSAATSDPFYLYHQAHATRESITATPSTLSSTECVRNDTHTPSLRLNPSPPTHTPYPLLSHPSPPAPPSYSPRPPPHTSSLSTHYPYPNTSSPLLSRHPHLFHHTTSFLQ

SEQ ID NO: 1012757 - protein, 66 aa, Homo sapiens
ACSVVTTPSAWALGTAQLQPSGAIRLNLWHFQSLIVSGLKCQLAGYVIIYTKNYDEVTCSLQFLIV

SEQ ID NO: 1012758 - protein, 257 aa, Homo sapiens
LVRRECRDRTIPEAAVSSPVSALPTVQPLGCPPFPKRYFRSLADGGSVRLPGGVNRGHERGRSSGPVQRGPMTRGRGAYNGAQASVWAHKIKPASPEVNLPTVSALRKMGVNRDTQQQGDGEALAYVLFSGVCKPLIIPFILDEIGADVQARHIVAPVRLVSHISSVEKKLMAFQAAPKVIRCMTQHNCGSAGRRYECTPRDTHAPGGGMGSSCEQLMSSVGFCTEVGRRSSYDAVHGAQWQRACLCIHGSGRIGDG

SEQ ID NO: 1012759 - protein, 255 aa, Homo sapiens
CSGGLGTGGGELGGCWPCLCLAWRRSLALGLRPAWPPTALMLLAECRWETSGPAPGGEPACCWPLSDVGAVAMCGHASPCVLTWGAGGAVPCGRSGLVSWPPWTLPLLSPGLEMGPKLGATPRALRAFHALTEPSASPSCRILRPFIRKSRRSHYRCFWMFTLLMHLYRLEHARYLSSYLLSSTQEKCLGLPRYSSPMWVIPRRHCLRYHTLVNVWRDTTAALCAHSNVQGELRSTVSHHPSRVSTYLHNVAGTF

SEQ ID NO: 1012760 - protein, 243 aa, Homo sapiens
MEPGVYIIQSSMPSVLLVAMWWVSFWISQAAVPARMSLGITTVLTMTHAHGLVTRSSLAQGHQTSRHWTSTSGSAMYCRCLPPLVEYALLISSADLQEEAKKAKVKVSRPRAEMDVRNAICPLAPSLRAGVHAGAWPSPVGSAVIPGNLMGSYRSVGVETGETKKEGASPLRRPGGIRCPAQAQSTQTPLTFTPVLCALQAFGAAQVSVYCGWQYADVSTGRQADHRLSLVARRMHGQETSWE

SEQ ID NO: 1012761 - protein, 119 aa, Homo sapiens
AGPELRRLRNGYVLQRCSDFRKPVKPVCDVTCSYVCDALSQSPAIHPHQIKTSPRPQLGACPRGHLTDSILGSGKSMMFNLVLENQTGNLVDFSSMGMSALGAVSCCVLRVPIILNVPG

SEQ ID NO: 1012762 - protein, 101 aa, Homo sapiens
MHPPDLLATQNGIQNPISLEDSPEAGGGSGRRSRSGRRSTAFLVIDSTVHEVSDTCPSQQGAPSRLHARLTCGISTKQLEKLVAYELVTGRRLWKNVYDEL

SEQ ID NO: 1012763 - protein, 82 aa, Homo sapiens
MTGEGSQCPIPHGPGNGQVPSEIARTVHILGGEDFILSLRDNCLLHVGVQDINDKRFQETFEDEFSDRPFARVPWYVLGGNH

SEQ ID NO: 1012764 - protein, 341 aa, Homo sapiens
MAPVEHVVADAGAFLRQCGSGGDIGKNIYTIREVVTEIRDKATRRRLAVLPYELRFKEPFTVNTCGWVKVSSVDSRTRGKHRRAHFVSIVPLQGLRPPQRNRTQGSLSLVEPEYPGNCEFLSSLLDDNAFAPNIRVTESAMDAELIVQEVTDDTKVREAGSEERRTRLCTDSKQDDELMTDRGVGWYRPRSETSEQNPSTEPGARVTVPRRTLLGVASLYHQTSRMRECSCVQHGRCNVLGRWTGMLDSVMARSYSLAAAMGCFKDKSGHERECSAHTCGNKILKKSVRDQLSDDGTCTLHVLPEPKVLNPEAPVTRFPSQRGPIRINPISPRIRASFSAI

SEQ ID NO: 1012765 - protein, 448 aa, Homo sapiens
HASCYSWGSDHGCLFIALGGSRLTYDTHERLPCCNVTCRHCLCTLQAPAHYRSRTAGALRPTSAPPRPLRRHCSRTPRHTTSPRPHWRQPPTEPPVRAPRRSPATLGAADLHTPPAAAPRPRRCPRTPEPLSRSHLPLSRPCDWPHPAAALHAPPPPNAPPSLPHGPAHCGRISALIRRTLLQPAMRLRTCCNLPTTPTPPPPSTPGPRHSSPARDPHLFHSGPGPFSAPIATRPHHTWRSLARCNSALVPRPPSRSHPLPLLTPPSPPWAAAHGCFSPPPAAPPAPAALLRSRPTSAPLLYTPFDRNATPHSRPSPATRRAVPLPYPPSRHSTPPLAPDASSGPPLTPTTRSPRREPHQGPTPDAQHANATNLTLRDHDPEHGPPTPGTPPTTPNVPAPNPTHLTPRRPHCGTVQHSTTGRGHGLRASTHYERTRPRTNTPAPDLTD

SEQ ID NO: 1012766 - protein, 60 aa, Homo sapiens
KAIYGLHLKHSGGLKTCRRSDRKHSECLKPIGHRAQCREVGSVSARGPCALRACILMRSA

SEQ ID NO: 1012767 - protein, 268 aa, Homo sapiens
MTDGILGKAATMEIPIHGNGKPGSFLKMMGWQQDLQQVMVSGPNLNETSIVSGGYGRLWLMRLIPTGLWPPSISQHHSFWPWRCTWLGGHSLEQKSRHRQRTLAASTPTKCTKQLSLSNDSRADGSRHCGPGSQQLPALELACAEHEAPRMTECPAAWRRRTDSPPLQTAARPSMHWVTAFADLSQKSTELQEELATMQRPRNYYARMGETPPGPAHSPASHHHTLDTQTTLRHLLTVKRLHAPADTSLRTNKRTRSGPGADRAAAGP

SEQ ID NO: 1012768 - protein, 193 aa, Homo sapiens
MPWAVGRRWAWAALLLAVAAVLTQVVWLWLGTQSFVFLREDDRRSWRGSTLGRVTTELCLLSSDLWSCGGCTQATCCPTRSCVGVVNAGGWMGAMCLLHASLSEYVLLFGTALGSRGHSGRYCAEDLGYHHLWHLPPCGERAPSKVRSSTQATTVRTTWPGEATSCGVGAKHNGLVEYGRGVSPIHPGFRCWA

SEQ ID NO: 1012769 - protein, 225 aa, Homo sapiens
MHEATAGTQCSCCRGHETVLTPEFLNRCRMHAISGWQVFFPMHFQSLPPSCGPSHIGPGPPRVWAVTTGRFDRQASQARSLSSTTSDLRGSPVGAGGRPLESNEEELLESLDVSEAVPPRSPSLHVLRAVGDLVLLSVYRAQTCSAEAHVEGAVTSRWPPRDRAGGPSVHRIPWLGQCYSFDTEEGREHVRTSVEAQPVEPQWVPGALVFKGPPLPRSFSSPGYS

SEQ ID NO: 1012770 - protein, 357 aa, Homo sapiens
NAPACCFIPPHMMCIDCTYMPPCVSTLLQCPHQPWSNTPEGLTTACGPYPWSRAEAHNMRDMLRVVASPRACMHNTRACSSCLDLRHDDPFRSAMPTSSRTACCRPLARHPPLHPSPTDPPSTHDSRASHHFNSSPLACPFPYPPSPFHSGIRPLPSTPRLALCIPPLTLPYPTPPFHTPYHEPKPDPYSPPPDNGAERPLTDTTSQQRTPTPAHLTSLETGSNRGRTHSKHAEPRHSPRPSPPNLVPPIPTHKSHSAQVGERNPHPPASPAPMAGDPARDPSIDPTALRRITNGSPGSPPLQTPPAPRHTSQHPTFAPLVPRAPTHLPCYEGESTERCRQRHHQPAVQTTVCGYAT

SEQ ID NO: 1012771 - protein, 191 aa, Homo sapiens
MPTDVHSSQKQGLVVRLLAGTISSVMQPHGGKCKQAPDGAHDPGGPPDRFTCSGCAVLSPAPSHEGARRLDVLAVMACVDGPVLVMCRRRGCIVTHGPGAARGSVVASKLHIAVSLRGARLAGLSRGRIAHEMLRSQLAFSPGSIPASHLTWQRNCRTPLVQIQCILSEDPVSKALLAAAMQAPGPETWRP

SEQ ID NO: 1012772 - protein, 222 aa, Homo sapiens
WYGRNRRIKGGQKLETCGCRSLQRSPMGRVLSTSMGLVSRVPRSTLYGNIAHRDWCWHERIEAHMVRCVDEIEGLRGRMHLSSVLGMHGETLTEAAMLHGLTIWLTEKDWIPKLFQVLGPRYKDHRAGGYITECVHDPYNRQFGLVANDGSDSSITGHCLPPLPLPRRDQTILHSYNRCLQGLRQGPLGEARVNASNRQFPHRSNTRDLTGSDESAGLNQYA

SEQ ID NO: 1012773 - protein, 121 aa, Homo sapiens
MRAPSTGPRGRWRWVGAVSERQRVRPVLAWGWCWLSVQYSPCNDGRRGGKTKISRAVKIGLMPYEMIYTQGCSAAITAEESDCQRIPEGASVRVVKKPYHMSYETKTSLCWVLLRKERAVQ

SEQ ID NO: 1012774 - protein, 56 aa, Homo sapiens
ACAITCKRCTVRILGSAAAFLSAEAAPCSSSGSALTSGAGPHGTLGAPQMLLHLCF

SEQ ID NO: 1012775 - protein, 223 aa, Homo sapiens
QAVPHRSYGISGSLVGIDNKIEQAMDLVKCTSCLRSGSEVEVLKEQIRELAERNAALEQENGLLRAWASPGARLAQVPPSGVPTALGPPLRPNGPSGLKPPFPLYKLLPFGGLPGPCVNAVFATLLILSEQRAFKLSPSCPPAAGAVTKGRQVTWALGPPRVPFSPSLPFDFNPPSRCMPGKSVRRLFRMYRWGLNKASGRPPSFIVMGYPQIPKITYALLLE

SEQ ID NO: 1012776 - protein, 219 aa, Homo sapiens
GVGRRQIMCILVMLGGLTAGLVAGTRCSDGQFCPVACCVYPGSEPGYSCCSCLLDKWPTTTEPGIWVAAVPVFDCRHLASCAGQSLAVLKTVIRGTFRLTCAAFTQAVPGVQSRRDSCRISLASAHGWSFTPCGCHDWGDSLASQPGLSVKGSSVEVAHSMLCRLATHRFSGSLNLRLELSYPEQVGCVSNGLRLGHPLAGGVACPRSGPDGLLVSCSQ

SEQ ID NO: 1012777 - protein, 254 aa, Homo sapiens
MRYWEEGAMQYLLRTPFLFGYFSRLAMFSRATLCKTLALGAQVRWPNLRARPPIGKRGGPLYGGKPADGGQTGALYSRLQLLRTGKFPHLRRRTLLSTENPRNGTLPQMDPSGLLGATQTLPVTHTSGRQATTLDHGANTLIHFNSAGAASPQNVTYWGIPLLAVHPVSLITALRDVTSLLGLGRRYWRPWRHCMREISPYVGMGWPLSACWCPTRVTLMLLTGDLSAHLRCSVRGARFPGVGCAPPRGAVPAG

SEQ ID NO: 1012778 - protein, 200 aa, Homo sapiens
LLQSQIFPPELFLPPTSKAKIEVMFHKPRNAKGLPANHRKLGERTRTDFPTALRINQSPDQKKKKNKNTKKKKTTKRKQPKKRKKQKEKTEKNNKKNKKRERHTKHEGARTASDTAKAPDQTALAISMVVRRLLTRSRCESGEMSRELKQAEQRGWTRRLSTNSDIVKSLGKLEPSVALVGRGDTHTSSGGWRVVGAASG

SEQ ID NO: 1012779 - protein, 182 aa, Homo sapiens
MTDPLTWAGGTQMSDSSESRLCTMNLPEGCHNMGPCDLIGHLSQNAQHGPCDLESVPCRECNPPLPDTIWKPNAYGVHELLGAQCKPGHRTLLLLSWLRAQERLRPLGLLVATEGVSAAVRTEDLAALEDKHLPPPSLSLGVARQEESSDADGYRAPPGLHRPELSLAGELDTELLQSGPEI

SEQ ID NO: 1012780 - protein, 259 aa, Homo sapiens
GCCNDWSTSPASSNSLRTARCPHTRSAAAAGSSHRVARTFLKSWAGQDIGDPPIRYGRLEAQAPSSMPFGARKKRSWFRYLEAIASDKPDGPCGRFCQTGRRCSFLPGDCHCQVLKSDPGHSATHHLKPSELTQSHEQDYDEALAAVEPPTDAEASGSPAAVLELEAAIQAPHPSYYVAQRWHHGALDWTQRPAQPTRRGAFRMAQLGPFKHQTPYGWPTGSNGTSTAGDMNHVSLITFTEPDARPCASLILVTDGKWP

SEQ ID NO: 1012781 - protein, 213 aa, Homo sapiens
RHRGHVRGKPQTRAGQAAVQGVRLVLRCAAPGPPPGAVSAAARGVRELRVPGRAVGANKYPGMRAVLCVRWLLLWCCMALAVWPAWCCWCRGEAWCLGPGLGPRLTCQCLTLLPSVLQAGIPSWPILGYDVCPTHYLGESMQEHSEDPCRDYLRTLPLKPTVDYGGTTFHPEPRPFIRPTNTLRKHAGQSGNAGAILVDIGASWAPQAIHYPN

SEQ ID NO: 1012782 - protein, 126 aa, Homo sapiens
RGEPGRPSPARRRARSPRRALWGPGRRRDPAPGKGRVETVGSEPEFIPPQTPERPDDSRGSALGKPIVTAPVGVMRTASRGLEIRWSDVRVDPWHCDWNLVLPGCALACVHNGLLTRAGTWHPLPW

SEQ ID NO: 1012783 - protein, 216 aa, Homo sapiens
MKGKNTYSVWGLESYSSDMNRGKSHKLRRATLVPKGFDPGKVEPFAVSFGIALGNQEVPYINNGKSPKANVRRLPWGPKGHTEVILLSDLVGNDLKFSRQDSKIYTHVEAMEGSLTRVHSVWEVPPQIPNYMGHPEEAPVLWIHAYVGLLHNLAQFRFAECTLEKKVRFITGWGPFAVLRGTSRKTGKTHFPKCKGPSVPRGWDTTQHNRVESGSP

SEQ ID NO: 1012784 - protein, 269 aa, Homo sapiens
LGRTSGEPERKSHSLQRCDVGHCCLLLCAGVVASWEFPCLRVPAELCVNSFSGSFDFKSMDVVSTVRPYSTEAVPARACGRCAEQLEEDKRAHNNGNHTFDEVALNQFSDMSWAEDNIDKYLWSEPQNCSATKSNYRSRYVVPTHLPVDWREKKEISVSPVTKSGCHAAVAGLSPVTGALLTSADRHRNRDKMLSLCWNSKLVDMRPRTFNNHGCQGGLPRPGLRDISCTTRGSWREDTYPYQGKDGYCKFQPGKAIGFVQDVANITIY

SEQ ID NO: 1012785 - protein, 204 aa, Homo sapiens
RPQALAGSGTAGRVRGPHQDAEDGRGVSGTGQAAGDGMAVGMRSGEAIAHAERPLLSEPHRRYRLGEHWTVRCSGYETFSFHGTAFRMLLGGVQSVISSSQNILVVRDAVSSSCFSNGLGFGKSLLLHESQQPVQLWAGGMPAIQLPALLHMALKRTAQLVWPRCTSLPPCLLTSIPAGPRCSLWTSPGRGVHLLLEGHRPGLY

SEQ ID NO: 1012786 - protein, 230 aa, Homo sapiens
CTDEPWGPAHFEGIYDHGGAHYGRFHESPLFHMCLPEHLLWYSLLGYWVHGESPLVMSAGTLQANVSQDVSIITSNRSLEDDRGPCRLQCQTRLCYGLQSQNGEIWAALKVYAGTERAEAHRVWRYEYTGSKKEFPCVDGYLYDQKHMEKHCGDPDGTWSVTEKWLAMLSPAPIYVVESYWDGDLGYFSDRLDAGLVVVGHKQVTHVLVWPSSGVCSRLLAPSWLLAFFL

SEQ ID NO: 1012787 - protein, 113 aa, Homo sapiens
AAWSAKNVLSRSLETGLFLRQVREGSTLTMWLYLAGLLWSLYYPSAVGYPRMTARSRRATHQDKVCLYHRACDSGRLGEPACQTAGMHEACRVLAAMLVDGEGCAEPAEGPDV

SEQ ID NO: 1012788 - protein, 182 aa, Homo sapiens
MKPKGIEYEVLIILSYVPQYSQEAKERDDSVVAHIGLESPVECKWTSVKLRYVSTLLGSPGRFQDTQGLSHDQVLVQRTLIILGASYRSTYSAYNDDVVPILWDAHTEREVEATPGLPSLRDCIKDANFYLKWKSLCANPHKRETSSPRNAPCERLPCLVCGWFEVPVGWETGGAQPEFGWR

SEQ ID NO: 1012789 - protein, 197 aa, Homo sapiens
VTGKTYVSPSPGATRSDKAFYIVCVRERKDGSLGVLTQTVGPWPRPVAYFSKQLDGVFKGWPPCLRALAATALLVQEADKLTLGQNRNIKAPHAVVTLMNTKGHHWLMSARLTKYQSLLCENPRITTEVCNTLNPATLFPVSESPVEHDCVEVLDSVYSSRPDLRDQPWASVDWELYVDGSSFINPQGESICRAMRW

SEQ ID NO: 1012790 - protein, 209 aa, Homo sapiens
MFPEPLIPGAFLSARRLRPDSSRISHGPVPTAGPCAQQSVLGLQELSLYHSSLRVSCLIPEELSGGWTGQEEAEGPMPRSTFRTVNGAGPGVSIGPNGATLRTYDGTLEAYVTHSRRPGHACVGKTTHEARDDVQESRGLMTFHELAELLVGILANANWDWQPWILVAPRTPYVRVYLLPDQTEAVLRPTCIGSKLKPHFGETFAFKVP

SEQ ID NO: 1012791 - protein, 121 aa, Homo sapiens
MVALPLYAQVLQLSRGEGSSRVSCPCVPCSIRNPPARPGASAAVRAPVVLPTRLLPSLLSQTPESSFYHYLHALILITISQKPSDQHDNAITNLPMCQFLPKQMSPHLVLTRIAPTTDYPK

SEQ ID NO: 1012792 - protein, 225 aa, Homo sapiens
MHCWRGGELWANTMGGNLSNIRKSPDRSAAAHCVSRSPGQLGSGTRNRASDLSRQRYRMNSHPRLKCSQCGTWKHLVTKKTHRDVKHIVSELGESVSRQWVGCPGDVGILDSRSLCWRAYQISQANRPCEYVEYYYTELLNMGSAQTRGKANSDGSQDATWRGLGHNAVRIWQYLWDNNYSSIRDRSIETCTLVLGPWDCRWIHPFQELSETRVEKKGEDTLDTP

SEQ ID NO: 1012793 - protein, 246 aa, Homo sapiens
MLPKEDYFKLEYAIEAIKLCSTAIGYPDIRWCVPELWTKRITVPTDGSPSALMRIVEIDAHIGCALSGLIADAMTLIEKPELETQNHWFTYNVDNDSGECDPSCVQSGFAGLAEDTMHDPGAMSRTVRSSDYYLGGLLTAEQDPSMFHMDPSGTFVQCDARAHWLCFRGCPVAPCNEVYQQVYDFETEAIKSSLIILKQVMEEKLSGSNIELGTVQPGQNFHMFTIGKNLNEVITDISGILILRTS

SEQ ID NO: 1012794 - protein, 110 aa, Homo sapiens
MEDRRILGNGVLEVMQCIWLTNEKGVGDKCVMPGDKLQSPALCVETRVHAHMPDGLWVSRTRVRITLLKEIRKDLLKNVLVPHTCGDLTAGDLSPEVRMLTYMKPRALWS

SEQ ID NO: 1012795 - protein, 150 aa, Homo sapiens
TKRLQRRERCGHEGLDPGLRQAPPSLPPQWIMPRAAAAAVCGGESDWCGAASPAGRCRFHVTTQGVTRNDTTATEALWHYFSYQLRQPPRRLTAYLLQKLIETLKPFGVLEEEGGTAAALISNFWENYNNLVRESGIGVNRVKARIFHNL

SEQ ID NO: 1012796 - protein, 251 aa, Homo sapiens
AVAAVAGTGPGGMSDGGWRQLVGYSGPRGDGARDGVQGGSGGGTGARSGMPSESACWRRVLCCGVLEPASGPLLLCDPLVRLGSRHPWAILALAVSWEPPGPPGPGVRADKPVLAIQVLGTVKWFNVRNGYGFINRNDTKDKMSLFTRQLLKETSPGSFCAALEMGRLWNLMSWKERRAAEATNVTGPGGVPVKGSRLCPQTTVSSADSSPVLPQLTEQPLWQRSPRRGQDMTVKGSRAEELWQGADDGAP

SEQ ID NO: 1012797 - protein, 137 aa, Homo sapiens
MDPWALWTGNERVSESRTVAFPWASIHQPPCDAACKRRLWELQRSAMHGPVICPVLEDAHAGTRPLQASHCRLRLLRRAAWRAPRERIRGGALIIFDSRGPRPPGRPRTKLLRSRSYLTLQAALSSPLRRARIHRAA

SEQ ID NO: 1012798 - protein, 66 aa, Homo sapiens
RGHGSSAPACIAYLSLRISVIVVYAYAIFLCNKVGPKRPSFKPSPKPYSIVEHLKDSGNFEDLVNM

SEQ ID NO: 1012799 - protein, 138 aa, Homo sapiens
GGGSSNGAAWAALSHPSVRAMGRVRSRTLDCDLRAKESVKRTRPRRGVPGSVGQRWRTTIRPPPVPPAGPFKHGMPTCLLIRTGGGGGEMLGKTEPLGMQLRGGTGKKSTNSPLSLLACHVAIGTRRASKLHSLLKTA

SEQ ID NO: 1012800 - protein, 104 aa, Homo sapiens
KGKVLKCLRKEFLLIRLNTPPLPSLIYTIHLLSRLWLPREDSSKPCPIQVYMILNHKKMDSEIQFLQDGEGLNGSGWASGLPCTPPHAGQVLSMSLGVTAGPAC

SEQ ID NO: 1012801 - protein, 210 aa, Homo sapiens
RQSSAWDPGAVVLSLDGSAPVPSHYSSRALRSHQPSTISPYLGQDRCVCDWTVEERLPSGHPTANHQSFTPLLPLREDGIDARGPCERLIDKPAPLGPPEQSLHDPIAHLCGFDAYAMSSLHPQAATTRYPSCGKNGVRDLTAEKGLESNLWRNQCNCDEISQARNERGHCECAAECPGENHESTYMPGDHATILQKSWITADAAKGDLS

SEQ ID NO: 1012802 - protein, 101 aa, Homo sapiens
MSLSKPIMKKANQPQNGTNEQDIRTGLPVIHNSQIKYATKDITNTVYTYYLDKEWNIDTHAMLRFSNSVYSQQYVIDLGNRPLVGVTYWGKQVYILWLDLT

SEQ ID NO: 1012803 - protein, 135 aa, Homo sapiens
MTAVRLRESTEHHPCAQSGPGAQKLAKTSCSIFICIHAVLAYGMREPRPSREEAHAIQDRSEKALTRGKPGPDREVALLSDPRPPEGHGLLFQAACCCPIDLAENQGLGLAQGPHARESEHLLCGGLLLQTELLP

SEQ ID NO: 1012804 - protein, 77 aa, Homo sapiens
TGVMAAPKTVAVGPLVGAVVHDTNSTRLLVSIQKAAETTKSSQSGINTRVPKRRMGGTRTRNTKFFSSVYELYSENV

SEQ ID NO: 1012805 - protein, 181 aa, Homo sapiens
STLLQIVRKCAIRGVHCILSPTGLQCSFGGISVWPRDEDGGEWGICLLFSSIKMYAHFKLCVTRYLRAMTWSLTWVTLLSAWEGIDQVKVLSLLQCLIHNRLAPWSLRCQMVRTSNDEAMGPSSNNKKLSVLPMLNRGRTTDDSKINLIVKLFTPEYDPKTESQGVSSRSDLVEMRILRNL

SEQ ID NO: 1012806 - protein, 122 aa, Homo sapiens
MANRLLGRIEVLCFPLDLLEHSCQIFYQAEMVELDVIERRREVQKTHKSPGVADKTEGIIAEFSLRAQVDPVDKAGSGECWSISLETGTEQFDQGESPMERLSKVSQNEEKPVHMMSTLVYL

SEQ ID NO: 1012807 - protein, 117 aa, Homo sapiens
MTLGDTSAYFSHGGGQGVRMALKECYGCLGRGPCGPLLKNPTHAQRSSEKGWDGLRLGGTFQARLLFTEKSSTHGRQKNWRSTSWSAFGDNNAARFVYTGPLVLGKNPWAERSNLVR

SEQ ID NO: 1012808 - protein, 216 aa, Homo sapiens
MSWSVSSSVGSTDWQRYRSGLLQDGQPQVHIKHLETIDKSCPCLEPDTRSMKTSPRNRDHDLLLPSTKSKSPASVYESFRIQTWDRQVQDREDKSESSWFAQVQLLGKDKMSQDWRVCLRESRSQPPSAPSAEAIKSIQDMVGSARRRVMLTMITRQVHYTGAASGPQAAMYQQVCMRSRAEHPMAHNSEAEALPDLMSALVCKWGHNVVDRLRRP

SEQ ID NO: 1012809 - protein, 70 aa, Homo sapiens
SSPRRRYKCLLKYWVKNRHRSLQTVLGVFDCAKSTGSDDEQQSTIQVEANEVLIRTEFVFKPRKYCNPGR

SEQ ID NO: 1012810 - protein, 276 aa, Homo sapiens
MKLGNPQSFLDQEEAYDLSSVHGNQKVVEDLTPSAANATAVSFHDPRGPCSPALMSSSVLPTATTMQLVCCKGAHYVHSHGRLTQDNTGPLVLVTMKPALVELLFSSHSFQMTHQTPFGRDSQQACKERVGLTSIMSHTCPGVADCLRATLFWHRASYASVPCMSVDCTCFTVAEYRQRCLSLAPTVARVVGSEPWLAGTRCYGTVLSERGFRLRPILVALGAAVSPVQCYPSLGCSRVVQMSTLIDSPYRSKRQCLSHQSMTCTCFDRKGRTGGQ

SEQ ID NO: 1012811 - protein, 120 aa, Homo sapiens
MGLVGAGGQTVGAGAAQRLGLICKHMGGGRIGLVGAPNWTRLVNRETGGERPGRKAFGLSKTNHPSGVRHSRLGKRATSPERQAKETPPHRLTVDGTSVLWSPCPCCWKGPATVCGRHFG

SEQ ID NO: 1012812 - protein, 98 aa, Homo sapiens
MVVDYAVATLCTDCERCLNPSLVHDEMRITLRVCERLLHQRVGRYPTDVQVADDVKSINTRWICVQTRERLQLTSGTHSLVEDVQLNCSLRNVEQVNA

SEQ ID NO: 1012813 - protein, 67 aa, Homo sapiens
MSVIIPGSDGQIIEQDPHVFSHANNERQLVHQDGQNKNYGPGCGGPQAVIAKHLGKADAGWTGLRPR

SEQ ID NO: 1012814 - protein, 142 aa, Homo sapiens
RAGISRSRERGASTGRETGARLWGKCRMGGQGRSRGGGWGTIAGLAGQGPAHEAGGGERALLPGLGRRGPRRIVAAVGGGGRGAPLLPCGAGGRALDRLDDPSPPPHLPGQRFSASNQGHFYVHSLEAMGSPRPSEAATPVP

SEQ ID NO: 1012815 - protein, 238 aa, Homo sapiens
EPENGAGGPGPGVVGVEQHFIAAGVLGLRAQCRRHHGLPVGQAHGPGRLERCLILEGTIPLETRQPGRVTVNSLSEPRTSERRSRVLCQVVVTGHDGLPASRTATMSVTEGAAGHLAVRLRSTAGRKAKSVEDDTDGPTHLPCLGTWLQERYEYRQHLRQRGPSAELVQLLLTIARLWGIEVQPLKYHLRNVGERISARQAWTLDESHSARDQKSNEVMDPGTEPSWWYQNAVTGSDS

SEQ ID NO: 1012816 - protein, 126 aa, Homo sapiens
RRRRRRRETTTSTCSLGYTFPESIYIFIGNTDVNVTDELQKESSVKKMKHRFESNLEDSDRKPAYESKKKIKIRLHNCFSNPWQQTTHWILANNTKIFAGEVFRNWIDVKPPEQKWSGHGICFFNL

SEQ ID NO: 1012817 - protein, 206 aa, Homo sapiens
MDPGCPCPAPTVRGWSARGWGRRRASRATGLASMDVLAEANGTFALNLLKTLGKDNSKNVLILTLSMSCDPGPWSTWGQRESTGAQMGQILSFNKTVAVCGDIHQGFQSLLTEVNKTGTQYLLRMAKRLLRGKVSVISSHLSEIPARKCYQAADGGDLSFHQLPIGEVREQHYKRPGIARTRQKVENCGVGYLRGSVGSIDQGWYW

SEQ ID NO: 1012818 - protein, 203 aa, Homo sapiens
MVSLLDVHVRILPVPHYYKSREAQKRESEWALLGERGSSMRASKYHESVTVMRYESSPQENSSLLQRGNEREHCVYRRRACGTSRFTAYTVVKVCDRPVKRLGSSVDAHAYTMHWLGRGPVALDLGSRESIARLHTTYSYFSPKAPKFGSEVTSKIQRVAVKCKWHDANVPLSVAVVELVGNCLLLIARKHKRMMKEGPGESS

SEQ ID NO: 1012819 - protein, 191 aa, Homo sapiens
GVGRMGSGRRPHVHSREGLGGRSGKEWEKELGPGIPAPEDILRTRGTVTHAEMSAQDGGWLMELAHAAVLLQSGAPEAAVGEGQDAVRAVSGQGSLGVKSLESSSSYNSETPSTPDDVLNFLEHLLPTGPVLRVGPTDACRGGPPCCGQIGGGLSTHCQIARTRSPGPTEDPVRTLAGHLKPEGTRALKEV

SEQ ID NO: 1012820 - protein, 75 aa, Homo sapiens
MNRESNPNSRIAEDHEFVILRECVFSHEHRTPEQYPARNAGRFLDRTAGSPYGLALAQIPLIILTAEGRESLLLD

SEQ ID NO: 1012821 - protein, 76 aa, Homo sapiens
PSRCPRIPLVRARRRYVRGRSSRGGELPAPGDAVSRIRRPSETLTILVIDSSYTDRRLLGYTFFIGAKTLASCCCS

SEQ ID NO: 1012822 - protein, 86 aa, Homo sapiens
GFSIQVLEFLVPGAPHLAERSLSLRHDASSGRLAGHAFRGLEDYEVLVHRLAQAPIGRLPEDRGGMSDAQDISLERTCTMAPVTRS

SEQ ID NO: 1012823 - protein, 211 aa, Homo sapiens
AGLGGAAGLDGGSCGHLAGFAGFSGNKATGDSHYVFRNRSAPLSAPQMDLAAFLATADWAPGARSAPAGPAWALGGGRASAPFPLPPRWRRTPVLVCACQAGPFPPVTGGSLSPPFVSEQAGPAYSVCQLSSRMSPSILGKGRVGQTRGSVFLPRRPSLLAPGPSEAAVMAQPARFREFPKRGPLHAEFALSRDGDSPRTLLTAHSGLQRV

SEQ ID NO: 1012824 - protein, 133 aa, Homo sapiens
FCQLYTDPPQESYTSYHSPGRHHCNLMIDIQKDTAVEGEEIEVNCTAMAQPQPDSQTIRVRTGNHRAKRQIGGGKSGSDMYTVTSQLMLKVHKEDDGVPVICQVEQLLRVTGNLQTQRVSREYRYKPQVHMSD

SEQ ID NO: 1012825 - protein, 153 aa, Homo sapiens
FGLLYICFFCFNFLKHITSGGVLCSARPRGRKSLPARDGGFTLEDIYMLRRKDRGSTSSALACDLLPGHGVVPQEPHGQLPPHEACVELGPSECSAYTPGYAWQAMQPKSILFLELSSCGYLADETSLAGPACLPEQGLAEAKVFQLPTSYQT

SEQ ID NO: 1012826 - protein, 249 aa, Homo sapiens
MQRSWAVLRTRLAYSLPVAGPAGAGAWVRALPVGGWRGAAAWAWKTRRRPALGRRGNGQRRAPEAGADGLSLRGAGSPARGGSGSSARSLRAAHWASLAGVRRRRRWRQLPDPAASAVGYDQRHGSPRSGRSDPRPVPGRLRWAAPVQRFQPRLPGLRPGAYADFLPARLPCPRPLAPRSLAGPAPFPLPELPIAPGREGRPKARPELAAWRRSPGEAELGGSEARNGAGLLRHLLKCGLASTGPQQGF

SEQ ID NO: 1012827 - protein, 109 aa, Homo sapiens
MTNRHELKAVVPSYLARETGHHQQEFHPFNRVFQEIVRTIVMDPYFITRSKARAYRVEVSVYMSVEALEYCGLLHRFTVRGPSNSNELIALIRTGSHWSRRFIDARLLT

SEQ ID NO: 1012828 - protein, 73 aa, Homo sapiens
WYGPEFLDDPRLQPPGPGGALRCRSLGCLLLSRSAMSSEVRPPGRGGASEARPSRFLPDACRPAPASSARLFS

SEQ ID NO: 1012829 - protein, 258 aa, Homo sapiens
MTKTDWPCTDRRYPATHRSTTYHNDHLLVPWGPTYESVEVTTRASVHEPRGVSFVLAAAWMSYLLAFSLVAKRGQPGRGSMGNWSMFTWCFVLRPGPLIILIVELCGLQARLPPVLGANSPSAFALLQRSLLLASTDLQSSTPAPMYQYPVATDTIAETTPSPGNFFSCIACVAYATEVDWSRAQAGEITGYMDTVPGLLKVLETFGCLHHLSRFNHVTPKLVPWQQDEPLDVGYGAKEIRPYAFNPKRSTSQTIAEN

SEQ ID NO: 1012830 - protein, 110 aa, Homo sapiens
FRPVPMDALGKLKQFDAYPKIGEDFLGQDLSGAPACTIVSGLLDAATCVLSDAAVLRSPRRVHAELYVDKSRGDKLKINYLMYFFRNMPCAYLSIDAMDVAGESACWMWN

SEQ ID NO: 1012831 - protein, 115 aa, Homo sapiens
GTSEDAVWPEYRLRTVLQSCLRHTAMGCTQESWLCDIRARYCLASQAKRPFYMLREEDISPNRSLGIGDVSKHITRRSPAPYAAGVTPFSLLGSDKPKSFLIHPFSHPRSQGLIL

SEQ ID NO: 1012832 - protein, 111 aa, Homo sapiens
MCLLQYKRIPIADGLIDRSLPGFDWCLCENNKIVYPNVRPISLKNSLYVGALVMDIRATLYAVTLIDIYVNRLRGVSYCTTHECIYVMMMLNMVHYFIWDQRIAASHSALE

SEQ ID NO: 1012833 - protein, 190 aa, Homo sapiens
MAANAEPERASAAIRPTCGWLTSEVPDRLGSLYLCKATDNDIRVAVQRGEVAWSEMVESSSTQVGQTVMYAVLSRDEGPQALDCPKFVLINWTGEWRLTDVLEGSLCQARSFSQADGQLPERGPMLTINRYGLEEDVRDHEVHHGMKCGLTVFRMPTSSFHNGEWRFRGRGDLPWPHVWLCVPEGPFARV

SEQ ID NO: 1012834 - protein, 118 aa, Homo sapiens
MSSWSVSSECLDEKEEVLLDRPTLPAGKGLVRFLVTALGHRSSHSSPKDVVSKLQESWSASRGWPRMSERLPQSCNASGGPDELSNRRGGPGAPFHHPESGCRRCCALTGLHWLSCSW

SEQ ID NO: 1012835 - protein, 144 aa, Homo sapiens
MASEKPLAAVTCTAPVNIAVIKYWGKRDEELVLPINSSLAVTLHQDQLKTTYNRPSSAKDFTMDRYLAEWPGGRMWGEPRLLGRACGEIRCLAQKRSESRAVMGTRVPSMPQLLKVHAVIVVNNVPHRAVGALASLSVRGYALP

SEQ ID NO: 1012836 - protein, 124 aa, Homo sapiens
MQKEGSSSRGRAKKQYHSKDYTEGWVEFRDKRIAKSVAASLHNIAYGYPQVQSPPIMTYGISSTCTISPGPTTASTLPLSARCAHRQHLRVEVTQAKCETIFYLQSVQWGQCFLAVDGDLAHPD

SEQ ID NO: 1012837 - protein, 102 aa, Homo sapiens
MKWQYCRASVTQSGAPNLWQNCPDCVGKPCGNRKPLSSHGLPPCQPPSKGAWQNLSSNHFVTVPPASLTTSRPKAFSGKHPPVWRTCSDTSSGVGMHLFALV

SEQ ID NO: 1012838 - protein, 41 aa, Homo sapiens
EESGYESVLCVKPDVHVYRIPPRATNRGYRAAEWQLDQPSW

SEQ ID NO: 1012839 - protein, 248 aa, Homo sapiens
QRPSQHTTPQTLGSRSLLISEAGQAWSAGQTCQGALGRATPTPKQLPVDAPPECLPDPLEAEDEEEDYDAVGCVINSFIPQRVARTSRERLTMRNLVQRSVAVSDGPELHETMYAHLDVDLTNGHLASCRHFMRPIIRIMLAAIPSHYKRNAQVIGLNMTRQRDTHTDVRPSIAHLEHKFSTPLQQRTVSRSHRNPLARSNSWRPGLSLRRYRGSPLSDGNIPFGPLQHTNPAEAHQGISVITAMKPQ

SEQ ID NO: 1012840 - protein, 297 aa, Homo sapiens
SGPVYLKAFPPQATLADLPQNGGDGETKAQSKVPLMVPGLSPSRPRNRPYLPAEDGRAVPLDRPSSARMATTESHLTRLTHECTLRFALVIVQGRGNLAATKLFRGNESTIVQTTEWNSTLRHDRYMGKCMAQEVCLNLKLDNHVSPVSHWSAPFSQYVTMNRYKNNCAGPSSDQLSSLLRGMSTDKGIHKVQTRPLIFGHGLTIMNSISPCTHLYHRKGEIFNREEGANAPRTPILPWGFRRTYQENKRRSHQTHGKSSNTNGAWTAPGEKPVRPHASLKHFPRCTWEKDETHMGA

SEQ ID NO: 1012841 - protein, 152 aa, Homo sapiens
MLVSTLRGTPQPTQCRTCDGAASIIDAQFISTGCVVKKLFLGGHRRGRIDDLDDQIDDKRETNARFEYPSNSQTVCSQSRLLLVPYRKSHYYIRCNTHDKSSISCKTAAMKTTVSVGSYKLQILAVTVTPSCIVLDPARRLTERRTGLFAGL

SEQ ID NO: 1012842 - protein, 124 aa, Homo sapiens
RSLCREASDAGGSPAPSTPSAFTLLLRAAFQSLLDAQADEAVLGKPLGSARSWILPGLEGLAREKRSRRSEKGKAPGRGSLRCFALRSVTECWRTWLCQDSERDSEHCFVPHLGTCIDANSIVT

SEQ ID NO: 1012843 - protein, 82 aa, Homo sapiens
TTICQLLSSVIGHGAVATSAFSVSDGSEWRSCCAVDAAVLGLLQAGGSVLGQAMEKVTGGNLLVHSCWIAMQPFTTHVLVIP

SEQ ID NO: 1012844 - protein, 104 aa, Homo sapiens
MSEMLRGMYGILKPYSWPVLKSKWSWVFCVFICYICACLYPAVSPGAGTGCMLWLVHDPAGVWGACEGGGETGMPVQCAWCSPELGPVGLDSDATGPSAELFRM

SEQ ID NO: 1012845 - protein, 269 aa, Homo sapiens
LPSTYHTHIPDPSRRSVAVEQDSQSRTHFPRPSPIPPSLLPDPRLANLKSRRSYYDSSATYRQTFGLSSLTISLYNNVCVDKGSSSELRGYISLCLDPITMPQLLIQQFLQIRTQHFPPLTLPTAWRFTPRMSVWSCGMVKDGCPCVVIEGVSFGAAGGTELPGSMCCVLSSMQVGWVQRLSHFACLKAPEPLGPADQIRAGSISSRSPTVGESSDEEPVESRAQRLRRTGLQKVQSLRRALSGRKGPARATVHPVKAARLGAGRSAEA

SEQ ID NO: 1012846 - protein, 137 aa, Homo sapiens
TSVTRTTVVVSRQGERRTNWSVKKSEVEVRRLGPEENLVWSPACIIYVMEESGVQGTRYSTRPGASHPWPSQPEPRPSGRLMRQTVGACEVGMGLEKTKAAETIYVTQEHATGSRHRAHEGQGTTAEHCAQQVLSLC

SEQ ID NO: 1012847 - protein, 247 aa, Homo sapiens
MPAPATMWELVDSLAAYREAYVFRPKRRCPELPMYAQRASVSHVPPLVGEPCHSFPQTWPYAVTTSSSMQIKIVAPIYSVRMGTKTYSDESVTMQLAKEVLIKKGKDLLLERPQHGNSETVASNNRKGIAFADLVHTGQLHRRLEMATFALFKDGDQKLEKIICQESQYIAVICWTNQNGQSIDISFPVFVAVTTCHLLDLLQYRSYKNGDPELTVIQNDNEGLHRQAEHRQPGGPSPLVDDLPQQN

SEQ ID NO: 1012848 - protein, 69 aa, Homo sapiens
GPRAPAWGHCCTARTSSPPRPCQRRFPGSRAVSHKHHAVHSDATRYYSRQTDDNMNHSITRTKHTKLRP

SEQ ID NO: 1012849 - protein, 250 aa, Homo sapiens
MLPALYVDARSKLKTRKCDDKYACNIHTYNYQYVMTSLETLLDQDKDTGDQRHPEKPQRRRHVSFPSFEFGGPYRYVMDGRRVTEDMLTLRTHKSWVSRMAWAILFCINLDTKLCLLIDDHPVSIYLRVLRNHTGQVNHQIKITAHKRKDNKVERRTLSGGTPLDKNGLDFTPNFQPVAPSENKFTRLTNRLLIYQSSKRMKHGYTQYPTLALPEQHTIVHPNGRSSKGGYRTGGCPSEWSGRLLTREIH

SEQ ID NO: 1012850 - protein, 248 aa, Homo sapiens
LRAVDYLSREVVRNSTLFAGSSNAPWSHVDVVSTGAGTTGLIEAAVKMLGVPGVEEKMHWLPLVLLRLLRSPMLRGHGGASWPECDYLGVSGSLHVAEGSHRGAPLEHRRHLFSETVEAATRRGAQGRDASIPNCLDGLPLVGRLPGPEETLPRTGQLETGSPAGPDMGNVQHWYRKTLVRSIATATSTVQQGCTDLVGKVPRGQQYCKDSQAGLTVTKGAECAHGKATDWAGHTALYGGTADSRNHK

SEQ ID NO: 1012851 - protein, 354 aa, Homo sapiens
RGGGCRDPSSVSRHVSGGGGNRWDETGGRSVVLHSRPTMLCEQQNGAFLQGRKSTAGPRRGHSNALLRSVATRGQHSGKWPRGAVCLRESGDMEDQEDIDCALTSCPDNEVLVTRQSGIAAGSVGPVQCGHAFPGCRMASNTNRDPVGAAIGSSNLLGFLSTCYGPQGGLVIVGPVRCLRTVAAATSGTTPVAGGLDTGCSDGTLGETFHTGSPTTDLSASCVPRAHGIAAHPSCGHVLGSRSCRGLVLERVHYQRPSPSLGASGRPTGTPCVKLPGTGEPKHTVIQSGGTFSEKTGQGVQRKGTGGPGGYGKSAVKAWLLLVAQEAKARLGPSVGVSSSPKGSVRFLNRPGGT

SEQ ID NO: 1012852 - protein, 120 aa, Homo sapiens
LYRGLRVSSMASAGLSPGGGVAAVPGGTFQPYLDTLRQDAAADGPNAVVRSGGGSGGAADASLLEVNPEHKERVRELVLHCEAFVIPGKTLLFVRLLTGLYQRHVRRPLLTAVLYSMSQQ

SEQ ID NO: 1012853 - protein, 305 aa, Homo sapiens
MQLHGARAKDIHGQRWMQGAEPVSTSRSTESDRMCLVLTIGADTALEGGCYRYPQCVQYRSVQKAHEDAPAGSGGGIAEAAEASEENMQKAQGFLGPITPSWKVHSNTSRPENDASGGHEQIPLTIRMLKPPKLEVTRHSHLAQETPSEAIGNSPRSNVVKRLRLPPRSPQDLSEMAKVTCPGKALTRQEKRSHQEEFLIPGKHEGTDNERREAEPSSRHPRKLAKHQREAQGNKKPTEQTQAAKHTKPRKDNGTDRKKGRTHTMTNTDATTRNHQPNRQRNKRRKRNTKLEGGRKTEGTKKQQE

SEQ ID NO: 1012854 - protein, 96 aa, Homo sapiens
RVAALRGEMATGTDHVVGLGLVAVSLSHLHLLQGLGDFSWCVILPVLLLTFPEPWHRQSNYYIGSRQRRWLHCLPHLLNSPEQLYEEDASGTAFYR

SEQ ID NO: 1012855 - protein, 212 aa, Homo sapiens
MQLTPDGVPAFLQEANEVRVQIGVVRRLLTYCKRIRCMQMHGLTARDSTRHLKERCDFIVFAEATGRVRVIEHWTDVASSNARPSRRTHLVGRAACSDFDQNYLASDYMGPASGWPKKGVEPFHRASENGIAEHLAHRPELHPGGRGIEVRPESWDKKTEKRSRAERIGGTPLNKPEIWLGTGLKGSSQGALLSFDDLPRGTCEQRYWLDNL

SEQ ID NO: 1012856 - protein, 298 aa, Homo sapiens
GCCRYWTRRDERGGVRQRGLQRSPRRRCPRRRQSVVAVVVPVPAGEPARKCGCVAWLAGGVLEPASCAPHAGTPSAAWCSLHPLAILADWRSRGTPRPPPAPGVSADKPVLTIQVLGHVSNWFNRPDMVTDSSTGIDTKEDVFVHQDSYLKETTPGRYLRRRREIGGELLENLMFGGSGEQCGCRKANIKCKLGTWRRAYPMKGGMSVICTTKRNGKIRGENLQIHPRKINQRQRRLAHKSRATIRGSGKEESHSNTRSRRDTKRSTMRQRINRGEKHRGRKKTDIIRDNRSHHRYYN

SEQ ID NO: 1012857 - protein, 385 aa, Homo sapiens
MERPWKRPLWSDSVSFKNMEEGRVCRRNFSRCSVLSVTCLPTDPCPEPTRPAMSSVSLQPEALPTWLSAEVKNQAGPEVLTSQLGAGADESGSECVVDTCRLHRQQLHGRPSTDGIILCEFINNAAGQCSVKEDAMSQPKIGTRLENIGNYIEGQYTKYGVKPLRHMMSANNLYENNYTYTGASTTTTWALDQTMANDANGTQRCTREQVALLPETIVSAAWHIRFSLVKPKHDHWSGNESIVCMPDYGQPNYCCAQYQALGNEERDKYEAKHENGQKPLIRNNAKSTLEHNGTDEASVKHREDTSAGSVHQLRQRRTKMIAKNSAVDIYCTQGNDKSGNEIFTDRPWRYSRHNGMAQCIKMSPGFHTMWQDRDEQNKSASTRDR

SEQ ID NO: 1012858 - protein, 198 aa, Homo sapiens
MNFLAVKLPALWLTQCVRAAAEQSAECCFPAQCSCNRHGMWPLANVPAPGPHEHGTGYTWGTAPQAGETRTLGRGSSAPNRMLSFSDCPAVQSSPTVMILPVTHTEISPEQVTGHVLLLVRGVALRKDIGSPDARPGTGLLTLQRLRKLLRLRSARGGEASGPPYVKRGQAESNKVLHQPVLTPVRRVPGLPGRGCGD

SEQ ID NO: 1012859 - protein, 106 aa, Homo sapiens
MGKLNEGNEAGHYLRMRRLDHAKGTFLGTQEKSNSGKVYNTFWNGIRGMHFTIGCDRNLGEQTISTRTTHLKGGVRRRSPHDESPASILPEQKCNVILKVNRAKKQ

SEQ ID NO: 1012860 - protein, 145 aa, Homo sapiens
MAALRFERSLERPLGTMRFIMRTVLPFVHRTVGDTVCSVSSDLFVFCTRWLMLHVSRERRLPGGLHLDGNAASCHHAHTKEGCSPYGRDVETRRRRGRPERRQHRRLVRRLPHYFMETHPQEGSGDDKPVYSTHRVMGEPNRTPK

SEQ ID NO: 1012861 - protein, 183 aa, Homo sapiens
GKGLQSRVVQCMHKVTVRLRRASAPPSRSLPPTDSATRRSATTRINANYHLPPPDRCCSAPINMRHEYHVDAYIVRVYSEKIEPLARHMRVASQQLLGMTLTGSIHTVQTESVASRIRRSSLTQQLPEGSAHKSQYFEVLEEPTRCALMHSPGACGPSPHSPVGAHKESNCHRDMRRGLGVRH

SEQ ID NO: 1012862 - protein, 162 aa, Homo sapiens
MPGSRSDPGLQPLPPPLPAPSARLRCCRSGGCAAGALSAGHVLAWPACGPGSCCLRWLEWLLSEPVSAGCKLLANWRSTRTARRGVSRARARRCSSTGPGCSSGSLLWIGPQAPSPLLGLAVNVVTTLVLISYCPTCTEEAPYWTYLLCALGTFYLPVTGCY

SEQ ID NO: 1012863 - protein, 107 aa, Homo sapiens
MSVAVLPHLAQLAGQCVTECHPSREGGPAEVRSIRFVPQTWESILCSERWHEVLVHGIADEGGGHKTSACVFRIHAAWQPRRLGMAGRCAGPFVVITSESHAQQDAH

SEQ ID NO: 1012864 - protein, 124 aa, Homo sapiens
RPSRGLRESGVGLSALPHCGRPLGGGAFSPPGGGVFLTNAFGLPGGLRPFPCLPWTLAPNCCGSCAGRGFTTTPGRELRVGVRCLRPERGGPAGRTAGEGRGFEPLPCSAPLTAGRRGHTVPCV

SEQ ID NO: 1012865 - protein, 152 aa, Homo sapiens
MSRARSHLRAALFLAAASARGVTTPVFGCGGGAFWKGTLGPGFLGGPPLGCVLCPLAQRGLNGPPRNGPTLGRFSPNGGTLSQDGLAYCPSNVNPLCPMKHRVALVLLLSKGESRPKSVGLIPFKNQQFWNAQWGHLLPLDRNVVGFASVGT

SEQ ID NO: 1012866 - protein, 34 aa, Homo sapiens
MGSRGFGQAKPNETWGKTISGSDKGLGRNKHAFI

SEQ ID NO: 1012867 - protein, 196 aa, Homo sapiens
RQQRKRVSYSPPGPGTPESKKATSCFPAPLTPPENLDQFCPTKAGGSLGPKKVTPKQAPKPFKPVWKGGAPEQHAQTRATSFARPSPLPLYTPTVPFETPVAPKFEVARSRHLPFKCRRTPKEEQAYGRHHSAFPVRVCVDAPSHANRAPLFQMGLSPHKSILRQLVGKTLLYHEFSFPFDPILAQTLAPSKFRKS

SEQ ID NO: 1012868 - protein, 38 aa, Homo sapiens
TRGSLDVWGCFCPPVLQRSRFQPWRAPKDGDGFQKGKT

SEQ ID NO: 1012869 - protein, 127 aa, Homo sapiens
FRTTVRLVRWGARGRRAAPGPLVLGPPAQGPGSPASPPRAAQLRRLPPGKPWYSGGSPGFSPGLRSRQTPQSSLSSSVLDVPLGPSRVYRLSPRAPLALCSRPTLLFLPRAPPPSGLTVWTAGVSSL

SEQ ID NO: 1012870 - protein, 132 aa, Homo sapiens
RRRGEFVLRTCTGLAHVPAGLAPRVPAGLGRGDSGSRCPSVRCAGLGKAPPPSRLLRPPRRNVSPISLSGSGGVHLRRIFEALGAGSNENPLPCWIVRSQESLNGANFAFVKPIAPSDLQFRKGEYFLDNCV

SEQ ID NO: 1012871 - protein, 142 aa, Homo sapiens
EQRGPDRAPSSVPVPRDVAHVPEAAGPVPCAWPPQRAVLASPRSVRGGPKPPGRGGARASGGAAGPAPGMPPGKVLQPVLNDEVVDELFLYWLSEASTQRMLQDCLRRIKAPGRDQPTPGDGEQPGAWHTDQSTNKDKRSRT

SEQ ID NO: 1012872 - protein, 72 aa, Homo sapiens
MLLAECGLCLGANWERRYIRFDTFRFLLFLLKASVVNPTLTRSLKLVPNPWFQGADTDTAMVDLSPKANFLA

SEQ ID NO: 1012873 - protein, 261 aa, Homo sapiens
MQDERSQCKVVCTRVHEQGPHGYEHNLCKVEKQLVLHMARQERGKTHTMGGDLVWEKPRNASKGIYAMDSRDVFLLKNQARAYRKLGLEDLCDITSRSTMGSCETLINKKAKLRDAGGRQATGARGRGLTRSIWLHQTDDSHQEMIDMGSAQQKHLGKTSAKVPKSITRNPRVHSKSTATETKGRNAMDTDTAKDQTQAREMTRDRRNTIARMAWTRVRTPDNGREKDSSNTEASKPPVRKRHRGDHKATGNKVQTRERET

SEQ ID NO: 1012874 - protein, 47 aa, Homo sapiens
MLIVSCRLNPVPEQFHPSWSKLSILIIMHPDKAFRESARCRVLDQEP

SEQ ID NO: 1012875 - protein, 147 aa, Homo sapiens
GGKAASTLMSHDEDRRSRKEGGFPGTTWPDMSRSQVDQKPQGLPLQIPCVEPNIVGCSPASCREMGSAPGCRAGAPDATTQGAQHHWSHPRGHHTRYIAVMATVADDTRHVDTTVRTTREERDSWFDRKAKDATHSSRRDTDSHGPS

SEQ ID NO: 1012876 - protein, 116 aa, Homo sapiens
MAISWGLDASADCSLQRFHVHANIEGYVTDWNSYSDDTPEVNTNSSSILALMGASACGNLKNLPQVEALQGWLMGLPESCFLDPSGRQGISSNLVNLHQKQLRDILLPPKSRCPAP

SEQ ID NO: 1012877 - protein, 80 aa, Homo sapiens
EPTNDTKHLPGRPGVVEAPAAPPPPRKDAYRECVMLGAVTRTVRFLTAQQHDATLWIPGRVPDGFWEGASSFLPPRSRAL

SEQ ID NO: 1012878 - protein, 415 aa, Homo sapiens
MGVFLTESDSIGGCESMEPRCTVPAWSYHCPLALCSPVVHETTDPHEQHELDPTRDDAIMAGLQACSLACSSDAMGVHRTILNGPQGAGLTLPGLAECRQMSHRFLEAAAWSHQGCSHGWAFADKDEAKGSAAKTIHAEDKPWSGREQWAKSLLSLKGYPNATFETHGADQRTRHTRDPRCWRNRGDIIMPTTKALRVHARHWGVNVPDMASGAAPPGESSLPVGALLSMASGHDHAHWERPSGPMLLPFGNLHRDCASLGDPFWVFTHRGIDLGPCAITKALPSLVWRIRYTPSECVLALVPGRGLSARWSTPFGVCRAFIRASLLSHLGGFVWNRVVGDALRTITQRPRPPKPSQLRGPRVIQTQSSLGRPKCGSIVQAHKGDNLRNARRSTVPIFRGATGKDPPTRGGPPRV

SEQ ID NO: 1012879 - protein, 220 aa, Homo sapiens
GSAGRNPALLGPGRIRIRPPDRVLSAEVTQLGQRQAHAALQAAASVSARPCPQRLRSPALTPSPVRHRALPRLLDADTDAATAASDVATAASDVAQSRGKSFRPRPQLSDGPASAPTTPLDSPAPSASGSLTSGLGPRVGNCRARKRWAYLWLIFSTVAQTVARSQLTAAPGCRAPKVLGLQQHRGCDVWCSCERGAGRGRLLAQCLDDGGGKTLLWVRS

SEQ ID NO: 1012880 - protein, 217 aa, Homo sapiens
MGATIHERRRPPPSGLQPGPVAPRHLATNLNAQPPPGKRPCPPARLGRPALRHKSTGSARCPAGRGVPVPSLLSAPPCGDGCEPARESLAPQAAPPNPAAATLRDGARGAKPLPRSRPRQAPPANRKQVQRAPQTMRSSHLEHPKGHNAQDGDRTEGDTAERFKGTSKTSRQPFIRNMTAGPGEETRTGPRGGQHMEYTIEYQQDNTRKQSDRSAER

SEQ ID NO: 1012881 - protein, 37 aa, Homo sapiens
MVGHKNLPIQREILETGPPGGTILYKHLRARVLQGGV

SEQ ID NO: 1012882 - protein, 89 aa, Homo sapiens
MSWLGAPDAPGTPPASLFPRPSEDEACSRGVMWRDRRRCPAGPPSVCGVSPERGGSDVPSAGEGSILSGCEPTLCPLFSYFVLFLPHMW

SEQ ID NO: 1012883 - protein, 58 aa, Homo sapiens
QCTLDIGIGPRLVASRRHGLGLAGCGARLPGGSGLQSAPAPLACGADPRSYRSVRECP

SEQ ID NO: 1012884 - protein, 219 aa, Homo sapiens
GAERDRASRGCAWARAARAVTRARGRERHGFAGALRAAMRAGAGGPARGGALRLLDSSNRLISAGRTPAPAVPPARGARRRPLRPDLLLFATPQAPRTTTSAPGPRSATAVKRRLDLETDHQYLARAMGQLGAEAAIQWTGVNIPGVEVNAMRPHWNLTNKRFLELLSHSTDRCRPTELGCEGSRNVQKRAPSINHNVLEGHTINAKKSKNKSSEEVSK

SEQ ID NO: 1012885 - protein, 102 aa, Homo sapiens
MTLVEEASGGQHAQMALSYREVRECRSEQHLVRFTSSARVYSDYLQTILKELQIGRDTPPDLCHHELPASGTSPGMVRKSWRSYLENLEKPVQCLGQDAGRV

SEQ ID NO: 1012886 - protein, 136 aa, Homo sapiens
ACLLSYASSGSTDPRIWCNGWLALGRLVTVVGSVRPPVPKPAFSVPPPCAQVAASHELDAPWESDVASQQEQTPEKPSLNSYPRHMNVLSDPIEKEMFMTKAESRQLKKEAQADPASLHPWTSLTMYYWCVVDRPG

SEQ ID NO: 1012887 - protein, 207 aa, Homo sapiens
MPGPGGGVGEAEELSAWGRLGVVSAEEDALWDANRRAFRHSVWLCALIARSKSHAVSAPLPGHRGAGARMEVLSTYRFPWRVNRDRGRLMDILRCRWQEGLVRPSWKALEFVLAPNTSRCSLGRGTRALALRPMILDEEWAVGPDPNSVDDERCDWLAGKLCKSQLQLVSSNCSARGRVLEEERAGLEQRLQGPAAGSGALTKAAGG

SEQ ID NO: 1012888 - protein, 218 aa, Homo sapiens
EGCIKNNTPWKQYFPLAETDQKHKTRNPRDAARRGEKTRVDWDDHWVDEESIEKQTVPSAVYGKKRADEEDMVTYGLVIWPLPFSGTNSDCQFCEQRTVFILTCIMRATWRDSSICPWKNLADTGKSARREVTTRIYSHGVHQGKQTDCLPSWIVMALVDGSELSDDKLEMRGRDTDRKSILLWWNQFFCRPRCPWFLQQLNKVISEEKPLTFLTLWG

SEQ ID NO: 1012889 - protein, 119 aa, Homo sapiens
MHAAKHGWSEQRFFSPDERRSFTTTVGKRTAAPPGEENKREEKADYKKECQYARKKNSDVKIGSFFMGEEPEQEKEKTKGDLLSDPEELLKKESGLFTKQRFNFSHREENASYVKMYIE

SEQ ID NO: 1012890 - protein, 191 aa, Homo sapiens
PRCWLEKLVEEFEMKEDEPWYEHLRTSSKIFNLLLSLEKTLLDGTQSWMDSVQRDVYNQFRSSLHGISRYLTKQVGTFYWLGMTRTRQCKWFMTRSYDDQQAQGTGKRTNVNKLVCVTSKVPQHVETVFVQPGTEQRVGIAMPKRKRVRSSTPKRPKGAMASIGKSIFGRMVHERKPEGNVVDTKWRKILS

SEQ ID NO: 1012891 - protein, 69 aa, Homo sapiens
ETSRTPKCGENNLLFTGAWPAGCSTRNWQNDVNREVRQISVHCKLAKEIRPQTRESCFGTVNYSSFETV

SEQ ID NO: 1012892 - protein, 205 aa, Homo sapiens
MVSRAQSGVKIPGLCAKLATAASCVPPCAEWLAGLPWALCALWLECCLLNVFRKSGCHLWHCSDDRITRCPTCETVIRSKCLSLTRYLGTLRVDLTPLSELSIRRGIYVANRRRPQVGQSPVGKYASERNAEDDSPFNVPRANDIGKASSVMGNTKEKVALEVVHEEKRFVATRSATRISHKVLDSLEPTVRRKAYPFPLALPWR

SEQ ID NO: 1012893 - protein, 148 aa, Homo sapiens
FKWVKQQCEFDKTSPRTQYQGPKLDLGFKEGQTIKLNIANMKKKEEQLGIPESGPASTGRAEPAYHPSPQGGKPPHLIPPPGGDSVSCERGIPRYQNRQLIPVQEVHPVPLDHRPILTLLTSGETYTKLYRIKLTEQNQHRTQAGSRY

SEQ ID NO: 1012894 - protein, 198 aa, Homo sapiens
RRCQEGAEGKTRISTGWEAARGGQRGGSLASVPGARALADAVVTSGTPGPEARPGGTRTPPVSPRAWQASGRVSGAEEDGEEPRPARQRPRREAGAGGRASGRRTWVMESPKSNKRGRAGHSRSPRSSTQCNGCSRAGRGGGARHERRLRKWPAVGCGSRVVGNPTAVTLVTREGPLPPWSPFGRRLGSALVTPSKVP

SEQ ID NO: 1012895 - protein, 264 aa, Homo sapiens
GRALHWPRVPTAPYSFRALTRVPGPRAVMEWSASWCLSLRLGPSTVPGTPEVPLAVGPASRLSPAPLYSTTRREAEENQDHLSRWVGPGSREVAPSVRRSCTKYALHHNLSTVGPPCASRRVTAQGYRPRGAKRQAWARATTPLATGTRGAQPTRLTPTSAHEPTPGTGGTPFGPSPSTRQHAPQQGQKHDPHNHATPDPATTLTNDPRAHRSGPRNTPPIENETCDRSDEPHNTAPMGPGTRKAQQTYRPQRSRTTQVGNDAT

SEQ ID NO: 1012896 - protein, 85 aa, Homo sapiens
VEFYCQSARGVDSPSATEDYLPDQEPVEENFLQKTQDQKDTSLGSLCISHRASDLELQLLGGRDNLQVKCMYQCTPWKSHLAFSR

SEQ ID NO: 1012897 - protein, 194 aa, Homo sapiens
MAALRLLASVRGRGVPAGGSGLGLSHGCARCFAPVPGSVQVLQRTRWMMVKDISDGATCHDRWLRALRDPLRTCSPAVRTRVKDLQVCQAATVGCGRTSGWAYLLAARQVLRIVCSYVGENTLCESQYLAGELELELTPQAPWPSASRAGGAGVPAFYIPARCYGNPGPVKGAPALSAKPPEGHLALMEPSPMR

SEQ ID NO: 1012898 - protein, 206 aa, Homo sapiens
MRRREPYREFIAKARTTHDRIARGIYCVHEEARLCRAVCFLWVDVERVLRPALACKCRKDTIALRRPSRCAQLKLPQRASSCLARTHSVRHVAELPQANNSTYLAWLPPLRKQLFDSKETRTQYTPVPTLSVGHRLSRYNLPPPLGTLAHFHTTRGRSRMDPTPSTQTWRPHLANLRSKGVGRNDFPLPRDSNSTAARQTLLGNLG

SEQ ID NO: 1012899 - protein, 178 aa, Homo sapiens
RPQAGRRPQHTSPSQRPQRARAWRVKAGASAGGRGGGGTGAGSSAALASPGSRPSRSLGLSRGAASASFLAETGVGHGVAARRGAHPAAQTPRGSGEGLGLGPGPGLLWGGAERLQLAAAAPGEEGVPGSGQAGAPHSAAAAGLARTERALPVSAASLCKPRAGGALSLAGPELRGVA

SEQ ID NO: 1012900 - protein, 188 aa, Homo sapiens
SAGAAYWKGAAPLRLVSSGCIGDCGHRLEGAPLLPRRRPCSPLRPDLFPHDCPRALLATDVAPASGFNTDNPDREAARWRMEGDSVSVLRPSRPGSVPRWESYDLLLTQSQLRPGAAAHRGLLVNAYRQGAGRRVGGAGSSEDDCAEPPLTSMDDETKGDVQGNAVEPDGGSAPAWASRTGGLQIISE

SEQ ID NO: 1012901 - protein, 67 aa, Homo sapiens
GAMVRGVGETPRDSGGVRAFPPKRWSGSQKTRAATGGIFGTPHTSGFLGSKPEGQGLRQSPEIQAQR

SEQ ID NO: 1012902 - protein, 178 aa, Homo sapiens
MLGKCETQRGYDESEKKNSGGLEKENPMRMADLSELLKEGTKEAHDRAENTQFVQDFLKGHIKKELFKLAPRDFDFTYSDLEEEMERNKDHSGFGPLYFPMELDRKEALTKDIEYFFGENWEEHGARGPRVARSTLERIHLHWAERDRRLLVGAIAFTRYMGGVSRGGPGCVKKVCPR

SEQ ID NO: 1012903 - protein, 127 aa, Homo sapiens
SIRVLCWILECTAAAWLRCCALLCCTVYDQLEASCHEYWFNCNLHQQQTSQRQTGTLQAQNSFPCWQNPPQVLYFVSLWQSLIHVIQVVIGYFIMLAVIVYNTWIFLGVVLGSAVGYYLAYPLLSTA

SEQ ID NO: 1012904 - protein, 210 aa, Homo sapiens
ESGIALLGPSSLPSCGSRCHLEPLLPPPGGCPREGPAPIRTPDPCEVNNRRWSLCVPVVKDDYHPSRTWKYRSKDRVPLKVLWSVGPTDAWGRKLVPTNRHVLATIGVDFKVPLPMVWNGMVHHNNRVVERNGRGLGGLRSGKHQNGVRDHPLVKQPFFPTQGPWAFLPKDFPLFILKVFPPLLCGTNKPGGLSPFWGRVVRGGWVKTRT

SEQ ID NO: 1012905 - protein, 140 aa, Homo sapiens
AQQADAGFSGWDPPPRPGPAASMRTHHADRGDRRYLLLPAGHAPQRRGATGRASMSRRLATPFVEGFKPPAPPVALAGVKRLIAREPRPQPLPPPPPSSASSDAAQGDLSGLVRCQRRITVYRNGRLLVENLGRAPRADL

SEQ ID NO: 1012906 - protein, 121 aa, Homo sapiens
MTSVTEVALFICPCMRLSHRLDQEVTLDATCKANTISIYLSLDRKEAVGTIFTWHSDTSLPKKTELKDLNRHRCRTDRITDTQRKWDPIVIQGLKRMGADTCMGKNRLADRTIKPYIADFL

SEQ ID NO: 1012907 - protein, 293 aa, Homo sapiens
GARLSCRKRDCSVLLFGCSGVVTTFPGWSAAITVSVPDRGRQEIAVQIAQRGGLDGTYTVGIAVVLVLSVSVLRVSGQAKPRGARAPARVRRAGKGLEAAPWVTTARPNVSPRGREDRLMEHLSGCTPTSKHRRRWSPSALPRRPLMQRVRENIEGRSDGARGGSDKRPGAVRSRKGVDLSKIVNDGYLKSLQTDPRSPHMTSCRCSVELQGVCGQLSTPGGCQDTSTRRLRTRCKTETKACRIHRGPRRGPTPFIFTGMEACALAGDQLTFCSSPQCLVGADCMDRHDLLDA

SEQ ID NO: 1012908 - protein, 241 aa, Homo sapiens
RDLGLGSFLTSNLEACAAGGVSLVGCSCAGGWVSRPGTCGVCPDPPLHIPPLNAALTWAWSLAGVFPIPWKSPGPVCDTNGPETPPDPAEPNNMGPTGPWLRGGGIGPGSAAGACQLGRVTACLTGHGTRMSWLDAHGPDAAYAATGTWLPWRRHECRGGSGKVRGPAPLPCPTQLLTLYFDNRRRSGRGPCVELATDWACGGVLTFTSKPADAEQGLGPRPIIALPWLPSLSLRASSTTS

SEQ ID NO: 1012909 - protein, 196 aa, Homo sapiens
MKTADELSSPYDHQLYLRPGSHVDQLLDYFYSGKVVISDANTVRGRLLRVGSMYFEPTSHAFEFTVHDLPYYMSICRANCLRYLFLARAVMSLKEVYDVAYSGIRDNFHYWASPEGSMHFMRCPPVIFGRMIRDENLHVLNEDQALQRHSSLGWYFRTARSASTYSGQFFQYINLNAVINKTLVFAQQQLVGMENT

SEQ ID NO: 1012910 - protein, 177 aa, Homo sapiens
MAFADSTAIGAPTIDTTVHPFAQNPATIKHRRRVSAHCTCQSLCDLDTPPTFSPQPKRLQAPNLWLKALRRSVHLRLETHNTKSTLRNAGDTTPYSQHDIAQRPNYIPPCHLHRLLTTYCIDPILSQHLSPYSYILVYPPYTPPQLCDIEPTQIVCILNLNSMYHGVNPNPTLTSAP

SEQ ID NO: 1012911 - protein, 394 aa, Homo sapiens
EELAGRAGWLAGGRLMAGWREAWWRLTPAACGWAPERAQALLADVDTLLFDLLTGVLVAAWDDRLCLGCCPEALRALRSPAVSCLGFITNNSSNDPVAALLPEECSRLPRASGVSLLGGPGCQGLVQGLSGNGPLLGTWRLLNLCCPVVPCAWSAPSMSPYGRLTLTGGQAPKVPLGPSGNAGEGPVGRGFRPEAGMRVFGGPTDVPNLVQAGQSAVFPVGGRLGLCQTGGRGFGGPAGTRLPVVVRWVGLGSFLERAGKRFERFNLFEQGFEPIEGAPMAAYTLCERMPPGCIALRIPLLRGHSKTDFGQPIAPVALFRGALSRARPGGPGAFPTFQAQGRLRRGASWPPWGFQCIGPLYATQILRPASPIDRAPSRGAPGTISIYVRETRPP

SEQ ID NO: 1012912 - protein, 280 aa, Homo sapiens
VPNSRVCPQLPLSACGQCGAERPGAPRGRARVGAGPAGLPGLGSGRPRHRAAPGTGRGGARLAGNGAGTCGGVGDERGRGQLQGGRQAESAAPWAWREPEPAGLGGGPAAGLGPVPSPAQTWPGRTCTGRRPWSLGQRMTIKQGDGDRSQKVRSMGRSDGVTVGAHVPIRYLSSVVPRGGIPKERGSEGRGRVRGDQRRIPVSRGDVRRPGGARSPDGGCALSILAGILLMRHSNQRYPIREGVHCDKGQQEPRPWGATHRAQAGLEVTLPERPKTGGSR

SEQ ID NO: 1012913 - protein, 217 aa, Homo sapiens
LNTLIRRLKLQLKSHPPRVTSPISPHFTVTERQTFQPWSERLSNTTWNELRTIPPLSHGRPCEQAPEHYSRSKDVEHRQEPIQEHKQDEGRTQEEPEEDTGQTEGTQEEGQGTKEGLGGCVSAAEQTQSPSFTLNLYLANPSSFAPRVREVESTPMIMENIHGAHSDAAQEIDEVTEICDENSYWRKHNPCSLLQLAHTEALLVLCYSIVENTCIIT

SEQ ID NO: 1012914 - protein, 279 aa, Homo sapiens
RRHRGGCVRARSPRGSRVPGRVGVLPPCESRGPSALADTMNHLTVLAKALYDNVAESPDELSFRKGDIMTVLEQDTAGPGRHGGSARCMGSQGIVPGNRLKILVGMYDTEASRAWLRPSLPPRPSLSLASMPQAPSGLPSNNAHARQNTTRHQPDSVYLVPTPSEGSAKAFYQKVPGSQPYSSSSPPGQARQFQLLRSRNTISPDFPGPAHKTCTKGAPGPWKGLAKEYLTRVTTFSCARIRGAIDNSSKGTTPVSQWYNMRQALWGGALIGNDPPGAK

SEQ ID NO: 1012915 - protein, 147 aa, Homo sapiens
MYGTCRLRKFDCESQFAGTIHLLKRIIQEGSWTQNWAALPAQELEEYNKILLDMETTYSVATVLPTEWQLPAARARSDECDGHIPEILRPVMGMGGLARQWRRRAILQFNPEIRGTHQPGCPGSMAMEMPGDSVEVYVRDTIPGSMN

SEQ ID NO: 1012916 - protein, 235 aa, Homo sapiens
MACGCTRWGVSCLLLTSAWRKYMEDVTQIVVEPEPTAEEKPSPAAVCCLSLFASCWPSPGLPSLAGEVSGQMAHVVGSPRGSRASPWICRGPRPGTLAAACLPAVSVLWPFFCPLCGLCALAGPGEGGAPRLWPGEATYDREVYPSQRKARRGYTIVQRPGLNGDLWPPGPHYPATKGSIYPFGLWYTPFGPMVVTTEHIIASEHIGPPKCTSIAPAEDSYHRKHTHTGVDTNLD

SEQ ID NO: 1012917 - protein, 193 aa, Homo sapiens
MINTGTQMDLEVKGVAATSRSQIQPFFGRKKPLQQRWTSESWTNQNSCPPVVPRLDLGSLVDSDDEDQNIIPENFPAPTDKCKLKYQQCKTEIKEGYKQYSQRNAENTKSNVTHKQSPRNKKMNKCVQDEEANTDDLTTLDRKAILQQGYADNSCDKQQRARKLDAEIVAAEKKKQIVAEQVMIDHLSRGCHQ

SEQ ID NO: 1012918 - protein, 256 aa, Homo sapiens
DPRLPAGALVLLGPALVFALGPVPAPEMRERLCGHHFVRALVRVCGGPRMVHRSSRRSCGRRSDRELLQWVEETILLHGLVADSNLTLEAGLQPLPQNSHLSPDITGGSLPTNPATADWLRSVACTAMKDRSCPVMIPTCMSSFGVARHYEVGLEGPGGVLVLVTLTECPSTCDHRSSRSLARPLYYPGDGLLNYLARRPMTTWQPCESRAAVDKSDPKPMAVAGSPGFHQMSGQLYSLNVAHVQRSPRKLRSLHV

SEQ ID NO: 1012919 - protein, 179 aa, Homo sapiens
SSPGLPAPGSCSEGKTQKGQKQFLQKREDPQVPSPRRAAKDKHKDEDSELVGVYAWRKGQALVRSLLGPPPVLRRHHSKDPSRDPALTVDLGDSEKVIAAKVLTGLCPVPDATSAHSDQQVSGNTPSLASFDQPATIQTAMAILQDLRQQIQAGLELAQARKGGQELGPSKRRLQDVAG

SEQ ID NO: 1012920 - protein, 170 aa, Homo sapiens
QSARPGSCVVGPDGLYRPSHVLSALGACCRPSRSRLAKCRAAGLERRRRMALEGMAADAGCGACRVCGKLLGPALRGDVFCQTDLWKNLTVDEGTMRGMRCLACPDRATTCTLVIDDETKEAAIVDPVQPQKVVDAARKHGVKLTTVLTTQHQWDHAGGNDETVSSWSRD

SEQ ID NO: 1012921 - protein, 201 aa, Homo sapiens
MSNKRPETCYIRNSISSIRGPTDYFTARVGEARTSRFRTRHPLEGRTSKSSEARASIEVRGASRSPLLMRHAGRSVARKESMFTDNRSSIGGTNKEAQDQSWTGSLWTLFRPPGVPGRTVKGEGDRPWDFATRLDLPRNVNSTMPYMGRNYFDVKRRNGPWVGSFSRAELQKGRGTDMPLEVARRLAGALFRSLRFAKGPS

SEQ ID NO: 1012922 - protein, 134 aa, Homo sapiens
MRSELPLREKKKENTTTTIAGERAETTTMGHSQPNPPLQNKSTDVYIKSANRGGKHNDKITDLLASECVSTYLGVCAQTHKPSRDQLYQRSVDRDKKTNITCACHPQHDENSAAVYDKQTHNLFLLTPSRRRDY

SEQ ID NO: 1012923 - protein, 316 aa, Homo sapiens
MVRYRVRSRELNRSHEVYYGTSMLHGGNEQWITTATEEQGLSPEHVYVYERIHGPVSLIGRRARLSNGRLHRESTRRHGSFLQKAASRRIRAGTGGGPRTRACMTPRKSNIGEQRQAYTLSRGSPPRAPTGMREIEEKKIVCRDQSTTRGGPIGKLSPLRVTYCFHSPTQACDSFYGKTEDPALGSQTNKQPGTTVRGTNKAKGFRARSTNSQGVWPVRNRRPLGRFWGAVTPGLGKTVAPPEAQTENSSGTPVVHTWQDPTGKGVPKPSCASRWHNSSALLWNSETGEPNHHNMINNKPDQQPPLGSRSNPAPKD

SEQ ID NO: 1012924 - protein, 97 aa, Homo sapiens
RGRTAPPLLPPLPSFLLLVSSLTYTHYAYTKTRKKQQGENHSKDGKRKKDRPVARKKSREATDRIKEQKMKTKTNSRQNSRKRRERTNRKGNRRNKK

SEQ ID NO: 1012925 - protein, 280 aa, Homo sapiens
PAFLTEALRAVLTFDSWFLECSLLTPCGPACVAVCGPSEELVRQPPGARPRPQEGLVATWSCWRCSSARVRQLQAESVSEVVVNRVDVAACSQNVAVEMVASSHPGRSRWVAKDASTVCPVDSWANDTGELDKRTHQMRMQRLKANLQIAIQSGEFNGAETGALQVEPRLLSKQMAGCLEDWQRKGRREPTGRQQLGHGTACREAPVARLEAHRRCIKGRRTGARHVRMGTNAHEWSAKPEAAIGEFIQQLLAMNQLTQSSPLEPSNMAGASRTPGHAAR

SEQ ID NO: 1012926 - protein, 243 aa, Homo sapiens
AVRLVRERYPKDCLCSGGIPAQWSGLVEGTASCASYCFVKALVRVFKIYLTDRYTYPYRGWSEVGRYPGGDDTVRARWVGGRHVRGLAPGLPCTLAASENPVRVGCGGLGWCFWAHWRAGKAGRKTDLVGAEGGTAWPWVGGTGRRSATGLWGGAWPLANGPPIEGLGQGWGGKYRFLGPRGQIGRSPGRGKSEALWGATLVYGYLAGLGTQARARSPAGLRSTPRVITMCRIEKSAGGRLDL

SEQ ID NO: 1012927 - protein, 235 aa, Homo sapiens
CPLGPQAVVAGVWLAVGPRRGGLSGRGGWIAEQVEGGMGAAGADPPCHEAPLQPVQETWRTQHLLCSVVNWTCCVCDPDVPMHDMRMAPGELIEQTKRVYDQVAPSEFEDVSYESTLKALADVEVTYTVQRNILDFPHACFRPPGHPEQPAQEADKRALLSFDVELTHERRTCTMRTRVAPGRPRSERTQLTARRPAAGTLDGALPRTLRPRDNWGLQPSPMRRPQGPSTPHRQS

SEQ ID NO: 1012928 - protein, 204 aa, Homo sapiens
PGAVGRRGLRLLLPLLPLLPLPQVGRAAFSLGSATAGRVLLVTTPLPGSPLSPQVCAGLLRTAAATLGPVMSGCEGAGAWPRSYGEARGCECRASHASACSMCRRPHRCPPQARCEHAVARGVSGGRGGAVRPTVLGRGSPWAMVPSRPLTSSSAVLRLSPVPDRLGRELTLEQASDLPSHLSRLGLRRESPTDPGSACWGTSL

SEQ ID NO: 1012929 - protein, 121 aa, Homo sapiens
MRDETATRFHHRLLVYATVETTSLGGETNQVANTFSLRPTYRKQKLGYHTRRAATDTDSPCCRTQFEVPAISYGVRPTTTRRYHSWDHPHKTRKFSNARSLPQSEFRPQARGSPLAKSHTN

SEQ ID NO: 1012930 - protein, 215 aa, Homo sapiens
GRSERCRAWPESPFPLPRLQPALPELADISVRRRLPSPGRAALLAHPARADPSPSKESDNGIDQRGSGATTMSHGVAVNGAILSDQSLREIPTDDKGFTAIHFAAQWGKLACLQVLVEEYKFPVTCCQQIARHPCTSSIHRDNTTVASPASTNLLDERGQTSTAQTCNGPRPLHLEPVTVWMDLCERSWCRVGAKVACPRCHGLKPIDFCTIMEH

SEQ ID NO: 1012931 - protein, 47 aa, Homo sapiens
MLLCLEPGLKQAVRPESWAFFTGAVAASEAGQDTIALELAAATDEPG

SEQ ID NO: 1012932 - protein, 150 aa, Homo sapiens
MAPCIISSPIAQRRAWGPGSRRSNRRCLRISKSEYVSRNVHSSGVRSMARRGRRANHVTPSNDHQLVRSTTPLVKTQANNSRFLSLSISEEAALPRWALRPREARAILDPPSRGPAFLLPSYSASPQRNLGISALAFKEKRNTDKPQGPM

SEQ ID NO: 1012933 - protein, 215 aa, Homo sapiens
MSRDNVMNPAWGVKSAVVDSGSWRARARLCAGRGQASLCRLPPLVYGGGGGHRRGADSALTLRESGARAAGWVPCRGRLDSTPGASGLDGLRQREHSWSRTVTVLGALEAKTGVEKRYLAAGAVTLLSLYLLFGYGASLLCNLIGFVYPAYASIKAIESPSKDDDTVWLTYWVVYALFGLAEFFSDLLLSWFPFYYVGKCAFQLFCMAPRPWNGA

SEQ ID NO: 1012934 - protein, 257 aa, Homo sapiens
LYRPELWDGRDFSGSKPSLFQACLLKPWAQPELFSFLSHGRFPRHAIAAIVFSGIACVAYATEVTWTRARPGEITDYSGRPELGLLKVLETVRGLSHSSGSSSSPYVYHNAAALEWCVAVYALCFVLAEPQLSCVTPGCTGTRHAAHPRSPVSCWGWPCMSCPPLVPLLACPLAPLRSSTEKYGVQPWQSERCELQLTETPTLCVSGTGDWLDRELTGRRNLLGYVGELVYSAHLVFVKVSGLPKGPVMLYNLFILP

SEQ ID NO: 1012935 - protein, 227 aa, Homo sapiens
MVRPGITGLAADAVAEVLAVCGDFLCGLQRGAWRLTVREPCDAMRADARAEPPAVAMVPERPDGHVPEDYCRPVTSVSQSSTCPTWLRLLSDTAPSWRTASCMWFQWSEQRDYIDTTWNCGYLLASSFVFLNLLGQLTGLRPGVEQELLCQYACFGLFGIIALQTIAYSISWDLTVKMRNLALGGGLELLLAEYRSEGKSMFAGVPNLRESSPKQYMQLGGSVYAGS

SEQ ID NO: 1012936 - protein, 293 aa, Homo sapiens
AGRGFRAGQAGFRRYRGRGLPHTGQRSGLRSRLPDSCPSSAVPRRRRPVYVSGAAMEPAPRWLAGLRFDEPAPCAALPCGRRLPPWSLMGCPCPAPAALCPGACFTLLCSPPPLRAAAASVALSGALAAGACLGLGAPALRCEGLMALRAAAVSFRRGKRRPPAGAGRGPGRRHVATAGPPNSGPVRRGQAGPTRAPPIVPLGAGVARAEHGERLGACRSRGAVAQRPFFQGRTGRQRGPYGAKAFRGDSYIAGESQLFHPGEFPQPTRVPCACGQRPEFPRWLRDVVLMMVI

SEQ ID NO: 1012937 - protein, 133 aa, Homo sapiens
MRDRPAYTVGKLYLLRIRTRSERDAGIGHGRMDRGTLAEGDVFARREPHAWSPDYLGRCVEANCPPSFETARVPLVNVGFPPKVVTLGMGKANGADWLGWHGVGNRVPTSLCLYVGKWLGSRTRRTSGLALSP

SEQ ID NO: 1012938 - protein, 91 aa, Homo sapiens
MIVCVPNVSIPPPADMIDGAGTRYGDLELLLPGNLKCWCVGLRSFPLREMGSEGGDQQHENLEKLNMRAILDATVSRTSPFRAAGHPWEGP

SEQ ID NO: 1012939 - protein, 289 aa, Homo sapiens
RGCYGSEFRECAVGRAVMTAWRRSAPWCYCDPRRRSCAVYCSFSERRLPRIAQTGARFAHAELSAASGWRDAALLAASVALAVAAGGPGQPVRPVRRFVCTALPPEAVHAGCPLPAMPMQGGAQSPEEELRAAVLQLRETVVQQKETLGAQRGGHPRAHGQASALRGGWRAAMARGAGATGKDTMGDLAAGPPATSWSSSGRSLARPSMDRLGGASRHQLQEQTFSNCWAARATFREVPPAAGLGGAWKRQASWRKVLARAWRHEQVPWRAPHEDLGVQPGRKTGRGNP

SEQ ID NO: 1012940 - protein, 69 aa, Homo sapiens
PGTPRIYGMRSSGLAALKRSCLARYAPTSSRNLGVGVYSEAISFRSPAPAGCVPSLEEQCDPFDVNNRT

SEQ ID NO: 1012941 - protein, 83 aa, Homo sapiens
HGRRQRKTHRLCHRPGKRLGEEEEAKGTETGVELESRESGGGGFPGPGLWRYHVRLAMSHRGSHTTTSVGHLSRKGYICWSSD

SEQ ID NO: 1012942 - protein, 48 aa, Homo sapiens
MIRDTTDDTEEQLETTSTQKERDKGPEKQRQTQRTNKTTERQVKGKQE

SEQ ID NO: 1012943 - protein, 81 aa, Homo sapiens
ACTARSTGSVTSLRFAALRPQAAVHPAWMRGALDDVLGLFDCDHYIINIMEKRLFILNCPVPPEGKVAVILTPEEVQHACR

SEQ ID NO: 1012944 - protein, 235 aa, Homo sapiens
CPGDKHASLSVCYKVGPGAENGEEGDIQEEMENPEMVDLCSEKLDSHPAAASGAVPLPVSVESLPATRHTGCKVQIVHSLLKRGRDVCIKVRTMVAGRISCFIFSSLLMPQQKTRVSWLDNRESIRDSETGTRSDISRLVEKKREEDGRDQYQVGDPGVGGAEATHRQGQIDQYLGGGPVLVERPSHSGPGLASTLQSGQVQVLHIEAACRLSRRDINHVSTPMDISPRRTSYEI

SEQ ID NO: 1012945 - protein, 183 aa, Homo sapiens
YGIEASMLAVVGTWQALCLVISFGFDPDPWGWSRTPGSLRESGRVSREATVPDGPLVSELPWLPSASRLCPLVFGRVLNSELSSRELYEGLRLNDYEINMTYVLTGYTRDKSFLAMVDGHLCRMLKQQNPSAGVLCVIQTWLTCGTCEGSNVTSRSGSFSRTTKDISGAALQTIITAQYKFEA

SEQ ID NO: 1012946 - protein, 137 aa, Homo sapiens
MPLPDPMFCARLIHIPPELAGHPESQFTNVLRILLPQSRHDWCLLAGSCVADFFMRLSDAGDPPFAVKVAECEECSTCNPEIDSRHRPESRTPESYCSKQCHHKRYVALSDLACQKWQELVPAEGNNSKRSYNMDSL

SEQ ID NO: 1012947 - protein, 180 aa, Homo sapiens
MSCPRLWHRRGSSFPVYVTASRPCAAAQESAGPRSRYGRPGTAAVPGKLNVLVRGLRHASRYTRDGLPKGGTELAGEPGQKLIMQSASSSVHSQLMVEPIQELLVTHGRFQQLVEELIAGGRCRKPCTGVPCSTARAGGRSKSSQINLTPQSKMVGAPTEGSSIESNLLGDHVFFALQEV

SEQ ID NO: 1012948 - protein, 142 aa, Homo sapiens
MTVLLIALCPTCNTIASEGFAKNRWGKMMEKKQRTIDEIEYMRLIRSSTVDGLEEKTPHRIRWKFNNVQSIQSVDIQTRRHGDNDRLKPPPQASFTMYMPLGQDYSRFLLRGVFHPLNYVVLATLCTDEANKTGTQVTNDAK

SEQ ID NO: 1012949 - protein, 141 aa, Homo sapiens
AGWYAPALWDIGYRYVVECYSSGGRPARWPSLLVSVTSKGPCDVHEESGGRAAWSQEHLRSMMETGRAMWARYCMPPCRAVLHKGENSLGPKRQKVGFHGDDLHIKLLNCGLFLLLFLLNPVRSVFALSACDEFTAAFGTM

SEQ ID NO: 1012950 - protein, 143 aa, Homo sapiens
MGSGSAVVVVLSPHPRFRVRPFLHRSLLCSLRTHRSQARLPDLPQPTVDPGRTCEPRCPPVSLHGKRKEIYNDEATLDSVRDELDCGGRVRRVRLALGKLPRREYKNKVHLRRSLMRESPDVNRRERALRPLHIATTKAHVDP

SEQ ID NO: 1012951 - protein, 119 aa, Homo sapiens
MDDDENDGEHEDYDTVMRKDDELIDEDDTGLGDEGEDSNARELVLSDGNDVVMTADDAEGGDGTDLRYANRQEEYVVEVKVITELVSSQNSGEWKYRCVASIFFELEEVSREQEPIISI

SEQ ID NO: 1012952 - protein, 227 aa, Homo sapiens
RVLYAPEYRDALCAQEGTSFLPVDSLECPVVCGSALITRRSQEPPLQATTFLLKGHRVCGPTPSTAPPWPQEPWELALASCRTAMDLLWMPLLLVAACVSAVHSSPEVNAGVSSIHITKPVHILEERSLLVLTPAGLTQMLNQTRFLMVLFHNPSSKQSRNLAEELGKAVEIMGKGKNGIGFGKVDITIEKELQQEFGITKAPELKLFLRATGQSPSAAKEWLNLLP

SEQ ID NO: 1012953 - protein, 108 aa, Homo sapiens
MTLRSLYGRNRDWIYIIFHSIIPTGLSLHHLLWDSVNSSQAPPLVGFLDSQPLSSVCIWALEQLLILVRLSSLGSSTTNFNFTNNSPSGVFTFGANSSTPAASAQPSG

SEQ ID NO: 1012954 - protein, 145 aa, Homo sapiens
MGLTGLLLSVCTHTGPLETHGLRQSAAWVDPGARGAVGGPGLTVPQMAVFLTAGLTLCPRANLEGRPICLLPCRTPGSGAFVPEDVAVTASGLVVVSDPIHGAVHALQHTARDPGGHWVTVGTFLSPRGLAVDALNRLLVTDYLP

SEQ ID NO: 1012955 - protein, 118 aa, Homo sapiens
SAVRSIRDCRRSSPGVGGQPGGAGVRWIPGQSDHLPPVFPLRSELLITMSTLYVSLTQMPSPAPSPHSRRYGEAGEGPDGEEPPIVQAERSKWWAEGRPAPVWGQVVTGGGPADGEAK

SEQ ID NO: 1012956 - protein, 146 aa, Homo sapiens
MVTRPPEYRDRLPTRPRAVTGCRLIRLLWSAAGCVSARTSRPRKIGTAGEGVNIQRNRWGWGGGLRARKTGGAVNQETYVALDNAWTSGRIVSQTGEVYTNGPDSRVKPHLMDTHQQPGNTGSLDGTDEAWAGQNGCQRCRVAVDA

SEQ ID NO: 1012957 - protein, 102 aa, Homo sapiens
MGGLRAPPASRAPRGPVHAPDGCGLQHLGARLVGVLGVQWLQVGAGLMRLVPGELMCLRCGGLVTALASPEQCPCGQQRECRPDDARQKIYYPVTVATTVIG

SEQ ID NO: 1012958 - protein, 191 aa, Homo sapiens
QAWYAPEFIGSLGGVRRLLSGCGSGIFVPGRCSDGVLAHRVREAAVACLVQNVTMDDGVTPLIPDSLAIPDLPEPGPGLTCCAAGAGVPPMAGRVSGTSSCGVEQFITDTYQVDPRSAHENPADHVHGYGRRYQRTVIDKGAPCGWRCKKTAGNTQTRVHEPSDFVPYPGTKISQSHASQREDGEVMKGNR

SEQ ID NO: 1012959 - protein, 174 aa, Homo sapiens
RLVLPPGLDRAVRGRRSGRRLRRGFLGRMSRWTSGVTPLLPDKPGLPDLPEPGPGDVLACGAGVPPMAGRVDGTSSCGGSSSTRYYQVDPRQCPDTQRPCPGTRSNSGCMTRCPDVEVQTAAGNTQTRSCTIRNLPFRITESRPAPRTAMMTIWSNEPDTFYAMMHKTEDNAGH

SEQ ID NO: 1012960 - protein, 143 aa, Homo sapiens
SADWVEEGWVWDGEGAELDFALWQTLAEGARGSDVSSPQQCQCELCVLHLLLFLLLTPQGGHSCQCAGCWPWELVLANGEGPVLGCLVGPPVCDQWKCGDHCESWLCCPEDMPCGGASHTGALPEEEEDVSQAILLPANRCQL

SEQ ID NO: 1012961 - protein, 188 aa, Homo sapiens
MAEFGLLLGVKSLKRILLLFTLCLIIFYLETSSFGVFFFGAISLVWLLDLISDLHFGSQPFFWLDSEGFRDWRFLSWLLDGAIPPCNSQLSRGKTTGRGWGNCYTGHAWETPTGKLPVWSWLNWQENTGGRQKQPGTTINQQRGHLWVREHTTGDSLDQEKRVATSAPEKSPGHEQREQFMDRFFSRE

SEQ ID NO: 1012962 - protein, 146 aa, Homo sapiens
MTGYTPDEKLRLQQLRELRSAMAEGPVAEPSVSRMLTPQKMGAYGEVLEEILENKSALEENGSMGYTKRVYLCKHYMYYVTLSGLFIINMKYHVSDKNHMAYVRSRSPEYIPGDYNSGRLGRQVSHNQLKEFSCIERSFKGLCRTS

SEQ ID NO: 1012963 - protein, 40 aa, Homo sapiens
MRNRSKDGQLRDNIFHPPLRTGQRSTKHMTRQTSTKASHT

SEQ ID NO: 1012964 - protein, 215 aa, Homo sapiens
SGVAGLRDVHAPHERRPAARLLSAPWAVSCSCPSPLPPLRTLRPWSRLLAALPRGCCWGDRSVGVPMWPGEGSVGGGGGGGLAARALSAVKSRKRLAGVNAWGSSRRSGCTAAVVLVLPRARYPGVPGKDGHHTNPESGWPQGFAPTRQAPRGGSGRMPPARGMDMWRTFQPTNERYNSKSRGQTPWPGMARVGLPFSHKVNGLESDLRTLQEGG

SEQ ID NO: 1012965 - protein, 148 aa, Homo sapiens
MVTTKNPVLKTVSPDSDRCAHYSDAVIAASASAQRGESRAAPSPAALPPHSAGPSGIFQRRNHDLQPPPGLGWPWVQSPEGHPSCPESRPWPILGPIPSPAQIPGPGRVSGPGPILSPGRMRSPGSLPGLGPILGPGYGPGSSSVPVS

SEQ ID NO: 1012966 - protein, 223 aa, Homo sapiens
ILRALGVLPPRSRTPTRGRAVGCAAMPQPQAAHGPRRGGRDMGPLSLRGRREAASRRSAPPPGRARARVPAAGEGGGAELRAGAAARGISDLFASLKSICRRGSHTMGVKTFTHSSSSHSQEMLGKLKYAAEMMAHHCDITIRVQDKIFRAHQVVLPACSDFFPPHLYGQAEDENKNVSDLHHVTVNWLHYLPQNMLTPSHSINSTPETYHSLSSSQPAYMTT

SEQ ID NO: 1012967 - protein, 109 aa, Homo sapiens
MHHLLQSVHSQILGRIMITLITEQLLKQTLDELKCTRFSISLPLPDHADISNCGNSFQLVSEGASWRGLPHCSCAEFQDSLNFSYHPSGLSLHLRPPSRGNSPKEQAFS

SEQ ID NO: 1012968 - protein, 313 aa, Homo sapiens
AVTGLEFWDAQPGFLSRGVSRDGGYGALGGCKLLRRAPCVMPGCREMGLPWEGRVYWHVEGAGPLFAVPRVPVQDVVLQDAVISVGVGAGGCGAVYIGSSVVSPLGAASPLPLRRDERAMTGLGKAPLPRQGLKSKAGRIRRGLGPSSSSFLFSGLPWRRHGKFPNWTDPARVTGPAGPSLLPQAWPLGSSVPAGGGCAPLGAGFLLHVPSARDLCPRVGTRTRRGKGKGPGLLLGQGFKVPAMGKAPTHSSLRKPGLLKRAQVGAPVELRETRFYKPIGSPALEEEPTLDIGEPALNAEAFGNNLRDEKLIN

SEQ ID NO: 1012969 - protein, 151 aa, Homo sapiens
PGTAPEFLGSQSGARLTDRLRGVRSCRVLCSVSEAFHIIHDPYSPVAVSCQQRMRMLACFHVVLLCHPEVSPEPGWGTPGTFGLTFDSIGEVTKRTCCSNLREPVKSCGVTGPKLWACLQVGCPYVGCGESFADHSTIHAHGKKAQLDREP

SEQ ID NO: 1012970 - protein, 66 aa, Homo sapiens
VDRPSDDGNFSLLIRAVEETDAGAVHLQPAPSLTATSTRCLACPPGGHLTACECFPSVTKYRITLH

SEQ ID NO: 1012971 - protein, 191 aa, Homo sapiens
MKGDVEQTGSSVHLLKLIRLLRLTSTFRDLGPKAQRRNSCKLPVREGETKGVVHCYTTSRGDRNRTCSTVHPWVRTHAIVSICLGAQQATKLNLINLVLDLWGAIVMWNQEWPSRARCDFMSGALLVGVYLDEGTKIVLQVVRSKQGVAETGLLEHFMFRKWGAFVVKGWTLSSKGNLPCIIKNCELSLGL

SEQ ID NO: 1012972 - protein, 141 aa, Homo sapiens
GSCRGGERSSLDRPSDPWMLQEGVQKATDAMAVVEHTDELPDNILLELLQRTCPPVHLLTELAVWSVRALAGPHRYSGPSGNDISACDEGFITEELENQSVVRPGTMLLAYLAETCSTELVPDTDPMCAERGVSSFWRPGM

SEQ ID NO: 1012973 - protein, 288 aa, Homo sapiens
RPSCSSGAAIPAEGPPSSESGWLRIKRGPFLRTAYGVWGMKDGSMPCITSCVVDLSGTLHIDKMQTGARLRRKLLQGYVVLAVIIRFVSNTTKESKRDLLERLRNLEFDISEDDICHQSRDCSQKFTERKQVRPMLLVDDRALADFAGIQTSDPNAVVMGLAQNHFHYQILNQAFRLLLDGAPLIAIHKARYYTRKDGLALGPGTMCDCLRDATDSKATVVGKPEKTFLHWKHCGVTGVNLRSAVMIGDDCRMMSVGLKDGRHGWASLHTSGEISSIQEDKSSTSLLN

SEQ ID NO: 1012974 - protein, 133 aa, Homo sapiens
MGKEEEGKGKRKRGRYISGSVASELCRTTGSARSPAVFASFPDGLRRGPSCLDPYGAACWVVARTPSGHAELSHVQLLSSGGWQGVPGPYKIGCLPANNLWCHRNLVDDRHYTPRIAVLVTDLNVQALQSQLR

SEQ ID NO: 1012975 - protein, 149 aa, Homo sapiens
MAQIRANGFKLETRDPRMVRCPPDQATLSVEREYVLASQTCDGPEAHRCHGRQVHLACATNMGRLSAETTTQSSTLALSPPGATRVQTGLGYAIPLAFHWHVPIKRLEIPLDALIAHGATSALRLSRYRLHHEHLSMDGPNVALRSSLQ

SEQ ID NO: 1012976 - protein, 254 aa, Homo sapiens
GDQAPWGRGDAGGPQRGLGPGGPVCDQWMTRTLSPAFPRLSGTCTALLQARFDDGQVPGAFAPCPRLPAWAPVWPLVLLLSRLTPGGVCLSNCSWSAVFGARPQAPWPPIAMPASPASLGQRVLLHCPALRSPPAALRLSQLAYGARGRSPWREPLSAHGVCSAPSASLCGIRTLLDPILQQTCAVNLAPHAIGKRSLPPKTLEEPRPLQELYLMLIDRAAHTVPHGNPKARPGVMTGTDDLNITKCDRHQALA

SEQ ID NO: 1012977 - protein, 291 aa, Homo sapiens
MWLGAAGGGCGGVSVQDGSSQRGVRECGGSGGPATRLDTSEGARLTRRPSPPDSYACAFDLDLELFSLLHFGATDLRHQLEVVFSPAPLRLSVAGVWRRLCWCPALPSLQPSSSWWSWSADISCCAPGVFTGFTDDFLFLHMVFLSRMSPVLWGRSVVRVLNRRNPFPWEVLRVGHGELGHEPVLRFASIYRRYSSQEGKRLLGTFRHGVYPPPVKAGDVDPNMGALLKECRNKRGGGGGALFGGDRVGPPPPAAAEWGGVFKSRQGGGERGYLFHMGVRPPQFFFARIFS

SEQ ID NO: 1012978 - protein, 398 aa, Homo sapiens
RRLGVGDDAVGPQRGLGPGGPVWITETRYPPPAFPRLSWHRTALLQARFDDGQVPGAFAPCPRLPCEGPGVAPVLLLRARPPRVCLSNLQRSAVFERVLSAVAAYAMPGLLPASLGQAPSYYTALELRQVPPCGNSGLSQACDTVLVADHLGGEPFGRLTGGGAVTPRLPRLCRESARLLDLYPAGKLRGWTLAPGGLREKRGSFPKPVEGRQRPLWKELITPSSIIDRRRRPTCPPGQSVGPELGVLGKRAWCGNTDQGPGTGLANDPPEALDPNLVWVDLRESSPLLVAGFDAFAKQCASYWRFLRPAYVHEGHPPGATWVIGRPLYGNTAVVYTAGSGLSPWIGSHFVGLQALVIRYGVFPLGKRRNEVVGTHCQFRGRQHVWGWTTEASHFTVD

SEQ ID NO: 1012979 - protein, 224 aa, Homo sapiens
SDFYIRLQTGEGHVPGATELPARTASVIVPRELVPDELMHPARPSRSSPPLDPRSRQSIPLLWFPNPNGPDGSLLGARGDLPVALYSASTLLYLPESPGTGAAFYVGFTVNTALSWSISTMGCRKKLRCLADQRARALVRGGGLLCLGGRRPTSDGWTPLGAHALLIRTWQDCDRGWGDLCVGTVGLSHGEARDGEAVPGASPLAELTGKEAIWGVGACSRLGS

SEQ ID NO: 1012980 - protein, 171 aa, Homo sapiens
MKGGPKQSHQREINPRDEINPKGNQHHRLISDMRQIEKLERSRNWSETTQLDDRTRWTRGICKNSLPQASFPISDQDIRAIRYRIKSNKKAPEITGQKQPRAFTSTQGVNKYLVVYSSANFGKTCKLPTTCSCRRSNPYNLIPKQGNREQEACDHIKIPLIQTSRSGQSEE

SEQ ID NO: 1012981 - protein, 155 aa, Homo sapiens
LCADQRKTKEDEKRLTRPIRALDERGYCLVENLCVRALTLGRSSKSKMTFSNVLKKINELTGIKESRHWPWPHQHSGTLAADTAAHSRVNSLYRLPRVYKRIINAAIREDPRITLSQAVNSQLCHSFCCVAPYVIQVVILLTLTRRDDEWAWIRK

SEQ ID NO: 1012982 - protein, 76 aa, Homo sapiens
PGAVARMQEDRDGSCSTVGGVGYGDSNGCILEPLSLPESPGGSITLEGSPSVPCYFLWKNICLWLNKTRRSEAHDY

SEQ ID NO: 1012983 - protein, 213 aa, Homo sapiens
PQQRYWQHGLWAGGVPVLAFALSYLEELSRYRGGPGDPGLYLALLGRVYDVSSGRRHYEPGSHYSGFAGRDASRAFVTGDCSEAGLVDDVSDLQPLQMLHSFYQWAFHSYEQAMMCVLGGCTGTVSHGSRHGLAQAAALTPGRSCDQREASEAKQTSSCKRSRHCPSVQLRRWSISQGQPDLVHPRTSGGVSRDWIGVPRKLYKPGAHGAPDG

SEQ ID NO: 1012984 - protein, 81 aa, Homo sapiens
PRTRKTKAQWRVLLCMQVRVCECNVAQGIKASVLVQRAVLADGAGGCLCELALVAREVLCLLQAVLPLAYGTGTPVITSGD

SEQ ID NO: 1012985 - protein, 192 aa, Homo sapiens
VRNEDMRRSKEQPPASSRLKLLNSSQTGQQFQSPRRGLDVEKYLGRGCFEHRRGIGGAGSPLASLLREDEDRRWMNRVGERIDYLITCGTIQHSKAGPEESASSGVIRLNTLTGLRITWWCQERTVTSIVGCSRKVVRCNVFERMKGSIEGHICRCKCTLSRFYSTSLITLHLWCRESDLGPLEVLSSQPQT

SEQ ID NO: 1012986 - protein, 110 aa, Homo sapiens
PGRMGSARCTGRWADPTGSAAPPPQTCLLPRNCDTPIFDFRVFFQELVEFRARQRRELPTTIPIYLVTSGRTCQLGGPRRRAWSMVKLEPWLCQRCTLEGTQTMRDVSIH

SEQ ID NO: 1012987 - protein, 233 aa, Homo sapiens
MKAPRRPQETKEQGNEEAMEQYGTEEKGKIKRNDMEQNTGAESRNHTHTRDTERTKSNGTETGPKKRTEGSTRTKSTQRKAWGRRTKKNRKQDREDNKKTEEESARQKANHPENGGGQQMAQNDENRDDRPEKIRRTARKHKRDRHRDTWHGAQNEEGQKEESDPKRKTYEQQEDGDNPIARRKGKKREEETKPQSGPEAKDSNQQQKEIKTKQKKKEEKGDQEDEPERSKNT

SEQ ID NO: 1012988 - protein, 225 aa, Homo sapiens
ARVLLAVEELGSASLCMARPSRALACVSVAELLVSGNVPICAVLGGICPRGVYGSVSCSDIRAPGAASRYQPALPHECACMDCPADAQGRRRHGHRGTDRRKVCAVASFSADALRTGRSRVGTNGQIWCLELSHAGVNGAGVSLGGVILNPLEALLGSGSLLVRGRVCREPCINSSTGGASYGYSSSARHAWVHALRTMETIPAADPGHALRTRRPSLQQPGPML

SEQ ID NO: 1012989 - protein, 121 aa, Homo sapiens
MERATMPRDLVTVCTVQVDRSTRRCDGPLVAQNRMKIGPSRLLRVSLHLWITFALIDPGPSQLRQGTVLGWPLSRWTALSIDLWPCRTDWVTDELHTVTSLTLTHRLEDYGRRGMGCNLAT

SEQ ID NO: 1012990 - protein, 306 aa, Homo sapiens
ADHGEKENPMRGTSASANSVFNICVAGECEHRLTRAAKVLDAAHRADPCVFQELDTLVRILLDIPAAICKRLLSTAQFEGPRLEEILEKGLKVRELSVKTHKLTSQILETLVLGSMEHTRLWCTQDSSPNALAIYGLDFYVVLGRPGYSIEYKKRIDMAALGPNIRIMQYVGGHAAGFQQKYEWDSSFLANKLPVSIQRDAIHKFSVINTPYNITESGVRRPYMYSSSGGTNVLALYPQLFCRSPMVGLPSCGSTATIVPCPTTRHLTALCPACFSRAHLRLPLVAMRYSVPWPSACLPLDSDALP

SEQ ID NO: 1012991 - protein, 235 aa, Homo sapiens
MEIRRMKSTHSHGPLDLLQVEPPGMGPGFCIFSKSQWNPVVFKSPPTNPMCGNAWDLPWVALPVQRWGEMAPTELAELRACYCSWATPPAGPRVCLPAFPALGALSRMTISEVLNVVLHLGVSTTGIFQKPRGFGPQIPGMLTLGLGCVMATQVLRCVASGASFNLSDVAVISHPAWDFRLEPVPGPLAVWASVEVMGGKGWAGSLGALVHALQMPRWRGVRGEQWMLIDAHSPW

SEQ ID NO: 1012992 - protein, 370 aa, Homo sapiens
GAQEEVRRCGTLEDRIPSPIVGYAGYSNSSSLKSNRLLSYLYVMSTRRSDDRAPKSRPGLRRGLFFGPSKCWHAAIAAAEESAVPALTDHTCVPQSSLSQLQEKPEPGLEEAHKDVKARSSLVSSKCHAIRVLQVANVGWFHERPSGVSAVACGPCKGHPRVVVSTEGAISCESSVQFSKLESVSYDRALLLTSALRPPESVGKVETTVPIVDGDYCTRVEDSASDVHMESLQSGREEDGHVHVGVSPVDSKGTGAWRPHSVDPPRGGDPRTGTPLVTIPRAPGKQRKRPQTHKGRLGTGDCHGNAMGERQCNRRKDAQPLKDASKTYRNGHGHLPNTLIINTGTRRDQETSSEEGNRTRHHKQWGRREY

SEQ ID NO: 1012993 - protein, 120 aa, Homo sapiens
LLESKVRGGAEMIRAAPTALFLLLLLLVLLSWASRGDGSPRAGRDPALSPGCAEVTDRSLYLAQLLRSYLMRLRSLKRPPLAGLWSSLEGIRTNQPLWCFGIKWGDPGAAKLHLDEATLR

SEQ ID NO: 1012994 - protein, 349 aa, Homo sapiens
QKEPPAGMLHVRWPFSAGGDLLGYGGIPRSKIIAARPLGICTDRTSDPKCATQLGRKGHHRYLKGPAPPPLLSSRSRATPLSTPVLSTSVPVPMFPLGSQGPSPWGLRGVPCAVPRMKPESPASWDLRPGTQPTCNSRFSSQHGLALTLQRESLDGEWDTGLVASSLSLSHVSHPWLSVPCLPMPRTLRLWPHERGALDTKHDGTWQCPAPAHRAALPQPGHPARLASPRPATGPRSTQSTHRCTTGTVLSKQPDAQDSTIAQRRPTDHAPRPHSPDPPDPAPPHAYAPSPAAPRVNSRLARCRPLAGAGCPCPRLRLAPVWPRAPSGPWHRRGPHASRGPPPPYTFAV

SEQ ID NO: 1012995 - protein, 261 aa, Homo sapiens
GVAGVGGFDGQVGTLLTDSVLCECGADGRPTLSNIISAAQSEVDLRSGARCGVGKTHLQLQMPGRCSSPGVRESVLIISHMTQLHNDLSMLFDQTVLDMGVLAKVKGYDDLFVYGDVTPGWAWRSCSERVRSGRRTTMLSMGKKMMPEADEAPLPGIDEAMSYAEVMRLVKGMNFSVVVFDTAPTGHTLRLLNFPTIVERGLGRLMQIKNQISPFISQMCNMLGLGDMNADQLASKLEETLPYIRQVSEQFKDLKQTNSSA

SEQ ID NO: 1012996 - protein, 209 aa, Homo sapiens
MAVKKIGVLLCAYCAQTRAHSLLAQAGASRLRSDSAGAETPPVSACLVVGPGPGSIVGEVWMMFCRQPMLHKTVAVQDAVFVLLGTRNDLSPATSVVSRAPGTLLCLDLTGYGVDLVVGCTSAFLLWDPTTVCPHDLEACDWVDYDRGCTRWCVKSGLKYVAGDAGITWEYQPLTGAYYRGPWDGRRALDMVISVYDLGHIMLRCVSDR

SEQ ID NO: 1012997 - protein, 226 aa, Homo sapiens
VLFSSMVCLKLPGGSWYGSADSDIDGAELPHWLWMGTPKHVSWSRLSVSVISSNGTERVWNHESDTSITKRSTRATTVTWGSTRRLTELGRSDAEYWNSQKDLLDAEAAEVDTYCRYNLRGCGELHMLSCGESKPKCELCSPSNDAQRTLQMDHEPSMVVLCEVVIYPRQQLNVRLVPGTGQEEKAGVVSTRPDPEWRLDSSQTLVMLETVPRSGEVTPAKWSIQA

SEQ ID NO: 1012998 - protein, 176 aa, Homo sapiens
GTRGTRFSDRSVPAEYWKRRKLKHLNDLGVTDVLCEACDQLGWTKPTKIQIEAIPLAVKGRDIDWACEKLALGKTRRRLLLPDSKIALHGRIPSSQFCLAPSFCTAALGELAFSDLRVSLKPWGPLLECRVLMIVGGIDSMSQSLALAKWTTVYIIGKHPWSTGLTILENTNRFQR

SEQ ID NO: 1012999 - protein, 107 aa, Homo sapiens
LRLRSHGFTAAAERENTSRLQPLPVATAPSERQRPGPTLGCMRAYQCALPIEPLPWLLALAPAPPRLSSMDEEQPGARLLLEPTCVGSLQVRLELCLVASWAVGFRS

SEQ ID NO: 1013000 - protein, 113 aa, Homo sapiens
LSCRLNPGCLVGFSTYVSDDSGGPKYQRDYKTAPFDSRFPNHVNQIYNTAGRTYLDLTSLLITKAMTRKGGDISVCRHGTSDVVPVPLPHILGHSTGMSNRRLEGHRYPGERV

SEQ ID NO: 1013001 - protein, 239 aa, Homo sapiens
MIRTLHAVPLWLAGVSQLVGTPTYPPYVALGWLAVNKRGPKAGHLCKVSACRYSVHMCYVAYHTCEQVSSCYANRSLASCSVCPLHQLLSGPYRVGLGRHKLYVADSGSLAVSVSKIVGAQGLEIVQCKSHKGERRLPCINTGYTPISLTRQDPCWPASLLPALILPNIYPMHTARRCWGRLQSNGAVPDVLHVGPVAGCGLCQLFQLCLVGQRIRDKAYVMICAGRVMRVISMLPRRL

SEQ ID NO: 1013002 - protein, 96 aa, Homo sapiens
QQTDSTMWACKYSQIYTIIRVFYVETTCIRVLRSPKNYLTQEPAFHTYINKTNQECHKKDTNYEPKNMKVILHSSRGLITCIAAHMRHPFLVSYPL

SEQ ID NO: 1013003 - protein, 224 aa, Homo sapiens
RAARELRGPLQAGQAPAMRAARAAPLLRACCSCWGRGWRLRALRSLRCPPWSLPSWPCNAEHSLAHYLGALERLDYPRCQDGPLVCQDHKCGSMTTEMLQDLAGGRVWLMTMLLWSVRPEGEPRVLPQMTRVPKSLDQWKRPPGNLLEREAGSPHRLPGPVRADYILVLRTHDNHSDQRIRLCGILIGCTGLSSGWPQCLDSQTYYFQTSGRGDQPPRGYYRSH

SEQ ID NO: 1013004 - protein, 264 aa, Homo sapiens
MKPHFRNTVERMYRDTFSYNFHNRPILSRRNTGLACATEGVTHKGFPKGPVLDAKDLSRPGVFPDLSTTHETVLPRLGFMWSTQLPALQGDFQDHLGVVFHGRPWPGTVCATAGPNFLSESPQVSTLNHLRTPRLYYVLGTRDLTEGRSAGMSHRRGPCEDSWDDERICILLCTNLVYSEGQPFMPVVQNSDDNYAIPATASLTGDAQKPDGGNVIHTYSTSTLKTVRKAYGRNESWLCFTMEVVSTITYLLEEGRLPNQVDPE

SEQ ID NO: 1013005 - protein, 411 aa, Homo sapiens
MRHPIGRAHHTICIMWRQHHYDLNETPLWAHYAKALNHPLLGRVWPAPRMYIHPQVIRPRKDFYPECQPDYGAGDTQHTKTRQRVTLIPTDLPPDFVYVDSAKGDPYAQPKKDRHYPRYLGARTKKKNPAAQTPGIVVITPTPQAGGRLRWAQQQRIARSIFRTLLDAGSTYIHSKLVLAVTLLGGPPRFSMIPSAGEVLVTMEDHQRYYTTGENNYYGRLNNQERPKVAAYGRLFCGGTAYQKKHILSRKEQQHDIGEEHPHSLLLGGEHPKPPTTARRKHKGFISPERLFIKETPRRENDPTLHIEHPPVFLGVQGEDTPHSRESPPQSTRGGQTKTAYATRWRPPPHDFIGAAQDEHGAAQKNRGGVTPRSTADCYLLYYLPDRCLLQFGTGLATHGERLFMSCASPQ

SEQ ID NO: 1013006 - protein, 119 aa, Homo sapiens
MRSMDESKQVHGLVQHLVDVFMTWNSPLGQRDAMVMGDLSGLWRYSILFQERLELEESGRIVVVSDCGGGTEERGSMGHKSNPGGPQLALTAHQGWCSPLWRLVDKRLTVVPKSLTEDR

SEQ ID NO: 1013007 - protein, 103 aa, Homo sapiens
MPQKERRSSRARPASRFPPVNMPCTWSRAKATFLPFARTLCDWPETSAHFLTRINPPTGGKQRKHNPAKATSGNTAHTTTQRKPKQHEPPNLRKKAYRPCTSQ

SEQ ID NO: 1013008 - protein, 141 aa, Homo sapiens
GRAAPGRALQAATRLGKALSGVIVRFLMFLSYEYGQHELGEVAGGRSVVGARRPIPDERPLPSRLPCFCPWPRVPRPCAPTSPGTQCCSRPLLWGRCLPAPGGRCMLSSSPVTGSECLCALWSADPAVAMELVAVLFVLLI

SEQ ID NO: 1013009 - protein, 286 aa, Homo sapiens
KEQVAGPVSFLLMFSWDGPPSQPTPWVLSGGFVEEAAPSVGLRGGGALWSACPRAWFLPEDCGSVRRARSPVIVGRQRSVPCVARVPVAGEPVAAAAGNTVAGAVLVARVGGCCLCVRTASTVYGDPIVSWAAFLGTPFLSGAEGHAGALWRASTSDPFYNLYTLDLRLGAAGAGGAVRGSRLVLSHLPALSPCPRTPGTGTRCVITGWGSVREGRLQWRRELLNAAVRLLSERNRAGASTQCEISSRMLCCRLPAGWRVHVLGVTLGDPVSCGEPSGRMSAKGGP

SEQ ID NO: 1013010 - protein, 132 aa, Homo sapiens
MLTVVCHSTVVGTSRSWDERGRTLSLCAVGIVRQAYRMLCRSMMALRHSPKGQIKMKIVLDSMSRGWTRQVKLPFFVDKHAFSREEVTWTEIGTEMRMQSIKALLIIGGFKVYLGLLELYSRPGEHEEFCVP

SEQ ID NO: 1013011 - protein, 241 aa, Homo sapiens
LAGEAAALVDVQLFEISLSHGRVVYSPGEPLAGDRALCAWGHRCRSRSHPVCLCIGSCGVSNKANDTAWVVEEGYFKQFPVAGDNKVEPALLESNELPTSMVPCFLPRDTHDPIEGPFGKIAAPGEGRINTPKGFPRITSAGLVFYILSPLNLNRQSQTVEQPNVAPEQPRSSPTSVVNDGQRVSSQSSTDLLRLCGGAGTAELHADVENQSGKDNQPCGWPVCCKKVSYKAKRWIHDVRD

SEQ ID NO: 1013012 - protein, 194 aa, Homo sapiens
VAPASYSSRSLPARFCLPDRLWPAPSPSPGAHLSSRGAEQHRPEHSAGPARSGRMNDFWNQEYGPGSPCWLTVTEGQLKRQPALDTFDGSLFAVFPSLNERANHCNGSANQACDSQFLMTSARTCATCPIVNRLLQTRHVTDAQALTQATFSWLHAQELAAPWRIPTRTPGCAREQQVCQLAFLWANQCSFTLC

SEQ ID NO: 1013013 - protein, 78 aa, Homo sapiens
MAHWKVVHRCDRWCAVLGAAVGSERRNCLLLDCRSFFAFTAPAYIAGSCQSCASCTTRAAAGRRCAMGLEHIVPNAEL

SEQ ID NO: 1013014 - protein, 323 aa, Homo sapiens
RSGSCHRHESPGRGKDRKEEEEAPVAMGLDGGAAELDVRGAGHSCCGIRVDGVNCTAAAGLACPFLCLLPVRHCAAACAAMCLWNALACGRPARRLGSSCPALYLGPLRIALRTDPSGCLRGLLLRVPGCVGMLVLLVCRGGVALGDRKGGPGCPSRVGLVKPSRVRADLRPRGLSLLLALGAGSLACQRKNLLALVGAPYLALLVPFACCGVEGKMLWVACARLVALRVALRDPWKFRDEAAPWGLYIPPVSLLEIRGLALSVYTLRLFPPFLGQSGGNRGLFYPESEGDIFPPKEGDPIRHEVRPVTSSFGLAVPFWHVGS

SEQ ID NO: 1013015 - protein, 75 aa, Homo sapiens
LVRPRSYGIDLSGAGTDAKGVWVLPSPPGPGRGRGALDVSEVGAAAEVVAVNQLGYPGRMNHKRQEDASRVGQAE

SEQ ID NO: 1013016 - protein, 242 aa, Homo sapiens
AGTAPPCPLSLLSEGQSRLLGLGPPLPLGATPSVLGHWELPEVVSPELGPQGWGAGSTAGRGAAPVKIERSGKPLRLGRVGVARQGESPCATCFLPRDSRLQQSAVSGMVGEAGALGLTSTRLPGLSVCHGHDESTAAGDSEAGAGRVDECSKRGLGLRACDPWERSFLGEPPLRWCLYVLVTRVRALLHNLGQGNVERGSSANETTRLSRGCGSGLGWLQTGGRAPSDSDRCRDLRIGTRP

SEQ ID NO: 1013017 - protein, 161 aa, Homo sapiens
MSSTVCPRYVHRRRARASMARTRVDPTCSLHRRGVPIQGARVLGSDQLAPFGLLVERSALVVPAFASKTAARVPCTALSFAEVDLHSFWLLFLAGLLTECRDVLLELVEHHLTPKSHGRIRHVFDHFSDPGLLTALYGPDFTQHLGKICDGLRKLLDEGKL

SEQ ID NO: 1013018 - protein, 68 aa, Homo sapiens
LTEAAGVCCYAPELAMPLKDEQNHKDAVIDRSKENEHSTQCQTNPGEHRLEQEKKWSNWRNVRDKLIT

SEQ ID NO: 1013019 - protein, 279 aa, Homo sapiens
MIRDAWRTSTDGASLIEDEYTGVELLEIAGIAVFFIDTRWGGNPGRMWARKLHHGQRCHFIFLTDLVIEPGRLSLGIPEFRPTKAIKAKERQVPSFTPKDWIVGESPGPSDHVKQGNANVGTNRTFTNNGDPIGKGVTVFATSDYLIGGLPPMGDYNPIKGWIGNLNEAKGGKGPNGEGCLGFGLKESYDQPVKYGEGALTGMVPTPLGEDRPNIGFPTAQQELTPVSGKERPIRILAVETRGIRLTNRIGRVKWETFLEAPVSISILHFRPLGVDLFP

SEQ ID NO: 1013020 - protein, 124 aa, Homo sapiens
EAASLRARQLGVRPWGSPGLAGSTGRWRPVQLPLVLTCCCGPAACGPVSWLTVLGARVPVACLPAGDPWHRVLAAWLLASLPACSTVLWQLWGHLSCDSEYPGIPVAVDSRPGLWTWAWWLAAY

SEQ ID NO: 1013021 - protein, 112 aa, Homo sapiens
MWRSLEPRIACHCNQQVCVSEVAGTLQGEVKVPLVGNFGKVGGLGPNIKGPKISKGFGLAWELVAKVLNNFSQGTEKNNGCLGIFRILPGGVNFQSIGRSNTQNYQNRSRKL

SEQ ID NO: 1013022 - protein, 120 aa, Homo sapiens
MAAVAEGAAGKQRRRLGRFRNIQTSVAALDAVELKRFHILLLSPHPGRCGSWCSLLLARDPAQMGTDCVLAESESGGPVEDMPPTVTLLDERLVPGPCLNDHPGKEGLLLVELEKMWDER

SEQ ID NO: 1013023 - protein, 88 aa, Homo sapiens
AHGRGQSVGMSSLEQLEQKLGSNRGRAPGAGLSWMPLIKPGIGVAHECPNYFLLGPIDGLRHAARSFCWYTLYLVSTAPLHRVWALEG

SEQ ID NO: 1013024 - protein, 170 aa, Homo sapiens
RGLLEPGPVACCLSPASGPAGCCPAERYPLCCLRHLAVCDPACKAPVLELAPCVRPELAPNFGRSLPAPLPAPTRRCRGPRTGSWPRGCAFPGYPWRALRCCCCCRCSRRCWERVRRPELAGPRAACLDGQCDRGEPAGRTATRTASDSSCAKARRTLVSFTADFKKSRV

SEQ ID NO: 1013025 - protein, 285 aa, Homo sapiens
QDEMIDVIGVTKGKGYIHGVTSRWYHQDSCPVKTHRGLRKVCLLLGHGILLVSLLLLARRLGKKVTYHALLRCLTKKDVYRLGQGAYAYLEGRASLYQEARSVLPTVELNVARNFLDHTEAVHIRVLASCDFTLHHPNWDAKVGPDVAAFLVALALQIGALVLEWRKREKQRRCLAPAHLRDNKVSCGRGVVKGSSNSVGPVGVLSAGKGIWEHPCLDGFPYFVAIASFFHQYGYFVTQLGSRTVYPIGATTEGHERRYKVKNGQYSSNLGENLTFENGDQRIPW

SEQ ID NO: 1013026 - protein, 223 aa, Homo sapiens
MPRDPPVAPCPRRTLCWRAVPPVHLPGCSCTPGVPGMGGPAPVDRKAKASAMPDSPAEVKTAEAGNSRKKRRKREGREEEEGKKRRKEEKKERRMSRKERREGEKKEKRKRRRGEEGGRRRRRRREEGKGKRRGEGTERGRDRSEERNDEEKGEQGKERRKEKRKKRKRRREERREEGRGQKREEKETGRKREEERRRKEEERREEREGEREKRGRERRGEEI

SEQ ID NO: 1013027 - protein, 357 aa, Homo sapiens
MTLLYTRTALTQLHTYYLRALSLGSRPHTQTHTGPPLSHQRTGMAPARACVQRKLSPAQPKLRGTAHRQPASSRDTALAPPHSAPPPPCARHSGQGTSARRPVTPQSPAPQATYPSAPRGHPGRHYAPAPPAPRRASALTTNGRQPTRDRDNPAPPPHRPHYPTGQGMHNHTYDSTHTHGSTTRQAAQPSAHTSATPNTSTHSTPHRPTKPHPDEQPRTPIEAQPPNGPTRQHRVETTTAHESVQAPSHPPHDHRAPHLSGKPQEQLRRQVGPPPLGVVQRILLYFPKRHNSARLSISNRIRGHAHPLPSINSWRRCSKSCGAPYITIAHSIFPTPYYALAAHVTSAQHGMQHILAC

SEQ ID NO: 1013028 - protein, 157 aa, Homo sapiens
WVTWCWPHSQIRDPKPGCSPVSPCPQSLRSPQLVTIPTSLPQTVWALVRTHMKRLLVPVGKSGSSRMTMPSTGWPPMSSSRPVSCPEGLWLVGVRSGRQDSCLDGQLTLPRPCAMSLTDRGVDELREALCLSCLGGWTWVSWRAWAVGSGPSGLCGT

SEQ ID NO: 1013029 - protein, 210 aa, Homo sapiens
MKRDGGRLSEADFRGFVAAVVNGMRAVARRSGAYAVMADPTFGALALEETSGADPWSWLSRDRSWSGQMALLPASLWSYAFHRAVWVHKVRPGPRDLALGGNVACKVPIDQRDVVLGQHKDGHLWHKPASLIPGIQMSFQMAQKHDCTVHGLAAKCGASVYRMRSRSDAGLRPLQDRKSLYLPGHRDLCTSTTRAQDLPTSTSQGLTLKS

SEQ ID NO: 1013030 - protein, 142 aa, Homo sapiens
HALFHAWDQKCREPLFSAPSRQTLVPTMVVAGGVWTTAGSMRCLVPLVLKPSFAWIQLLSVVIHAGWTRASFRGPLASMLEAALDELQRRIYRLGSMEALSARSSYAAAGLGRVCACGALSSLSALIKAALVVPREPDERTL

SEQ ID NO: 1013031 - protein, 339 aa, Homo sapiens
KRPSERRSLSFCHGPVDAPPDACWLLLCASGEPDRQLAVFVHTTLTLLSGSHPGWTRLSYRSVCGRNARLSFYTPERLRPGAAMSDLHGWRHGWQLVRRSPWARASHAALCAPWTEDPARKLVADCRNNIASYQALSLPSYHALEDTNYQTEKLLDPVSAKTPLIHRHSPSMSTQREEQWEINMPHLKPRGKRHRTIYSQNEQIQIDDSQAGNNTIDGKLQAARTAINHIHDLSQEVGAEHNFPWAQPIQENRVHTENRGSPPKIRHGYPGSCIKHSRKAAQRLVTTIRYKQVTERDRPTHRPNTPYILPHLLSNQRDPTTHTLKVHRRKQHIDTVNEE

SEQ ID NO: 1013032 - protein, 366 aa, Homo sapiens
RSEADSGEPGETPPPSPCVAAGLIPVLRARGDGRDALGLSVTRARPFLASLDYSTAVSQPLAVILLSPSDGDGKMCCTGAGMDELAQQALRRARARLRGNASRVGLGLSCAPELVPRPGRWMPKLVPRLGDPGWALGAARGLLLPARTAMGHTGHGTGGTHNDGREDTSTHKREERPQNHRKDRDREGRPAQVAQGPAGPPQERTAGDQMARTAHRHREGRTGNDRTGIDGEQPGNTQHEPGARRQRTRDRQKMPRQHWGPPRNEAPQETRLRSAMLTAARRRGRGVERPGETPPPPAPRTGGDHNPTGHASAARRRQTAKEKGTLVGGPGRDDPRPAPRPHQRDQRTDAARTPAPHQRAHPGANG

SEQ ID NO: 1013033 - protein, 105 aa, Homo sapiens
MPLLSAYGQRLWGVSNFPPSVFKFRVGALEKHGRWFALCGLFFGSSVVRGREKLAIFLHPQRFPVEFIAPTKEFPLGRANANPERPKGLGHSLGAQRERVLGRSI

SEQ ID NO: 1013034 - protein, 281 aa, Homo sapiens
GATGRLTPVSTRSPGDERAGAGRCSALTCCRDLGPCPLLRRCPRLVRARASQGASVSELCRGRRPRGALDECLCPVVAWERLGRCVPGGDCLVQREVAVSSAVPDSFTLDPWPCSNQSLRLGRCSLHARIRANQSTFETNTGPVARTGAALTSTEGVNSDEKRKRHLGHKLARFDSITGCPKSSDAKYALRFGQRNLFQNLTEHGNSHVEDLHGPTDHGKNPCRGYGSGQIGKRTQLARDIGPGSDYIGIYNPKGEGLSKTNDPNIYPISKRIIEGQKQLG

SEQ ID NO: 1013035 - protein, 391 aa, Homo sapiens
MEGPRGWLVLCVLGHIAGLYGDRGLVPSTRRDERGGMEDLVETWVRTGLKGRAKGILGCPLCIRTVHPKALKGDLVGIPGPSWKPPWLMVVHTRMGPKVVPQSVRPSGISWDIMDGYQRVQRQVEHSEENQSRVLMAILRDPNFSAGRPRAQHGAGAPVDGLKSFRIPGTPSTQYLGELRPCYTLNSDRTGTRNLGFMAKLVNPRDLPNRTIIKPLSPRVDLGTPKDGGQYTFLDPWVPKSGIIPSPSTQAGHNGLPRNGTITPLGGQYPEARHNVNRRITQPGAGPPYSADGIGDWITDYRANFRIGAYTDRIRHNPNEGRLYHTRGYRRGRLRNDQLGTAPGNTRTGCSTTYCVPRGDLSLMWPGSRRGSCTVLGLSTYAYLIHQVDGH

SEQ ID NO: 1013036 - protein, 126 aa, Homo sapiens
LGRCCVLADRGLPRLRPDAGPVLASCCLPGPCLSLAPAKSEALRQLEAELERRIVSAPCAVDAGCPPTLGAECAACSSMLGALRELPRRQCGCRRLLLINNAGKHPVAGADSPCERPRSYHRLGES

SEQ ID NO: 1013037 - protein, 137 aa, Homo sapiens
MASLILAVVNLTSRYWSLPRVFLLTRWTGGLDDQVRPLSISFVMRSFSLVSCEIQKWQHCVHGYAALDDTVETVVMSPITPYANSACVWHDTQRGEIKGTTQSQINGANGGSNGRWKLANGEDLMPIKCNSARWLYG

SEQ ID NO: 1013038 - protein, 74 aa, Homo sapiens
RGVGEWRVLTCGATRMACLDPRTCMPGSDSDLRACMLRVFPCNSVAVFGLLMRRLPLVLTTKQHNHTQTPIHRR

SEQ ID NO: 1013039 - protein, 282 aa, Homo sapiens
MDKPGGGDWDQMGATAHTTHNPMATEEISKMPSIQTSHDCVSYSRPKNMDDTSKRMHEKHGRPSYRPGIQYAHKGSSVTPYSTMCMYDTLREREVSQCIGHTVETRTNEIPERNSTPYTMHNTSEKTNNNDDMHNQNAHVMVETDRRHGDRPKRRYEEHELLNPRETQPRDRRITTPNWKAGGAGTSTTSPMHQKKNKDAMRQGTAEDNRGAERQVKNTNIDHIRPEGERSEHSTPHEPTKRELHLVEKQRSKRTSKWTRANGSGHGSDKQNNTIREDDNHN

SEQ ID NO: 1013040 - protein, 285 aa, Homo sapiens
AGVERIRAILLPPRCAICGSRSGGPESGAVPAGMWCVPVCGGCGALSGVPRHTLLCDAAAPALDESDVPCAAPLLEWQGAVTSALRRPLPALHAALYVCAAGQLGTAGGRLLRPALRYPVPQWLCPVRATRSAQWATSYVVFYPGPLPSLFLLELEALRHGARLCLQAVKYLIVRPSTCSFWLGRPVAVLGVRQFWLAYNTGGRFATLSSFLSQSLSDANLSHHQPGAFMSLAIGFVGCLGLPSTAEQRCLLVTYIPACMHSWCSCMGWHSIRPSLLLRPTRDKT

SEQ ID NO: 1013041 - protein, 197 aa, Homo sapiens
GSAGGERWRELAAYELETMLLSLVLHTYSMRYLLPCVVLLGSEPSYVLAWGVLRFGLRLPVRPFLPCARTIVSCTCVYQSMVLFFFYNSPCSSVSRLRSSPGLWCSILSSRGRGRFSVSPAAGEGHPAGLGGSSSDEARAASPTFLSACFLPFCRDRSLGSCGCVVLRLRVGPAAPFPGPRLGLMLLSKVGADARFK

SEQ ID NO: 1013042 - protein, 176 aa, Homo sapiens
ENKETGGDGSLSLALTLLLLCRLSRCSGEGLAGAPRSRPFRTDTQLLSAGQLSTEEPFIQWLEISLKMQEQGSRTWLSMLTSVENNSRVTRGQDVGRYQDVLEAWSTERRPLQAPDECYDFFDEEIRTGSSGRLIGSNEDISIIPPLFTVSVGPIGALGTGPWVSTRGAGCGDRRL

SEQ ID NO: 1013043 - protein, 221 aa, Homo sapiens
GSHAASPCPRVTLVPWCACMPALCLLWRWRSGRGGERPEGWMTLNGASYGQRVTPPAGATSPGGASSVPPSKRKAPEWSSGIRSLECVGPGYCHSGSRSDQRCPEGRRLARCLEEFTAAPGRGWLDRAPASPPTAGPGPIPGGCMRQGVETERTRRKPEREGLAAEGLGDLLVDRVAPLGVPSLALTRHLPGPSERSGRLYSKRTCACPYSQSSQELPGLA

SEQ ID NO: 1013044 - protein, 270 aa, Homo sapiens
ERVGISRDNWHKRRKYRGLGDSPTTKKRKYEIGAPSANSKIGPSALVHTDPLCGVEGNHEQYLCRLRLDVGNFVLGLMSVSTRINKEQSDVVYTCDRRETDAGSVARDPWVNEVALSARSRTSKHRIPDRVVRTSPASAAASLGQQEWEAIGVTPGRKTEDFYHHTHKRIRIEDNFYARETTGLHKANNTNMPYNCHASSCRRMEPRFPAHGAYAFFGGGYQRILEAWRADSSARSRIPLVVLETEQRKYGTFLLVKRKRFKRRANKGNN

SEQ ID NO: 1013045 - protein, 189 aa, Homo sapiens
CLHTCLTASYLFAYLCLRVVFLWRRSLSLGLSLSVLSLAHCFSLSLSCCLSLSLALVFHFPILPAIPHPTSHTRRRPLCDQPPSPSTPPACPPCSCAVGSRWHLPDAGWDAEASATGAPSRIRLSRVDARITQWTLDGGAPWHVTGVARGTCGPSYPMPGPTARLPGRCHGPLSVTDYKNKAGVKPGRA

SEQ ID NO: 1013046 - protein, 460 aa, Homo sapiens
DKFATGCTRCPCDCDRHVGDEIVTSYRGALVAQHAVSVHLYCERESRYAVRLSTMIYELGLSQWSVRPLPDDGHAAKTTALISIVAIEQSGVTSCWCTVRASRRVHHWRGQEPGHLVATESLGQVHRRGEAWCRELLEQTLLGDTLVGEQPMGIGDGSRPYVPPRSSNLGDSRTHGRLRRAYARYCGLHALLPSLLWRTVPTLSQYSLVVKGPNGVSAPIGLCLLGSRRQFVQRRSKGAMSRINEAWVTIGDSRLVGRPVREVPARARIATPRGFWEAFVSIGGDWLGGGPSGCEPFLWRQYEGEGAGPFIPVGGLGGTLWCFGLVSTVGSSRLGIRSLRVLRDGIGLRRLAGFQLFTCSYPPFFRFTSWAKKLGGAPQEDKGFPMPHPSCGEGAFGERVHEPFECILGGVRAFFGGVKANTHYHCAGEPDRIFEQEYRGSRERQQWWFGGSKLSSAERK

SEQ ID NO: 1013047 - protein, 92 aa, Homo sapiens
ERGTLCAMRAKWRKKRSAQAEAQKKKDEAEVQVNRYLSQRGGAQEQKALEMPDAGDAGSKLWDVQWLLSRVLVSNGIVEPFIDPSDSPYHHL

SEQ ID NO: 1013048 - protein, 263 aa, Homo sapiens
QPLRARLLHDGFAWGHLNWQSQRVRELRDANRGGWPQRGWCGEVHPRMCTVGIWGGEAGDDEPWTPTDIVPWTEVACRVTSRFSLPYRSGRHVDCGIPESIENGKVEDPESTLFGAVVRLHIVRSPYYYTGKSGRSVADVVTCAGNGSWVNEVLGTLELVRNVFTRLVESRLENPLTWKKRWRMTCEDPNADYSGTLAAGQALLSYKRHGDWVEPPHELSYLGCMNGCLRKLEGNTREPNECYDGVHLSCRTLNGGTRDPKMP

SEQ ID NO: 1013049 - protein, 46 aa, Homo sapiens
NAITVRAARALADGNWTLERQRHETPPPSCCCFSYSCSRATGLVPE

SEQ ID NO: 1013050 - protein, 155 aa, Homo sapiens
QSWCTALSLRSESDQQLSPQDQKPELIPWSSAGPWPAGGLLGLMSADALSTDSGELWVPPTSYSGLWQQGMGTSYQATSSDSDFSIWLSGARVVSFLVLSASPLTVPPRPRPACLNHRSLCCSHLHGGGHGGVHHASGGDHASTPMIPDASSFLC

SEQ ID NO: 1013051 - protein, 67 aa, Homo sapiens
APAMTVTLRPYLSAVRAMQVCPRALENFSSQVVERHNRCRKWKSVLAQLNLRNQSHITDEKIEIPTG

SEQ ID NO: 1013052 - protein, 194 aa, Homo sapiens
RPRVTWTLRPYLSDVRATLQAALCLENFSSQVVELTQEAGSGSQEVAKSSCYNAVTISRNDEGTRLRIEGSIRALSGSAEHVKQADEIEKIKCHKFMRFSDDAAENFFILRRKPVAGYDISFLITNFHTEQMYKHRVGGLCDPRFMEEMDKEISEMKLHVNARARIVAEEYLKNYGITNLDWISMGLHPHQTDP

SEQ ID NO: 1013053 - protein, 332 aa, Homo sapiens
AGTGNPASCGLLGTRPGGYVVGRSVGTRGPGGCAGSEADSHFGNWLNDAGLMSWSPMAVAHSRTEFRRLARVGSLQAHWSLEGAQGQLLGAFAEDAHRLSSHGGTRSARRPRASRQVGLERVMQSSRVRSVAAARSRRLMPRRLVDGPIPPRLAAARLPYDICQQGFKGPWHCAHGRLARLLQLGSTLSSLNAGSVMTRAWDLFATETGMHRPVTQKLVPARSHSKQSWHTRERCGETPAVGEPSSGRIPGLPPRNGGWDERGHTAMEAERVDARECLEGEGIPRDNPVAWGWTRLTVISSDNLDRRATAALGGPKQAPEEPWALTLRRGRP

SEQ ID NO: 1013054 - protein, 311 aa, Homo sapiens
MEGMRVSLRLSEDNFWQGSLPGLLEEREGAQCSSGTEVRHNGIRLHLQGHLSKPFEPIVDYLEKYDKFGSRRLCREARFLSTFCKNLLQDILPEDGVKGDLLIDIGVWTPQSIQSPLWLVESFKEIVVADYSEPEDLQELEQVAEERARGLGLVPQLVTYVCDLEGNRVEGPAEGGEVETGGSSQRAEVCTVTSGASLLGCRTPYPLGLTAVLQQTLCLDADWPMTSPNYCRGAQEPRQTTEARGAYLVIMDVRSKSSYYSDRGAEVLQTSPLGREAVRGCCERGWYHNRMVEVISQRLFFRHWAQRKDFF

SEQ ID NO: 1013055 - protein, 444 aa, Homo sapiens
MRTNVRTPGGFVRVATGPGVGSTAFAEAVTSGLGKRMSTRLLFPGSPELLSPTSSSSLSAFRYPRQASSTSGYSAFCEKSQVHGLLLFVAADVPARTSMASDPEGRAYLGGVRAWIVSLEDEAGKEARSAYRHRDVWRREVSMTTPKRRRPRSKEIWTLAHSVYPGRYDQELRVGARNPLWDGVRRAPHVALRVASIDPIGHPGMGAIVIVLAPPFKFRLNRGHNGRTDGVNVCEGDSQTEHASLLSPVDVNSKEQGVNRNDSETFKDKNRCATRVYKGHGEMEAQSSVGERDMLLEAEEGHNAAFHGERQLGGRSLLVHHRRKEDKEEPNLEHSNLKEPFPIKCKQQIALSHSQSFTVRTHWEWKHIKRGTPPLKNHSFKVSLHHVSVYTCGQLRGNVTGNGYLGDDQKDTLVPFGMAHSERIRTWSRETPTAAGAPISCGDV

SEQ ID NO: 1013056 - protein, 231 aa, Homo sapiens
STDVLPGMKPDPSRIARPAVRLLPCCYCACPPSSCFVANAAVRCLLLRRLRGRGAAHWCSPACLLPPGAVVAVLLPRGGNGLQLVLGCTCCCALAPCLGISLQLVAVDEGIGGYLGRGVWLAVLVPCAARWELPLTVVAYEDLFGGWTMDAVALQCTAGSGRSRSCCTFCGVLRRQGAGGRGAPSWEPRNIVQVTTADDMAETVLHELPTGLTRGWLARVRGPGLSRRGGR

SEQ ID NO: 1013057 - protein, 227 aa, Homo sapiens
MEVASTGSTIEETSLLDKVLEAHRAWRRVAPRRCVPPSGGLQGNHVYLQGEKKGNSTYIQDIERQGGGVRARSEQTKASPPRGWHRERAEGRGDLTRVSKGGKAEVMGPAGTRDVTVRETPKYKWHKPDNRGHSRRTFYHPGKGLLGQPSWGRHQQTGAQTPGGGKPFAGEEQRDNPPLNVQHGGAGVGDTNNTEVGGKHNRMYPPLTTEGRHSNKGVLLRGGRHII

SEQ ID NO: 1013058 - protein, 164 aa, Homo sapiens
MNVMEVTNYLSSYTKRNLRCDCGNSNVKTHILECKSYVSVTKQEVHILAIQYNDNFSDCTAFDKRPYPDPEDEIPDEMIQMRVCEDWFHGRHLGAIPPESGDFQEMVCQACMKRSLLCGLMLHNGQYTKISTEDDGLVRNIDGNEVIRHVIQTCTNATSINDST

SEQ ID NO: 1013059 - protein, 222 aa, Homo sapiens
ASMKAQLPAESPEPSKLFRGGRINGHVVFLDLLTDYLADIDEALAALTVTLQFPLQEFILAMGFFLVLVMEQITLDLQGAVRAVTSGGNKGSAGNSEMVGRSIGMMGQGSHRTSGATSKPTQHLRACVLVYSLDPHSSDSTRGMAVEAADETGTRAMELCLAYSMHPQGASWHVKPVPAACCRATIRGTGGGWTCGILLSSCMTPLGIGLGCRSWQEIGRDL

SEQ ID NO: 1013060 - protein, 104 aa, Homo sapiens
MSKLVAYYCYSKLINNENCNQTEYSSSALVSFSRYAISMFSRNRGLVGACSNTEAGEYRRLLNKAAIYYISQQDLRSQCSKHGLLYVLCTFDKARCSCAPRVCN

SEQ ID NO: 1013061 - protein, 116 aa, Homo sapiens
MAILQAADGGAACLGSQHYEDCQPLASSETEDAGTLAGVTTELPHEMGREAGQERHQLSQGSPGNLHMLLGDSFPNHGSFAPSSFYWERWGPMTEARTDGLVGRVYTILSQALVFP

SEQ ID NO: 1013062 - protein, 146 aa, Homo sapiens
MVDYKEEGGAVDGMYYEKEINEGPMPSSCRYIGLSLQRCTMDSCSRPLARCRATVNNECPRQGGHRTTLIDAIQMSCATPCDQHPRTTTRPDLRHRAIVPKKQGVGNELEGGNVLRLLRERLDAGSDFCRTSTGGRSCHVRRSRIE

SEQ ID NO: 1013063 - protein, 158 aa, Homo sapiens
IETAVDASALQCLSAEEATEARGREEPAVALENYAPIPGRWCTRISLMLHGCSARLGRSCRAGGRPPPGTCAAGPVLADFARYRSTSARGDPGLSPAPRGRCWRLTARDWASLARQPLLAWPECTDCRSWSIRGWARWPLTAFDGDSIAGWGSEDGCT

SEQ ID NO: 1013064 - protein, 402 aa, Homo sapiens
RASQRSAGRESQYERSQHLAGWMRRKPDMHAPGFVRGPEGRPAKESAHPWQRSAEFMRNVSEGPRCPDDGFKLVMALLCTYIFVALEEEIERNSGRAPVFAPVYFRQESSCNRYGLHHGMQGPWSILVAGTQRGREVITAYIDLVAMVQIDLVMDSVPPSRGGRRGIEARRSLAGWGTHDRITSCTLGVNPVPGGAEALLSHHNGISHPMKTPRWDPLLTKASGRRPGARELLIVLHAYSHTSIFASGCSNRRVPTSPSASLARRTPGSPEKYFPPGDSELEGTSGHGTVSRDQVGWPFEDLDAGLWGTLARFPLGASGFNVPKDYSFTEVTEQFVHRCEDLGPLKPPKLETHPRECGSQRKGPRLFRTRWSSPHIVGHFPVAKCRGGPTRRTAKKRVCPTA

SEQ ID NO: 1013065 - protein, 343 aa, Homo sapiens
MRAAGGAGLAPGLAMFRSLVASAQHACMPPAGPAGVCQRPGWRMYTCPICLEVYHRPCGHLAAAGHTVLAWDVSPALPAVCHPLLCPLCLPALLTPEKGGQGHPQWMKHALILQMRPVEAATKNGDPGKKMRVHISSCLNGPVRHDGQLTQVRPRGAHITAFPSNIPNRSTFACPYCGARKLDQQELVKHLCGKPPRDPKRVVCPICSANALGVTPGTKSANFLQQLVQRNKYSYDTYGWDYQYMTRRADYQGEDLDHELSLRNCTGSRDSRQKTESKGKVPENHGEPTHENQEQEKPTSTGDNTQQRQKHGTKSKKGETGTRTNETQKREQNARRKERAADP

SEQ ID NO: 1013066 - protein, 109 aa, Homo sapiens
MGGHGAPGKSRALTWGSSGEGGRGTRLWSPQKRAGGRERVRGHMSIGCPRGATLPARCLEQEGKIPYNFKKTEKQKKKGYGTAGITREQVLGNTQVCPQDARGGPPEGP

SEQ ID NO: 1013067 - protein, 34 aa, Homo sapiens
PVVVLRLSGTRHEGGSIAVGLIAGSVFLLLLPGP

SEQ ID NO: 1013068 - protein, 81 aa, Homo sapiens
AVNMPGCVDHVARRAMLPPKCHETADIIDEEGSYVLGDRNGIWTASRTAAPKLWSGAHKRVCLVVHGHSLCKQHAQQAVSC

SEQ ID NO: 1013069 - protein, 152 aa, Homo sapiens
MSFRFTAIEERMRMSVWLCVRRRVGINMLVVRSSASGPGGKARERATAATGPAAGGRESAPRDAPLRARRSHAEGGARRHGGAPAAADRPATKLPAVGSRRPPAPQSPEHLHPRPGLFHARSGHLSPSCPLERRPPHTAPRSLQGPLRRAGG

SEQ ID NO: 1013070 - protein, 257 aa, Homo sapiens
FQGPQVHLRLPSPPPSSLHRAQKHAPRGLHEEASKQPAGAHSRACAFLPASSHWDSQQSPPASPGPTPLGSREAPARGCLGVRHPGSGRASEMMHDALPLSCMLQEPLCPLPCALEGPQRLQGDCLRQHHCCRESEDCPPRKTCNCGALHDTDEGPTDPPCASAGTRRVTSWGPKGAHVARHACCSWHKIVESLHPSAASSASHHAAKRLSLEMSPVASFERDPTDGDLRKADPHGAQTLAFHCSYTPELSETQGPP

SEQ ID NO: 1013071 - protein, 230 aa, Homo sapiens
PRLAHRPVLIYKNTVAEAGESLQPGRRRLQCSRDGAIALQPGQKERNSCLKKKKTMAETRKLRDGCHGPLFLPALCPGRFPFLKGSPGSRKRRRWRVDVPGAGSSEALWAASCISRQSQGLALDLRPPRKGPPRRRRRRAVRNRRKTLGAQGTVHPREERLSTEAAYSTAQEPRSWVMQAPESSWRGKLTACKSELYGPDRAARRAARALQSLPAPDAVKSDTRFAQTQV

SEQ ID NO: 1013072 - protein, 178 aa, Homo sapiens
RLSSGHMTHVTLPYYWRWFTFHYPAPLSLYPITYQCSRGTLGPTYMVSVVLVVRGPRRTQDVCLLLTNKIDTKKNTHTYREKRTKKKTIKKGGEVGQKSKIHRKCEDLCSQPVSMSYMQQASRTPAESKADISLGNQVPRTRDIYKQEHCREGRWRRRGQLSSDVTHEDIWKTVYPEG

SEQ ID NO: 1013073 - protein, 77 aa, Homo sapiens
MRYMVPGPHWNPHNDRFVLSKGYAAPIRLRGHGLKAVFPVPEAELLNLRKISSDLDGLPVPKQAFTDVCHWLPGPGP

SEQ ID NO: 1013074 - protein, 227 aa, Homo sapiens
MPHAPRNACGFLVLPTEESGSQTSGGTGCKEDPSEQYSAYCLGSLQPKSVDCKSLLMLRGLPSASNILVWVYQGTLQFPWGCWFRGLRGLAEHHLLPLAVSRALDGPLTNFWSSRLSNSWEPELSASSSTQFIGFGATMADLWHSHALILLERDLVGLTGNLGPLTPVMGPARNGSHGNEDSTLGAFSMHINYCPNFTLYFLNNSLVSHQTCYTTHVSHHCHKLRIN

SEQ ID NO: 1013075 - protein, 114 aa, Homo sapiens
LYQKKWRYFSDLALLYLQAGSPEDPRTYNAHLHNSDTGSVAPQRRYAFSSSILEHTIGCQSLRDAGNIGSACERGMARGRVIFEEALLDASTEASDLTHGGCIRVCSYRHIPGT

SEQ ID NO: 1013076 - protein, 186 aa, Homo sapiens
ADPNEAPCEPDAEQRPCRAKQETGIMDSFNSSAGRGQAPCGLPDCNGARHFNVPLSISRLTPGGKRGAGRSGRGLTGVLSIYGENAGSLTLHLKLQNKIRACGVSLSAWCLYAGTQPCSETKPAEGLRSPPQDSSVGNTFAAHAVYPQSMTGPSLWVRPRSRYSCPAGEWTGRSDRWSQIASKQAA

SEQ ID NO: 1013077 - protein, 334 aa, Homo sapiens
SSLSCVPGSYTAFEVTGPGQTVAQINAHVASLEGIAPEDQCRCSWQARPWRMRPRLVPVRGLERSLTTPGNSMPAVRWQRKVRWCSLARCLENSEEVQTSQRWLKQEEPRHGSKTGQRAKAVAMSDTNPCGIWTTPIVASQHVYGARGHERGTPESVLDFSESLWLIHSACAYVVHDSEKQKARHSKDLKVQSPRYREQTLEHRDTQEQTKARRQARLAKERVCTHAHSEGERPFCVTTPGDIPAARGRSLVCSANQNGGRAPTLLDYDEARSSACILRYERINPRQNLLTFHTHLGPLIADPCHWKGAREADPCTAVLHTPRCAAKHATLVGV

SEQ ID NO: 1013078 - protein, 57 aa, Homo sapiens
YFYPKCELSTVGLGESVRDTTLDRAADTSRSAALSSVESVRDTTLDRAADTSRSAKT

SEQ ID NO: 1013079 - protein, 402 aa, Homo sapiens
TGPASVGHEPLTSAPLVCARRLSWDCGVYAMPRRTRASPANPDLPHPPSASVRAVHHGMGDWGLECCTPAAHPSTMQPSYRLLWSPVVISLASCWTSLDFTLLLPLLPVLFETSHWPVPTEPHLLAPGKGRGGHGYARLPSEDASVTTGPHNVYPWTERVSIWDIATFHHDSMTDIQVMSATSTWRCQYSCTLTYPRQDTTHDMLAADLKWPYGPKLHNCQVLGHHAHRLVTILPEPLLPVSTSPGALGLSCGPHYHHEWGERITARTIPQCATSCLAGNPWGHTTHRLGPQTEKWHLEEEQNGQVRNKKATLDLIQPNVSHHLEKRKPKPMKPTGDKPVEANWSRKSAERTLDERAARNNMNKKNDTEQENKAHKKNGDPQEAETGRQTQKKRTYDDTQKK

SEQ ID NO: 1013080 - protein, 81 aa, Homo sapiens
MNTRCWRNVPWTYSERLLPRRLLYRDLLTPSNYILARCRGPSAPLPARIHDVIRTPYTRGHLFARNCDTNISHAHCSSAAN

SEQ ID NO: 1013081 - protein, 176 aa, Homo sapiens
EEPRPVCGVWCWLVAVMATGLVLADLPWARKVAQCPESRVCLLLQLRPAPWPPPPPPREQFLMKLHEIFLLCLHEDLQVVCPELLLLGDGCGDLKKMKKFDHVAFLIEQCNMWTQDETAGKRWTDVMLRYCTPVFPENPMMSNASENYREGTLLNSISGGEKHTFDSHTVEAGRRT

SEQ ID NO: 1013082 - protein, 104 aa, Homo sapiens
MLCVSYNSILALFPRSVLMSTGGSKILHSLEQLLEGLQQSIFVLALIKRIEPSKPPVLIAIRSLDTLHTQSSGYLCGEHFAAVNEKGTRPTGEGYDPQAKETEN

SEQ ID NO: 1013083 - protein, 217 aa, Homo sapiens
DGDYSSPGQVVSKEGGPETGGWQDGSGCSGREMETSTGHETSYLRCENVCMSYQYSTKAWRALHSHWTARRQARSGPSRSGNEVLHMDASSYQRVCVGEARAICAAKEHEWINTYPCKNSAVTHAERVGAAESVICSRAVYLLELIILLVEGIARRRDYRIQALPWMPAYVDTAYQRRLSEQEYHVSTVPIQRSAMTAKVLNGTFRVSKVKSTPEEA

SEQ ID NO: 1013084 - protein, 234 aa, Homo sapiens
DALGHTAPIAAASGAAWPGLALQRAVLPPGLRSAVTRPSSLWLLLSTLVHRLLSMVILGDLCPIPYHSGDPSSSRVTLPLYLPRMTSKLRDVTTSVIMEVQVFLPGPHRLMPFSPASVYNQLQMPSLAAWEPRLQPHTLSARTCVLHLSGSCGTKQGNAVTLGDYYQAGGLPSPEMLDLTFDQTAWGDKWCVLLLRGLSPGPPGETMRPTQSSSSLCIAVGKSSQLRCTQTFMT

SEQ ID NO: 1013085 - protein, 86 aa, Homo sapiens
MPRQGSELGGTIDKVGPRGDLVDPLCGHTQNDKICGPTRHLVSNGTVNNQSKTYGGRRYKHWAHNGYQKRRNVIAIGIRELPAFRH

SEQ ID NO: 1013086 - protein, 399 aa, Homo sapiens
GRREPGRGWLVQLKERAGWSGPAPSSVPPSRVTFRGPGWLGACAPAAVRRDVRGMEEKIFAGQWCCCVCTNLRGPTGAEVVLGMEAYLMDIPRCDVSLRWTALASMHLSVSLREASDMSPQYSYNAQSLIITSHLLVSQDDGLPAAACPSDHYLCIVSQHFQLTHRHATIFTLQYTKTMSLALHSNPGFTTMHCALNVLFPFSGLCRTTRISSPGSLLQQRYRWASNCRPCCFPRTEVYRALERGPTLMPFGWCVPTSLVRLVAFSAASLFLYSSDVRDPLGAPPCAVVSPSGRALYQSPCLDGEGYPFLPPTAKSCLDLAAFLAGWYHRNIKPFSADLAFRFVSSCFSRRGRLGPLWPPGDMASLRLYGGYLWYYCPKCYIWSGGFGGNMPFGYFVVP

SEQ ID NO: 1013087 - protein, 185 aa, Homo sapiens
AGLRRAGWPRVPVLGAGIHSYCRNPDRGPASGPWCYVSGEAGVPDENGLCECTWRCPETTSQCPVHAFTYRKSSEVVLKGLGANGMSVHAVFDILTIARDPRRKGGRQADAAQVIWRSAERVAVINSIGENGTWELWATMLGVIIDGDRSSAIGSLASSSGYSYKQGAMESDNAPTSLHSRNTYL

SEQ ID NO: 1013088 - protein, 170 aa, Homo sapiens
MAMSPPHGAAQAGAMVYRSRSSSIVTRQTSDHYVPITRVKDVLLAFSDVFSIVIPFSLIVSRTTSFSHSTLCGWRRDVTQRTVDSLFGSMRHDEMMDDLNEAKDLCTIPLNALEQGIRIVVEYAIVVPVVMATCIAPEVKTCDYEDNILVRAKADANLQIENLAATDSTR

SEQ ID NO: 1013089 - protein, 279 aa, Homo sapiens
IWKEQLDFFVRQCYEVVAPDLAGHGGPCSAPQVAAAYTFYDCWLEDMQMTIFQVAMPTKRTCAHWPFLADPAPGIPEAQSYVRAGRRWLMLECPETVKHAAPRIPALGSPSPRPRLYRSHCRRLQKTRSSRWAGGASLGEHSRSRRRPEPAPGLQRSTILGVACSLRVGGGQVRETPPGCLARGCVHPREPIGHSALRFPSRRGTIGVIGAEAGDLRKDDLVQKLSHKLSRHNARSKGRGAPMPVIFREQPELRPGTHRTPPGKPRGPQTGKTETQTKP

SEQ ID NO: 1013090 - protein, 299 aa, Homo sapiens
RRGQAGFCQALSPREQGSTWGLVTPADSPLLAPTARGLQTLPGSLALQGLPGYRQAAAGACFRLLTLQVAVVPLGRPGQAGRKGGGRAANARACGLPRLGFPSASPRGTGLARSPLCKQEPGARRAAREGGRKAAAPLVAKPPTNPEGLRQGTRVRRIPSTQKRVTCGQSAAHPREPPAGPPRSPPFRTQQAGDIGSIREHPQRPPEEHGTKLKISMKALCAREPQKTPNPHTANKPPRTTKRLPRAPPQYETDTTEGTQIRNPPTMLTSHPGETPGDGVRRTRPLCKRGHIQERHHKE

SEQ ID NO: 1013091 - protein, 171 aa, Homo sapiens
MYQVGTGSTTIPPLSHGYTNTSAGLDIVTRPQLKLFDRGQRRGHTTIAEEDTPPKRIVITGRGIHISPQRRGVAPGDLLTKRSTKQFPPKNALPRPQIGITTTLPVRTAHFPNSHCPPGSYFGSTGHTTPMFDHHVVTNVCGRQTLSTLDAICACTMSLVSPLPNVVYGPL

SEQ ID NO: 1013092 - protein, 233 aa, Homo sapiens
IERRERGFRYGHLMKVTHESKPDLPEEGEGGNALESGVTRDVFLVVPAWGSNVSHGARVALLLDELCKIMSLRNIKPTGARKAHVCRRLDEAKVDPYVLSSPLRHEAMMSTASCMCAQIGGEHSSFKYNSRANPVGNHHRRRQSTAWLEEGHINKGYETVSRETVCEESLPKHEFRANEGGISTMGRKKNTYDKCPNVCPGSTAYEARRHQGSRTTSDEPVKGLNHRDRGVEQ

SEQ ID NO: 1013093 - protein, 96 aa, Homo sapiens
MHGKGKRLDRLGGYPQASGSRGTKNSMTDPAVRHPPNQKGGTPITGRWWLSRVFYALRDWCIASDRFSPIASTWIGVDRLSDLGVTLAVDMEQKDS

SEQ ID NO: 1013094 - protein, 212 aa, Homo sapiens
TASTRLLPVYRESTQLPRPFTSTAAAGMAASVEQREVHHPWCRAMALFFQMMALSLAVGHGSQFYCICLLQWYSASPPHDLARTWVHCTVLCPCAGYLGCGHLTCQVWGTPMDRRTPLPLKGSWPLCSFLAAVVDALDAGPPGCDQSITDVAMYSLPFLTVPGLPAPVALCQCAPHLHCLSQLLPTIASVKSLSSDCLLARTMDPMGSLTWR

SEQ ID NO: 1013095 - protein, 137 aa, Homo sapiens
TEFLGSSVKAPWDRDIDVIGEHMLLSCEGEQVNSTRASLRDSPSMGQSQRGPEDRGPLRRWRGRAPVGSLTPDWSWAWEGVLSPSAPRWVAQELTAHLWFLSSLQRIANGFMNHGKQRMLFYFSATDLSKEISRCLI

SEQ ID NO: 1013096 - protein, 103 aa, Homo sapiens
MTGGVDTCTDDHDTEDTERREVSSRSPRCCGTVRDYTQHSTLSLYNHSRLLHPNRERMSQTNDQTMKTSERNAKEREHKGMEAMRSKRETNEEERKRIKDNRR

SEQ ID NO: 1013097 - protein, 253 aa, Homo sapiens
RGDGRFGEAGPTALDSGADSGVRDTLAVHEPGSCLRYYSDAEVLRSRAHPTPLIRPTSGSTLLVSDGDPSSVLMPGDAGGPGAPRTGRMKEFGFRGTDGPCCVLLQDFGVHVQVAEGGAPADFYLQVDRFSLLPSAAAPATWCLVATNDLRCSAQKLYELPCRSTVCTQLHLVAMPGLITVPAFLDANAARDQERSGGTRCAWLKRLLHTGACPLHMHPPVDPLGLAHRMQASGRRCVRCPPAQCCGSLSMTS

SEQ ID NO: 1013098 - protein, 155 aa, Homo sapiens
RGPKQLQPVRVLPRCLAVADAAPARGRARVPSPAPLRCGAAWNLCLGPGRYSRLLTLLGGLCCLSLISILGCRCGHLRSCPVPPVPRGPGAVVSPGPGGSACAYKGAEAGWWPGEHCSLNRQAVVQHQLNPARVSPGVPHGNDTHQTEGNTTCNG

SEQ ID NO: 1013099 - protein, 161 aa, Homo sapiens
MRYIGILVEIVASSVPVTQIVNIGPVYDKALDFPGFLDYDGTVRTQADAVHRSPTARLRAPDPEASLDTTHLKAWQALSPQSMLHVPILQAVKTTDINDPEQQQAKADTRTCIIQASIFRGVRNLAPFPLLEPGDATPYCVPLAAIDRLGPGAYLVYWYEP

SEQ ID NO: 1013100 - protein, 145 aa, Homo sapiens
MQVLGFGRDPTSSGGVVATGGRFISVVLWCLLHCETGVFVCLSCVGTSRRRRGRRAPPCELLSGQKHYDLTVVRDCFACPLYQGITMFWAGPVYLPASRDARSSRSLLGSPSLGPAVTGRCDACDLTYLAAVRGEQWTPIEPKTP

SEQ ID NO: 1013101 - protein, 31 aa, Homo sapiens
LRALRPVPLPLPPSTSSTRTGRALAAKLYDK

SEQ ID NO: 1013102 - protein, 149 aa, Homo sapiens
MRSGIRGLVFEPMPIGVLLHPNKKSTTLKIVDLQEKEETQENKRESTYIDNYRWEWSRETSGEYTALLEGRQQRLPGLSTNPGLVSQTRRIARLHEQMGDHVKITDNEQAPIWQSPAYLTMHHLAGPHVAEKTCANDLVAKPCNERRPS

SEQ ID NO: 1013103 - protein, 102 aa, Homo sapiens
GAVLPARSLLPLQPRAPRRGLGRLRLQLPAPCLFGVSRGLKARPASLPACSLTCVADVLACCVGCPVLAAAAVLLLSSGGPVPGPVACTTAVVPALGIHAAC

SEQ ID NO: 1013104 - protein, 223 aa, Homo sapiens
PRAHVPRPGWRTGPASLSCRMTPAPWGPDSELSWAWPISASADLLWIHSVWHAQQSQCRATHLQTYIRQREMKWCGDDLALGENHVPGWYKNGKDACAWKGIPSALTRPDAGPCCVGPMCARRTDLAPISELAECPWRPTVDGDHWAVDLHLSIPSALRCYVSPQWPQGSTGAPAGAQWPTPCIDLDAGLLPGPVCPVDCLCCSMHTCPQEDGLHAMPWVQKS

SEQ ID NO: 1013105 - protein, 132 aa, Homo sapiens
PADACCCPAGGGGWSLARSLVLADSPERSVAVGGRSVARAGSVEGGEAMSRVAARDVCLAGPGVTWTVACRSFFPRIQCCALSWSAAGCLPFLIIDRALRLRRMPDPRTAGTSKPERGADQEPDQTLDTAAS

SEQ ID NO: 1013106 - protein, 92 aa, Homo sapiens
MYWFLQLLPSCSLQGCAPCGGKLLTVRLASLQGSKARLYQYQCDFGSLPSFQDFTLQQALDVIRGVFKPSSTLLTSMAGIYVLQAHNEDVHC

SEQ ID NO: 1013107 - protein, 286 aa, Homo sapiens
MDGGGDSQGGRVTRSTYDYETVRNGGLIFAGTGLHSVCVLHLSFFSVKKSSDVMSVAHYRSAVLNLHDRCRPLTCLGHRACATTLHWRPGWEATVMALPSGVRPLLPWAFRPLIPVSASAWADWKLQDSIVIPLGWHSRNCLARATLQCLYINAWRQEHRRAVPQTERDTRRPLDRIHRGGALKVEESPGGALMLAVPGEFIFEPGLGCPLVCVCSYWRRVESSAGSALYLPGVLVRVDTTGALLACPLLARGWQLLAAVGEPHLVSWVGPNSLDGDFQAGYGRVP

SEQ ID NO: 1013108 - protein, 220 aa, Homo sapiens
ETQNVLEIALRLEMWAELCPSAKWRHHPLQPGSVECPTGAALVVPSPTPACSENNKDFILVIPLASAISCNREEQLWPCSVDGSCGLECSSVRYTSLQQWEQHGELETLVACVPKNVTKPAEMLGICTLTCIPKVDRWSFGIHCQIENNVEVQGCLELTNSKLKTRAELGTARVNEKQAVGVDMEDLGYSRAPHPFITTDPHNSSNLDGGANRGSLGSTP

SEQ ID NO: 1013109 - protein, 179 aa, Homo sapiens
ALCVGPVDPERLMVHSTRLGELVCGEHGLGLRVLLSAAPASGCWLCWPACGPCAAQGRTFSVLLARLMCDMPRSSPEVQQSRPMHDCPRGSLLNVYLLHQRGPDVGSTWGRLWDTGPKTSFSYEDGGGCPLQDRRNPWATIDFYRDPSDKPDLSRMQPAQQLSDNLAPYTMPSAITGGQ

SEQ ID NO: 1013110 - protein, 282 aa, Homo sapiens
ALHCAPCASRHPSPESLITGSRGPREDGREAEENQDHLCGGWAWLMGMAASCEKIVQEVWLHPPLHRVDLLRVLSVKLTARATGARMLSEITGERGHAGSTGGQCLDMLRVMPWLAKCQVLPQVLPDMMATRGQVHAKDEQEFDATDCTATLLLYVERTCPVRPVTQWLVETLERPAGVWTDNEETIKKRVENYYKATEPVHRLRMRNCGTCCAIVNDWRAPWTGVFSQVCTQLGRPKVATLEPISAGQAGILPRLIRGPPGLRRKRGTTTDLLSTDEGSRI

SEQ ID NO: 1013111 - protein, 166 aa, Homo sapiens
VYKGQGFSLSVCSLLRNLASLVSYGLHEFLTVSSQGPSGLSRGLDDSLCAVAKSFDALASVKGLPGGRSCRPLVSEGAMPLVPWARPPGPSWLELRAPCSSSRERKSLWNTFNNHSGRFPEQFLRHGPPSCSKPAVQLGAELMEATQVRGSPSLSAEWDFRMTLDS

SEQ ID NO: 1013112 - protein, 185 aa, Homo sapiens
MALVPFEETCYGQSALVGNGTMASFLQTVLEIGSERMRAVIAGPALIFTLTLAREAETAGMYGDQQRDHGYVLTSLADVNRIFTPKGRFISWSHRKPFNSRQTIVRIQLTHRETTQRTVLGDCGYGTRVADQVTAQEKPTGTAAVGTTKHNAAGTVEGYPMGLGISRSLALCGGTGPENNVCKRP

SEQ ID NO: 1013113 - protein, 309 aa, Homo sapiens
MTHVIHNALRLGDTLQSPEHPRSLQCSRWEQTDLTSNPPGPPRLHPEDCAHGFMMDKKWQRWRVLSYQLHRLANNGNTARLLSSSLGRIIPAIWFRYYLSPITVKYTERRQPLYMIFISHDLCHSLDGTFSRRRASWNSLHLHRPLMAWNERSSWAQMLFDCLLPSLMADGPWASPALAIQCPCLLWPSIWSRNLASVPKGVWEVGGTVAGWLDVLQLPLFPVFLFRQITLPEVAVPLSLGSPKNRVRQGVGSPGILGTPPRRGCSLFPQGNIPGMHNRSALSQASTISQPHQVDTLMIWVSPPGQRTA

SEQ ID NO: 1013114 - protein, 377 aa, Homo sapiens
WDHRSLSSESMADVLSMSGRRTRARAPGRTLGHTWSGGGEARVRHSAVSCGNGKLLQWLIDQIDMRQVPLVLVWEELRHSRRIFLHPLVNAPLVKQDYNREEDAALFKGIVVHLFTRNSSDEGHRTHAWTTSHRGKDRGPAGIAPIETRTQLTFEEKPGLSRGRPTSLVTIRSRPPVTPQVLPRAVANPLRGHAQQTQVKSRMRKPFDHVARETQPDIVSQWKATTRIDYRRVQAQTPPFSPVYTDSRPRMPKVEGIPNDNRLEDRIGANARTSGTREEVLGQRVKLSGEPRGDYKARTRPTAENNSHPVTPRVDIPPKLETSLMGTPPPAEARSSTLGDHYGYAKALYGLKKTIVYLGTTGRRHPAETHHHCHNMP

SEQ ID NO: 1013115 - protein, 67 aa, Homo sapiens
MQRRPSIRGTVKPNAAGKSNAVSIGCPQRMRLWSDHPFSRKEAAREADAVAPGYAQGANLVKIGERP

SEQ ID NO: 1013116 - protein, 147 aa, Homo sapiens
MAIALAAVGALTGALALAWRCFALGRVRGPSRHWVNKPVELGQKNVNSLVIKRHVGALEENTVLADDKILEEYANCYEGPSDPGKFTSGSKVTISGTFKLVAPGNLGTTLDRRDSVTIRELRVEAPFQNFLPKGQDILQRDVVFMRQ

SEQ ID NO: 1013117 - protein, 77 aa, Homo sapiens
TTPTGIYGTNEHRWFKKQLSVRIRMWARSHSHVSPASPARERLGGVPAAREPGGPSESTEGRRRVSPAGGESLPGAG

SEQ ID NO: 1013118 - protein, 179 aa, Homo sapiens
RLRLTSLEVSAELWKRASSCLAFSISHQSHNSTVPPVLIVPYSSSLLPRPYRTESGAPSPLCTGRGSEVTRGRLLLASCIVCLRFYLAAFCRGSLLAVTRTCCALVSPMWEVIPSDRPARGVAFASPGPPPSRSPLETVSFQVAKSSVPVKCILFSDIRSTKYKSLTSYPSGIITITVC

SEQ ID NO: 1013119 - protein, 77 aa, Homo sapiens
LSYVQILIYSKALGIVLKFASGTDNVAFDYGRGSPRTQGCYRRSALGDLDRGELPWARASSNFGDLTIFAQDGELTP

SEQ ID NO: 1013120 - protein, 282 aa, Homo sapiens
GGVSVAVLSAIRSVWHWRPGARKAGAMLAPGAARALEGFVGPETLGRMSGAVLLQRKSEPPPLDRVYEIPVTVMPITFCCGKMHILCPCAWRWPIFPDLGPAGYNGPKCSTCSHPVFTDASCCTKTEACIYLSPPVACLLEGVKQALWLTKTNVNMNVPSLRKCLALLMIQGTTIENQDECVLSVIVSRPYSGRPLRKSPKRESYCPVIVDNLIHAVYISDSQASYIWPGGSVSKNSSFLGNLDTDEVPSTYRVRRNMVEPGVQPHGATAHHGSSEDRKRKD

SEQ ID NO: 1013121 - protein, 274 aa, Homo sapiens
QKGKKGFVSPIRRLVYPKAGRRADCRSSVETGPRDTRVPLYPPEYLIDPQILLCDYLGERGSSSWSHLILVMSFAHVKPIHGRDELHAAGIDTGRQPEQEHERVKNHGGRRSSILSTVMPRKPCCIHLGQRQTKERIQMTDGYPHTDTENQAGTAIRVTLGKRTERRLRHGGIRCRHRHPDHWSCENPRWPGTATMSNDAKHPEPVDNLRELSQKIRQETLDTRTKKETNTPETTRRDNDADTTNHSATSTETDTNKTNNDAEDTWRNKDTRKE

SEQ ID NO: 1013122 - protein, 151 aa, Homo sapiens
MAIPYNVRQQNRRFHWAQEGGPPIGEKLVHAGAALPNRTVSIPGKPGRQIEATVLIKLAITTWAFRQQGTRQHSLDAPYTPRRPTPPSEKRRPANQGESSARKPDKDGLTSGDDPHSAGNDVPPPDGATPAQRTQHQLKHRPRARQATGDA

SEQ ID NO: 1013123 - protein, 276 aa, Homo sapiens
GAGAPSTARRGPGCHCLKAPRKPPQDSPSQVHQSPRAPPLTPAVIRHYVIVQRLTYPYQTSMTWPPIHDVFPVDQMAMPQWGSPPPGPRCAYPDSPDATCSSIASGFIRSWLERLVVRPYRLQLSRGFCDDQWTLMTNQQARKRHTHTQQALTPMMRITEQLTHNQSHPQPLQRGTRPSATRPTGHCGNAMRQPHSNAHSREETRARHQTQHNRGITQDPRANTGSRNMQTTETPLTVTPIRENGRNQHTGRADTQDTQAPGGKRSENHTARQYQQ

SEQ ID NO: 1013124 - protein, 111 aa, Homo sapiens
TSVVKMAYQMLWGGVPAESDRLKQTLYTIVAVILTHRLLGASLELITCLFELYIAIREIILYTDFETMEINSPHFSCVGPVGSDSRITVSLDYSRYTVRKCYRERLCLSRI

SEQ ID NO: 1013125 - protein, 373 aa, Homo sapiens
QRVFTSNLKQTPVVHLTPEEKSAVTALWSKVNVVKNVGGRVPWVEADWMSLPLRTQSVHCRCPFGESVHTSVMLVIGQSRKGDRLTGKESASGAYIADGGFKPGHTSTCTLLLTREMKLVIVDQRCERWISMSKLSRHPCGTCCMDLVLLGPVHFGNINSPTTSVQACAITKVGGLVLANAHGPINVSHLTLDFALHVQNYRIRRIPFGSLRSNLLNMGDISDRALKRIVEIPALNTKHNSTSSIAKTNEAQHIKHREGGGSDSKTLFHKKRAPKGIYRRRNTTSVHKGDRTKRRRVTRGYEEAGGHYEYGRRREGATREPQYVYERTTGRQSNVRRYSGLNAERERPSGKAKPTSSWRVRPTNGGQKESALY

SEQ ID NO: 1013126 - protein, 149 aa, Homo sapiens
MDSSPASDAGTVLDSSKEHEHVLTSSETISMIQKSGNGFDPWFDYAMSYFNMSFQDIKPSERSNRQSERRYEKVATNRVVGNKVDLEPEREVMSSEGRALAQEWGCPFMETSAKSKSMVDELFAEIVRQMNYSSLPEKQDQCCTTCVVQ

SEQ ID NO: 1013127 - protein, 56 aa, Homo sapiens
MQSGAPSRVLEPDEYLTAEITCINWILEITRRITCLEPQGMTGAYFQPRRAYIISE

SEQ ID NO: 1013128 - protein, 475 aa, Homo sapiens
PGFAVLSPRRLEAGGQDRSQRPGLRVCFPRGVSSRRSCCALYPCFLVSISEVVLCLVVCIYAACGLRVPFLSPSFSKRVIHVNNQFKIKVEVLSTNENIQKRHNTQENKIKNQTKKHQRGGAEDLDASRHHLRRVRPTKLSAYEKATINGPLSDRSPKKGVVATTPGGATGRSMKRHQRQTQGRATGMLDREKPTVGHTGRDDPFERGTSMRESSSIVREPGGGNPPMNNGWDERGADRTTHIYGRVDRDELGHPRSRAAEKRLYFSLNDPSGETPESTLDINSTFSTDQQDCPINRHDARPHKEPPIMPWGTHLGARLSTPSVQTQQPILVEGPPERETPSIGALLCETEDLLSPRKDLVSSGTLYEFIPHQKPVSQRKTTRSPAVKRITTIEPLAEKYFHNRAIEEHSKSPLERSLHREVLSTFTTNLSIHNYAARKSKLSTTDISSVDTQRVQPWNQICRFISIRTLERARG

SEQ ID NO: 1013129 - protein, 85 aa, Homo sapiens
CEKTLSQASVTSTSSVQRNSLQKKTGDLEKRAVIYSILYSDATGQKKAMDNTRLASNAIYSGMNAFLAGMQWSTRSLQKQGYYAS

SEQ ID NO: 1013130 - protein, 249 aa, Homo sapiens
RSCHLRWRLDATGFHRLDGWRSWQHVDDREKWHKCTDWTDTFLSSGLGRTGSPASEGGGRGELARRDGAVMAERLERLPEGWAGHRSRMLDPVVQADTKSGKHNKKRSRSRSRSRDKERVRKRSRLSGKYTGTGGGSRGPVSRSSNTGVSRRERDRERASSPPERIDIFGRTVSKRRQRWNERASNARRRRRRKRSSSGSERFDMPETRRKNSSREETALKSRRIGSKKGWRKKLEKRKADIEREVLRR

SEQ ID NO: 1013131 - protein, 287 aa, Homo sapiens
AALPLTTTNMAAAEGPAERCRWRKGCVGHDSCLRDSMTSLRMAGRGSWLGSGAETERSGLLVSILLWTMQSLLTAPQPWGELCHSSSYVKRGSTTRGNYVFGVPWGLILYCVVTSPMLAGGVWRVFFGACYNSSICAPWESKSWCSFWPRGEPSASVCSGWRLSPSPSSWLAGAGSAGFWVLGATLVVIGSRAAFHQIEGCGRGGAADGSLCEGVFWDLAASRGQVPQPCPCLSCTARAARAHRRRPITSPGRDPAFETKLEWDVIQENTKKKKKKRSLENNPEGRQ

SEQ ID NO: 1013132 - protein, 152 aa, Homo sapiens
ACPRLSPPPSASEAARAQSGAHCSSAESSPVAMRSCGRVELPTSTYLMADGTCQDAGIVGYKDSSSVWAGVPGKRFVKNYASGGGCPGWQRPVHVFSVNVRTLGGARNCSGVIRDSLAAWIGADFSPGSSYPRAPLGPPYLFQVTAHQRLDI

SEQ ID NO: 1013133 - protein, 75 aa, Homo sapiens
GLYASVYGMRLPELLPTSPWPRASIFPMSLGILGIRPGRGSRVHNHRTVRWCTPSEKNKNANSSPVASTTPDRLS

SEQ ID NO: 1013134 - protein, 120 aa, Homo sapiens
AGDAGRRSQHLDEGCTAKCGQHDLWEMPCVSWSLDTCLGVEEMSVACWFPGPWPCPSPVLCDAHAACLCAMCHALDTVMLVPDAAMSPVLSCAVMLKIACDVPCLCDLLALVALPAVACL

SEQ ID NO: 1013135 - protein, 90 aa, Homo sapiens
MTPLALSPPTEYPRSPISDSSPFRDQQSDGSAETLVGPIRLSTVAASTVQTEHGPNARGPYSGGGTNVCKQLPGAYIWVPYSVIGGVCQQ

SEQ ID NO: 1013136 - protein, 135 aa, Homo sapiens
MAGYLKLAVCVLVRRQGFHTVGSRCKNRTGAEHLWLTRHLRDPFVKAAKVERYRMSKRLQAPEVNERHQILRPGLRVLDCGADSGGLEIRLAVQKVNAAGTDPRSPGWRSMLWGTIFIDDIPRWEGANVCCALLT

SEQ ID NO: 1013137 - protein, 173 aa, Homo sapiens
MVKNRKHGTGGKSWWLSSCSSMLVSRQCRYPRAVQELIVGTVVPASLPRGPHVLLLVIQAVGVSLLRTQWPSGMVKRGLWRQCAMRHVVILLQAIKEDLVGPGPGIDYVAIRRTICSLKDLVRECERRYCAFKNWGSVEEQRQQQAELLAVIERLGREREGSFHSNDLFLECP

SEQ ID NO: 1013138 - protein, 248 aa, Homo sapiens
QHSKPAGIKVYQSAAWLRKVGIVDPATPPLWRPVKGPRKEIVYQPCVDRRHSALMAPELCWTNWWMMTPSLLQIWPGHSTGLTHAPILEGRAASLRTGTPAKQLLSCDSTNVVAPSWCCPVIISSDIYVVDVGSEPRAPKLHNGIEPKDIHAKCELAFLHTSHCLVIVGSDDQRPLGDVKGNGKGGWELLDGETFEVKVDMGETWGCCTVWAMTSGTEARHNVMISTEWADPNVLRDGFNPADVEAGL

SEQ ID NO: 1013139 - protein, 115 aa, Homo sapiens
MSTNDSEILNDTFRIDKFHIIVCGLDSIIARRWTKVGMLIVVFYIMKMVSLDPSSIVPSTRWAGQKVVTGNARVILPWNDCLYECTLELDPAQVNFPMCTIASMPRRTRSTVLEY

SEQ ID NO: 1013140 - protein, 307 aa, Homo sapiens
QESSEKGHSSMGLGAHRSPDGETEAVDVCLSESLELGLVPEFDRSRILYYISRAPEVAELADPGQVNPEGMQEHQGADAGADGDGRARPAAQLCTECHSQGLKAHPNGDSYTRRHREGPAAPSRLHRMPDGDCLECRRAGVIVPRGRPGGCQEPDGSGRESKDEWQRCIRGRTVRWMNGHRWRQCDIEPYVAECTGTTGGHSNRRARLVAGNASPVRERRVDKYNAYAPPLATQHGIGPKQRLGQMTLARGVAPLAAVADGHRTGAIGRRSQGSGHHRGGHRLVTDIRGTERREGRPPITRKPQRGR

SEQ ID NO: 1013141 - protein, 365 aa, Homo sapiens
PLRRRCCWPGPCLRALRPGGLPRLRRPQAVGGDAHLRPALVTRATPSMTTGAGAPDLVAWISWRRLCPYPCPSNWVNAVRLSLVCGPWACRAHPRDVLSRKGEDGLMIAIKLRLARSPSPAPGMEFRRWAIVSETCVARLLQSPSLVACEVQCDATCWVVLICTFLDYDSAKSLRVTSMAHSLGGLCIAGGPSIEPKAGSELLALVPPRVDILRANNQAFWCYLSNRNNKRPKITQGRVRTFRSELLNAVEELDALVGPPQFRPGIETTGWPPMKEKVRHNNKLSPAPCERQQFRQKQCRWYQLGGQTGGARREGSTMGEEDKQPEESNKDWCQKTVRPRRCTAWAVYKPVAKGKARRMACGGCN

SEQ ID NO: 1013142 - protein, 305 aa, Homo sapiens
RVPAEGLEEVLTHRRDDCVSQATRRRSAPCRFHPLSSQLCVALVPPMTSAVRSLGPSGVELIGREACEELTEGPRIVLARGPGVRDGQQLGTVCKDGRCAASTGPGVALQPLLRKAQGPKGRTRETRIDLGYVMSQHVLLVVWSLIMRPHNPPLARPICEAPELVRIMKLEATVAVLDALANGEGAGSVAPVNSSVCPVYVAIDTWPRCVLTRGRRGDHPMVNSMYDACVPDVHHSQFLRVQSAFTFALNSHIGASVLLCVTTECDVREVDADAGALRLREASAWSLWAFRVPRSPEGVLPGMTV

SEQ ID NO: 1013143 - protein, 218 aa, Homo sapiens
MAELQEVQIQEVEADVLAERQTALEARDDVTSDGRASIASLVVHFISWSYESTSPDISNAHAISYPYHECGTQAIIVLQFQHTVSEYRGRCKDRSFEDTYDAGIQLFGMHPVRHIGTRSARPLMMIPHMARIIIRDPIVVAPRLARTMDPLSILTRYSKSISLSINLRRRCWTLVAYSPGRDMLLCTRTLSKVLYLIRTIGVPKCLRGLDRASGARAT

SEQ ID NO: 1013144 - protein, 231 aa, Homo sapiens
SIRNQTAASPEENAVNRSSHVSGSQLYREKNTRLPFWLKASLSSIQARTAVTWLTGARERRTDIDWQPVEINLRIKARQQDNVRVGRRETLIPLLIALMGRKCPGNMIGRDLSDAFSPVKDLVEEHEGVHQLRDSPILYANGQFPVVLAPMCFNSAEVKPLDAATVETYIARIGPVTSREWVSPGNSVIAKSETSSTVLHDESPGCPSTGRSSGPVRRLEVLLLTLAASAP

SEQ ID NO: 1013145 - protein, 241 aa, Homo sapiens
MGSPGLLTGWGLLDYKTENVCDDQELGWVGALQEALLLGMGIRRSYVGSGGLSVAENKATQAAGPWNRQFSYHHQDFKRRFRVTSDQGTRWKPAVGDVGLTFSECHRHVTRPVPLVLTSLGSTDGLCPEGGREGTRADSRVLESMASRVVGSRRGPQQDLCRSGSMDAQVAEWTYVPSEGPLLGPRAQELSQAVHRNTTVTFRQVQASSKVRCLVSTLESPPYSVDATGVYEATNSAAYVS

SEQ ID NO: 1013146 - protein, 237 aa, Homo sapiens
GSERSRVQRTGDQCRGQQLRAQTPSRVQSPPARRVVLGDGDAAPGRSDYSTTPGSVRSSAPPREVPGSSSDLEIPDGVSGNSPVTKITPTRDSVPSIPGVIHALPVMSPPVKPAYEPPASSSPEDKRGVPGDRVTSLRCTFRQHAAIGVGAHTKGPLRAFLGGGPILAQCLMKVSHTGQAVGVGSGHLHGLSPSTSRAPCSPSLFVIDSMQIPPCALHLIATELADAQGGRDRRAST

SEQ ID NO: 1013147 - protein, 127 aa, Homo sapiens
MASGVTVNDEVLKVSNDTESTGNLATQEEITQRDRKQLLFCLSDDNRQILVEEAKQILVGDIGDTVEDPYTSLVTVATSEMIADMLQYDATYETKESKKEDLVYIYWAPESATLKSKMIYASYYRCH

SEQ ID NO: 1013148 - protein, 282 aa, Homo sapiens
TVMAEAAISLEQQPQHQEQERAAETCVHACLPSSPDPHMSSCLLFPCVVAVAVMCVCCAVHADLCHAVLGEPWARTHPRARPVDKRYSLYLPLARGYSGYTRTTRKHPEPCYRDLTHHAPCCNAHFDSIDSLLHTTLTFNALGITPWLARQPLTTLSKGPSAQRLYTVHNILVNVWRHRQPTCVSLALTGNFTFAYPNLTRRITTAQLLVILLNGANTVHRPITIDFKPTANLSYNEPFKPHDRSRFQLSPSRFSAPYFGAFYPLLPTNCVYLTFFHISRDT

SEQ ID NO: 1013149 - protein, 134 aa, Homo sapiens
MCVPCGESAPELAGFTLLMPAAIIGNVGQLATESELFSTLNMSKIGYFYTDCLVPNGWKSNPYATTEGHIQAEAYHKMLKYNIKAIAVKKLLSWVNEQWLCQSHGSFKQSFIISVVICSFVGTPFRYLLTPSMQ

SEQ ID NO: 1013150 - protein, 106 aa, Homo sapiens
MPHGCSISCAQNVHMHALVLWMTESVLQRIALKWDELRQFPSDDDQSNVRRCTLPGGAIESHGNHLLVWQWTPMEGPCWHMLRVFAHECVNTCSLVAMLTWTALHA

SEQ ID NO: 1013151 - protein, 176 aa, Homo sapiens
MFRCGGLAAGCFECMNAGALGADRVLSECPEAEEPGSHGNLFQRWHVPLELHDDNDKWLALVHQWWQTSDNSCVSPYCGLINSRMLGAYAYKTMKKDDKTDTMKEFHGLRADTMNMKHDKQACVICFRKEQDTFLNDKGCQCHCTFPCLNLVGRHMLLFAAGRIHPGARGSWVPGY

SEQ ID NO: 1013152 - protein, 246 aa, Homo sapiens
PPFPSLGSGGDIAPGPRGVAVATPRGLPSWRAPPICLSWSVPSPTFPPDHAMAGCVCLTGCDFRLRSVPWSFCAFSTHTLCGLVLHPVFCCSSILVSAMVAFFLGLVSLLLASVVWFILCPCDLTCVRCPVRLMILFSSLDISLCRSHMSTSPIRTRQCSILPICANYPTHAFTAHGQHAAGSAIALSECTRKHHPISILPRLAYVSWSLLRVIIMWCLLCYQSSGCCTLAQCVVVDPWSTQPITS

SEQ ID NO: 1013153 - protein, 219 aa, Homo sapiens
KIRRGCVITISGRMSFIETTKSMEIEVWVDADPVVDSIEKRYRAASAFFTYVSMSQEGGSLAVPQVVPESRGRRRSALSEGIGRVPADEGEADEGSTLESVSALDSRILPAHWCLEVAMVIQGPVVLMSRHYEVRPALGHKPLIAALEQLCVCHEGFRYRQLTVERLILPRPTHQKLEFHDRCPSINATTVLSRAPGGRRAEKPRECFLSYAVGYGKKP

SEQ ID NO: 1013154 - protein, 196 aa, Homo sapiens
MGLLLAYSLWPWLLGALLMILGLVPSLGSCVRTLCGLLLAAEGGARLAAGALERTGLFIIRVNVFSRVGNAQVARQVGDAGSGPGVVHGVFFSGRVRGTHCGPLPCAMTAGGPHGLVALDTSWTLVAGLDFLALGPVCLEQRLPWRLEQPMDVGHKKPKLNAFQATGPLKTSMARKHFKKTDWLEEPPSGNLTGNK

SEQ ID NO: 1013155 - protein, 269 aa, Homo sapiens
APRAGSPREAQPPLLPMVQTAWQGYNLQRVSGAHPPLVCATLILRTPWPTLAWCLGRLSSVTTRVTWPEPLGLLSIRPRTWVSFFEIFGPADPVSQEWDSHREFGEGLTVVGLLSSLELRETVQDEVDKTRTIPGHQSVGRQMGIEQDFCKDKLVLITARVTTERTAREPAYILVLYQESYPPDQPPISCSEEGAGNATLSPRMGEECVSVLEPLKALLLTKLTHLRRSLALCGSRLLGLGLLPCFSSVAFSACVTAMCVPTAPGVRLV

SEQ ID NO: 1013156 - protein, 150 aa, Homo sapiens
MVSREVLPASSVASSSIRWERRPRGMCLSDHGASCPALGKTETKSSSGWAIAERALVSAVPTCPAFQATLILTSRSCGFQGQGLVYTLLCDGTDDEGAVGTAYASYTCSRHGHDVHDMLQSHTSQLLGVAWNGPELQRWNQPGELTSIDA

SEQ ID NO: 1013157 - protein, 207 aa, Homo sapiens
MIDVRGLTRAHWDSWLLCCRTRKFVALICEASGGGALPGCCPWCKTGRVDKNAPYGLWPRQAPVLDIPGARHNDNGHCQWRPRTGISHGVGDPGWGPDAGPCGSPSSPMEGQTKRVGIGAWHSTAQERAAQLQGCDNVDHGCGTWATGAAMLTLGPEVQPDDDLRVWTGAEMGGPHLVPPAVSKTRAQSSSPQRPGVAEKSGPTRDP

SEQ ID NO: 1013158 - protein, 165 aa, Homo sapiens
MYVSKAYRYSHTDIGTPINSALGNATPDDHTLPLGLPGPSPAKDLETTVVPFDKERRIAPVARWLYMTRMCTREGCPAHTCLTCRWLDAAARYCKGKRAWLVYTCSCRGTSARLHVHRHACHIWSHHISATSTAWTLGHDGQAKVTRLHHSSSKHLRYRRSVIPR

SEQ ID NO: 1013159 - protein, 272 aa, Homo sapiens
RRSHDFSNMAAAALRSGWCRCPRRCLGEWNPISFQPQSYPMGRPIRCAVPGVEQLPLSKTHSSLVEDETTGVFVIAALRSTNCRKQRELSQKETHSNMRTQEVEQEEFRDEALKAQYRIETMLLGRPAEEIQTIDVKKPCGTSEVLRKKLGELTGTVKESLHECQYNSDLGRKIKEGVEEAAKTAKQRPESVSKGGEKLGRTAAFRALSQGVESVTTEIDDSVLGQTGPYRRPQRLRNENGVCGRQVQGGRQVFEPHEEALGVVLHKDSKWY

SEQ ID NO: 1013160 - protein, 104 aa, Homo sapiens
MSTSGTVVTRSQAGTEDQPSATRRDNSLGPRATSNFGDLDLFLRMGSSLRETGEINIAVTKEWFMIASLGLLSALTLCYMIIRATASLNANEVEWFDRRKNLLC

SEQ ID NO: 1013161 - protein, 226 aa, Homo sapiens
GQLQLTGWHRDFWTGNCTIRSSPSQGGSRDCPPRKSGGRGDLDSALVMSQAQEEMSLWLGAPVAEHSSVTSAVELVEARRTGCIGMPRPREASSCILERGSQECPTLLGVLQGWGWRLQSPQTLVTRAEPPSVTQQRSVHKSGRRTGGSPQNAGERAMQMCVGTRASGRSTYRGSELLKGCKGFFRRSVNQEERTTSGTVRGKLPHGRPTMRRKVPGGVGFANAVR

SEQ ID NO: 1013162 - protein, 114 aa, Homo sapiens
MEPGGVDASLTLHGLQNRSHGKIKLRLENLLALYFNTQENSARRRGASSLEKNYCICSLFYQKRLQNIKLALLAADKILVSSMDITGEFSVNVFSITIGLSDVIELLVEPLRNM

SEQ ID NO: 1013163 - protein, 149 aa, Homo sapiens
MCALHKVHGYDSALMCAPTIPRRMSGDTFPNVHLRDRAVDGWLTRAINRRAGTRAPSSTSDALGVPEGHHKKRMESDERELPRLCYQRIRQVYAFKDIPWPGVSPAGVLPQRASSSPFCCTNGSSRYPPRNYNRGPPLLAVTIESSARY

SEQ ID NO: 1013164 - protein, 131 aa, Homo sapiens
MLARLVLNSCASGDPTFLASQSAGITGRRAHRARARSNMEPNFMTTRPIIHMCNRIWTAPSVATVNRHHYDYIVSLQTPPTLTQNRHPSGPYQTANPYFVDPSNPLLQRDKKATRIYANRLVDEEYWWKNE

SEQ ID NO: 1013165 - protein, 168 aa, Homo sapiens
GAATQASLEFGPTDHAAGGRMQPLQARAGELWLPHGTVATPVFMPVGTQATMKGITTEQLDALGCRISVSTLVYAWGSARGAQRSVEHERLMRHSPSQSTSCIERPQGPGLVLGVKEQQGLKLARSVSQEGPPGRGHPKPDTFFHNPGPELIQKANGLHGFMNWLIIC

SEQ ID NO: 1013166 - protein, 179 aa, Homo sapiens
MVGLEGHTSTTLMAGRDACQDAGHSVGLQRTLPVRSGARSDLARREAFVHTIIASCRWVSWFGKDRSRIFYCVMGLDTVVSAIEDDAEVMSEDIDCACSRCERTLSIAASNSVTHRRTPELGTHAPFNSHLLTQELTYARRSPDCIGLRHGVHRMGYGQPSRCYDTWAVLLAFWALPSN

SEQ ID NO: 1013167 - protein, 355 aa, Homo sapiens
SSRHLGWGLARGLAISQRWQQQDKADIKELTFRAILLTRQPACREHLDEGPRKPVSAKEPPLLCALKASTPARPHVLFRCFTWLRCRCSVLTLRDAAILRVPSRNWAGPCVANQAQGLIFGHLETSCTDSIPIAFGSVNLSKSTESGRVSTHLLGIVIVVSDSCGLGRQSALRGSEAWYTRRSLNDRIAMVSVGCGQICPFRACLCHTIHRGKNGELDKREREGSCVGWGDKATLQGERERAGTTPALGKYLRLIGGKGTKTDTVGVPYTGAQGPPRGPWVPPREHCLGVCGTRALGYHTGLAVCPNDISARSLGTPISLAQYARKLGVNPKPKCVPFRWDPPFFNVVLVEGNFP

SEQ ID NO: 1013168 - protein, 68 aa, Homo sapiens
MEENQRVARRRRFPFVRERSDSTGSSSVYFTASSGATFTDAESEGGYTTANAESDKMSGTLTKESEDG

SEQ ID NO: 1013169 - protein, 164 aa, Homo sapiens
TDTMVHLTPEEKSAVTALWGKVNVDEFGGDGPGQVVGVLSLGSHGGSLSSLGRSDQLLMLLWAESLMGEWLHCVNESARLPLWMAWPWSHAGTIPQGGTVCARLEWRLATVNQACHVESCSNFPRSWATRAGSVVLVRSTSGRKNSPHQLSAAVLMTSGWLVCA

SEQ ID NO: 1013170 - protein, 239 aa, Homo sapiens
MAIHHLDILDRALYELVSHKSSRHVLSAEDHLEFLDMLTDGAWGTMGLLGAMCARHFDPRRVHCTNNLPLSFCVWCASFAWHSETNIEAPKEITSGVGHGRKLDARIHLRHLQPEVVLVSQWTPRVNSGSGSLVVYSKELAQGNFPKMWKLTRERGHGRHDNCCPPREPVKTPTPGTTHNSWRNPTSRYPSNQTRGYQKVTMERPPLGDSLTYFIALLPSHVGGEQPFDTSWSHVPFPQ

SEQ ID NO: 1013171 - protein, 145 aa, Homo sapiens
GVFAGGVGKPSRTGYRMITDVHARHLRPNMLGVSLFLSCTVLYHYVAVNNPKKQEGEVALVSAARVPGHSLRQDGGYEEAFSTSLHPFYRIYKHTEAITPGLSKQLLVVRRESCLNPYGTKEAVPSWNRGPDIGGLLLTYSASPH

SEQ ID NO: 1013172 - protein, 323 aa, Homo sapiens
MWPRSVGESQNLCDPRRRAFEKSRIDQELKLIGEYGAREQTEALWRVKFTNWLQLIREGVGRELLTLDETGPDGGSVRRLTNLCCSGWVLHRGAGMMVQRLNAWNERYPGDREKIRRECSVRPKTSLRESQGFVSKARGTFALKGRIANLNDYGDGMDFAGTTCLDIQRGSLQIPTVAMRAVPRIRYILIHVLGNVHQEMHKSEALLIMADSPLNGGLSQTTEAGGWKQGKKLPNGRGPHGLTRAWGEPGEERNRRDRDADLKVPTTWFPYPGRLARGQFGHTDIKPMAQTSKSTGLTGSLLTSQNNYEDEQEPQQTQIAAKG

SEQ ID NO: 1013173 - protein, 224 aa, Homo sapiens
MLEGPVCHPYSAIQGLKGRPEGKRGAASGNTSVQGWSYPGSHRLPIGARGIPGINRHQGQPSENIKDQPRPDLLRHSAEPPKGGNVVIFDTVITNQEEPYQNHSGRFVCTVPGYVLLHLPGAVPVGKSACPSSPPQGGQVRRSLGFCDTPTRGSSRWCQGAWCFSLQQGDQVWVDKEPNKGHHLAGPEAESVFSGYPHRSHLPEPGKDPRPQRRRLASMLRLVT

SEQ ID NO: 1013174 - protein, 244 aa, Homo sapiens
KRLLRTRKAHPPEAEDVSRRAKSQDHQEAATAGHIQMSFAMFDQSQIQEYKEAYNMIDQNRDGFIDKEDLHDMLAQRGEEPHRAEYLEGMMSEDPGAHQLQPCYLTMFGEKLNGTDPRGCDSATPIACFDEEASGFIHGGPPPWSCVTHQWVTASQMRKWRKNSTGRHPIDPKGKFEYVEFTRDPQSMVAKDDDDRPGEELKNAEDHNDTEYTWNQTARRIDVHVTTCTRGTMREDEPAQLLNP

SEQ ID NO: 1013175 - protein, 183 aa, Homo sapiens
QIGGYCGSTVKKMDMDVCKQNMKMRKSEQIQTGWGVPRSGLDVLEVLPNVWILMQPLAPPQTNARRTQRKQKPQNGKTLLLLQIRLEARNRPLDRPLAPFDREPFTLGKKPTYLAELEPSEFHAGNGLRRGSNLPKIQKPSSTTEHGRDMKGAGPLSEGNEATVCHIGMEWWTRTDEEKLMTE

SEQ ID NO: 1013176 - protein, 217 aa, Homo sapiens
MLSSSSAKRKNVHCLKDGHTACLSRVRLYPQRHSFAPGLQHQSTPGQTGAFCARLICSHPSVIQSSLLQVDQSVTMDLGCHDVRHRREFIHGPWRVTWSNCAELAVPKPRRVTPSFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAA

SEQ ID NO: 1013177 - protein, 110 aa, Homo sapiens
RPQGTGERVDQLFNFDVHDDVLVAQMTPHVEKDESQCRQGGAELSWYEKNNAKHLSRTVRVGTRTSREKKWDERTSSPRDVTPGVLQRAPVSSAPSVCPVGSHRELQSNH

SEQ ID NO: 1013178 - protein, 444 aa, Homo sapiens
PPSTTSTCPHAHVAPSDAQQCGLPSRNAMCLCHGAVPEMRLDCLLGAGLELGGMPMWYVVCHTDGPGGVVWTPGGAAGVFPRMDRTGTTFIQTEFPMWRSREGPVNLPWCHVASFSEVYLTAHVFPSCILSIITSHYYYLTLRLQVLQLIVAVRHGPWAHPWGVASEGVRGLAIAAKELDWPVGMYGQGTTRDTSWTKTLLYPIKARHQLPLFFGNFLGNDSDPTSSLGKYNFGGLLHQQVGQGLWHGYPQWQARPCSAFNSGPCLAAKGAHHFDYEHTSTTVFLTYPAQIRTLNIVHTLKQIVGPFASGLGMEAPQDKVPPSYKPPLPVTIGREHWLTRASFDVGGAPVGWSKHSDPCLRAPKNEPRGSYVRATRAQVREPFRTLATNMGHCDRLRCHFSPLRIGDTSHACSTIQVGKNNPYGPFYGTILQMPQETIKTIPRS

SEQ ID NO: 1013179 - protein, 56 aa, Homo sapiens
MFELAKRYSTHQRKIISSSLITATKGIPLLGTSKQAAELMRPELDKLRRVTTEEAT

SEQ ID NO: 1013180 - protein, 410 aa, Homo sapiens
MPTERKADLNVPVPTTACSARVTVADYANSDPAVVRSGPESRKAEPTLFSEGSKISYVALEGLSVFLQRKLFLGLGEPCDIIDSSDEIGCPVRKCIHEENLSPENNTRQSKKDTKKNLDVGWTDERRIPWILKGYCLALLIFRSLRTIVPFYPEYVKTCLGLATCTGCLMWEPGLYLQCAPNKAVGMLTLGVMPSCDQGMSNGRNAWGMSLPAPSQVESRIFLYHSGMTPNMHGYESFSPEENSRALLRQNIGDHSKCTIFQTGNFAHEVCRTLSSLVLARTRAIGWGETRTLAYTHNVGTQFTTYSKGYSGEARARTPPTRVLHTRVSKVVYTGVRQCRRPTQGFTANPLAKWLSIAATSQSKYSGTRLGVASWRFTATRLTYIYFNTGIVGLGQVVTHSHSSRYRNPY

SEQ ID NO: 1013181 - protein, 35 aa, Homo sapiens
MRHDPRQQRPEPQPHAAEHDQRCAQGGVHTRKRQA

SEQ ID NO: 1013182 - protein, 73 aa, Homo sapiens
AGTGLGVLGIRLGTVAPDAVALGGSPRARVSLPCHFMQPCSLSNVSSGAGRGFNYSALPGPDVRRPYAGWCLH

SEQ ID NO: 1013183 - protein, 148 aa, Homo sapiens
GDKMCCPSGDGRSLSDRDVLRGPAVWWLVAGAVGLSRDRGRRPRAGTRRCRARVFDALVSVAGCELVAANDVQLPGSCSMLEDGWRSSWQLAVSEPAQLCVLQLTLTESGSAACWPRGSEEEGLVRAPHLAYVGKQQRREQTSPQDGE

SEQ ID NO: 1013184 - protein, 59 aa, Homo sapiens
GTVGGLSPGELQDARCRVPAQRIAGRAGGAALTPALSPQAAGCAWRHLMLAEGYRWCRG

SEQ ID NO: 1013185 - protein, 357 aa, Homo sapiens
MTSSKDRRQLCDLGPSIALVSCKLCLWGVPSGADDNHEPSANASSCNSVSLNSRLLSEVLPLNFARHTDFMTIRRQCRLRQDACAGPISRVRGYRMNRRLSCHGLARTDNWLLRCIVNKATKFDRRGASLSPVDLVTRRTSCQRCVSAPGRGAAEAPGMCSCKSRGRYGDSASKRVGTPVGKQLDQGAWPADRYGRSTLLPRGESQLLVFTYVGRTMKQPIKCLARPRLQGRTLSERRPPSGVAPRTVMCHRHCLSDHALLSGETQPLTDTHRDTTTKFPSGKPTTRNGEAPPRDTHREPQTPRGNFLNHVEHRTTRAEYLKVPLPASDSKRKTTEQGVLLRNEGHPPSVRSDGDRY

SEQ ID NO: 1013186 - protein, 156 aa, Homo sapiens
LHAGTMVMAEGTALLMRNRPGTNAHDSYNWPDESLDEMDSTLAVQQYIQQNIGAHCSNIDKMLEPPEGQDERVRKHEHLRQVCLELNGLAVKLESECHPDTCTHMTATEQWIFLCAAHTTPKECPAIDYTIHTLDGAACLLNSNRYFLSMGMIKES

SEQ ID NO: 1013187 - protein, 143 aa, Homo sapiens
RRVARQGRLTVLYWLTPDKMVTAMVASIGWACSVVTLCCGTWLPEPSLNWLVCRVRYEFKPEEKERIGQFVFARDAKAASGWSSDDKEISCREIEYPLESYSFAKNCKRKTSSCNRTHRILTLNFNFNIVSSRQSMQCLLAEA

SEQ ID NO: 1013188 - protein, 361 aa, Homo sapiens
MKKKKEKKRKDKRKRYQRTQKKSTQQKKTEESDTKEQSGHAVDHDQSTTEKRTTQNKTKTIDTNAREITQNRDTKDEHEQNTNQPRREKKKKNNTKKRRTKKRTETEKKESEPKAKEQRERQREKDNKQKAHQRRENTRATKQKNNTDRRYTKRDKKQRNEHRHQNRTREQERQDNKKTTPKTNERRSKRKRAPKTKHQKKNRNHRRRQRQTRQKRRNTQPQKRERRNKIDKPMDPTKTSNTTPTNTKANRIRQENRHKKHKRHTPKDGRTNQQQDGSDQTEEPKHNRDEQIQRAEATALQGARHSRQARRKHQANKHETQTKEQNKPQPTNREEQTNTRRPSERKQNAPKAERQHPQTEE

SEQ ID NO: 1013189 - protein, 111 aa, Homo sapiens
MLSHFFLDSSLPSLLALVVICPGSLYPAVMAWLCFWAIQPYPYPVRLCGWSTWVARSDPECGFGPGCGCGLLHDDCGLPHPEVGIEMSGRCGRGQGTETEVLGGDSPARPG

SEQ ID NO: 1013190 - protein, 344 aa, Homo sapiens
FRECGEWEDEPRRDDSSIVLAVFEPSGQCSMRQSSKVGQVDTLLRNFLPCYLWACWQRLVLAGMISLTSQGPHGCLTWNAMLLLQCNIQLAPDVLLMHPDGPLDLHMLSCGHRSSPCVVQARLFLMVRWRWGDCACPLWMLGSHALTKCRCAHYFDTPPVWRAHLWPFWRLQTNAHFEQLRINYLPSPWHLFPQCPDGDYSFLDQYFLADLPSTLASLRIIPVLAGIEPELSFPGGTLKGPFGTLPPRMFPNIIWGGDTHLSVIGATAFWASCEMPPSLLTPPPLGRPFGVLRPVWAWARYIRPHPFIPLWSRGTITPFRLRLFPFLLGQLASSAPLVGNLRPP

SEQ ID NO: 1013191 - protein, 141 aa, Homo sapiens
SQLYVGLPGLVGSLNLLPGRGGIGSGLGFITWTLSLKDKGMPSPQALAQTGTDLVLLQCWTPNLHIRTVMDHGAMKCEDWSTHHPRWVPNGLSSLLREYHQSTTGSHFVSPGWSISALITCLSANLKAPMLKQASCLQLPK

SEQ ID NO: 1013192 - protein, 230 aa, Homo sapiens
GYTDGAQTHTMTPHQAAATAAAAASSAARLSAQEASCAVPMLRARGARGLSRGCVEDEDGGSPAEGCADAYVCLSEGGAGVRVVFEAPNCASSVLQCHPAQRTDEAPFRALLLGRGRFLPVRAPAVADENPIGRRKPPMQVAASCLHVMYTPQQIQQSEVQALLPGSPIPILRVSTGLLRWASCRMTTLVALRACELTPDLEVYRWALTLYVSIVSIEVSSVKRQCRSRL

SEQ ID NO: 1013193 - protein, 244 aa, Homo sapiens
MAVGPVTEVEAMACASGSGVRARRRHAGQLGQGCVPWSPRAARRCSPIPLFYMHEMRSHLIAGTDPVVLLDDENFYRCEEHQQYEQWYYIASHSHVTRSAVCTRTIHVQVVERKRTSTILSFDLLLRIGPGEIGMGCGHAAGSYPTRCLNHLRDSITFINGMGIPAFKMAMLLLMECVQRSSNRDSEREYSSLQGEVELAVYDPIVGPKVLSRVLLNSGTLGGGPELGLTEANSALGAKTTMAR

SEQ ID NO: 1013194 - protein, 141 aa, Homo sapiens
GWYRSGVFGIARFSLVVIWPSGPGLAAAAFPRLVCGHCVAVLRRPPPFDLRAPSSSKPYMRRKIGRRGQALMLVSGRRRLLTVLLSWLMKLATFNASSDSETMCSSGAPHLVGASLGPGDREVVDGVINLNAFDAPHSRRR

SEQ ID NO: 1013195 - protein, 273 aa, Homo sapiens
LVRPDTGLLSARPRYWAYGAAWWRLHGGLCFDLDLETEEVHRGRGASQSSSPACLWDTMKSVELTDTSVERWPRAHLGPTAYELAAVCWARVGYGKVFQDAKGGKCTNLGKIYAMKVLRKGNHCAQCQGHMQQYTGCSRNIHSSQVKRPFICGTWAYAFQTGGKVYLILECLSLLSCPERQWLGLFILSPASASTVAMQPSEASVDVSCIELNPHGRLCEAGCRALHASWSEKGILPLERYGLLLPCADESRWPLGPSPTPSVIIYPGTTRPE

SEQ ID NO: 1013196 - protein, 135 aa, Homo sapiens
MRAMELLECEMECGDVPCLMQEVLGCSMYLGIPTCCACGVPTVTHGPHSRMRCMVPAAPVILPNYLRHNTYHAVSSMTLGGPMHDCMQATGSSSHGGMALTFVGPMIGIWPVVIGVTWTAPEGSTKPCSCGGASM

SEQ ID NO: 1013197 - protein, 289 aa, Homo sapiens
SRLVLAGILDASASLVSQSCEHGSWVETDARKRVSRHERCDWWCSGSLTGLLRTAAGWLLPAQCHGPGERSDQAPSPGHLQRRSIADRMQSEARSGATARDPRPDRLVPPWMCTKMEQATSTSERLIHSYGIRPGPLGWPLVYDDLQTRVKPVPGGQTMCLSPYREVVKMLPGGLLRDPWPNDVEQGRCWAVPWLTFIPLRSQGGFWEQRQGRPVIHTKAFRAILYRETTMWEKRPHWQFWVPRLYARANNVEAQFEFTSVSRNRARYEALRPVGNPWVPVLLTARRRV

SEQ ID NO: 1013198 - protein, 59 aa, Homo sapiens
MVVWERNLRESSTCFFRVAVKIITAPAISDKKLQEDGTICKRETYRVLQNGARGGGGGG

SEQ ID NO: 1013199 - protein, 318 aa, Homo sapiens
MQLYWPRISGHCWWTLRNFALGALKKYGLGTRTVRGAAVLRGGELVCYDEFQATIASAWPGERNVAWCCGDVPCTGKTCGHWKGAPVMTPVRLLGNVLYPVLSVLVFGNRYRYVGTLEFLRLLNRLQLTTFMQSFSSTHGAECDDGQLATNLIHWVLSSTYAKSRVHQILTLQIGSYRSGDRLSWNEVARKHPVFKDHLVAKSSTCKRKDLKRHKRGTYDGERNPKPIGGSKKPHDTSNTKKWTTNRGQWNAHTKMGARGGIRRGAPGKYTAKKSQTRTKQIGRREAMRGSPNRHAKTKHSNTAQNGQELHGKDKARK

SEQ ID NO: 1013200 - protein, 106 aa, Homo sapiens
MAAHLTIPICALFLTYSIWPQGNLEGPVDYTKAVTFNHLSGMQTPSGALESATDVDSGMSDVFDCGKRKPEDKNLPAGPVTIDSMSHSQHSQDWGTLNTVRTNGRD

SEQ ID NO: 1013201 - protein, 135 aa, Homo sapiens
PRRRVDAGGKVHNTLGLNPFQKAFKKGPQERGESPPNLPVPANPVLVSRNFGQGYPDLPCIPRKAMYNDGKYSSARKSSPKGVFWQNKKGTTPPSKTGHGTTGFSFRPKALVLTKENPSFWGGVEQKERGGYPGG

SEQ ID NO: 1013202 - protein, 109 aa, Homo sapiens
TRPGLWCLPVLDLNKQAPYMGPIPIQVGTSQASRPPPGGAKEPGSGGVAIPRSRGGKPLKPQGAPSRQTEPWETIDHQTQEPPGLTFSPQLGKHGKKPQIPMGGVPYPL

SEQ ID NO: 1013203 - protein, 195 aa, Homo sapiens
MEAYTPKLTQVLSSSAVMVLLACTTLREAGLTRMYKAPEIQQHLRQLADRKPNSRTTKNLKREDKRSTQDTGKSTDKRQSTLDNTAPTEDDPRQRQTYTNKTHRTASQHRTKRRRHRATTKKRTKRTHHDDRRAKTKQNHKKKQRGNKEEASTAENKANQRNNKREPTTTNHHSDTKKSKRRNVNEEKTQQKTDK

SEQ ID NO: 1013204 - protein, 123 aa, Homo sapiens
MASDKLRIPTLGLRIPENATTSLLHQIITNYGVHTGTVHAPKTNGQQAPQQEKPTTWLRTQSRAPHLKKDIHRKKDITDDPQRSPSKDTASHDNAGSYTGTAGKQQTASIDYAHTGKGKDIHA

SEQ ID NO: 1013205 - protein, 119 aa, Homo sapiens
VHLPEEGLGDNFDLVDHSDLHISDFNPSLKTLCKLAVIHYNLIQSCLPHDIRWRRLKCHVLTNSQIVTSSSSRLLPWVVRKFARPPPSLLSLRVYLSAWPSAPILSSRPVFLCTSSDLR

SEQ ID NO: 1013206 - protein, 226 aa, Homo sapiens
VSWNINEIRIPLRGVANHEPNYCAAVAVGRILDELDADIVCLQEDQELTRVCTDESPVAIGGGLSSSYFSFSRNRSGYSGVATLLKDEATPVAAEKGLSWPCFATQNGDVGFYCETVDELDATEETPGLCASDGQGPPHHSIRSAHGKVQEKTLTLSQRVLAPMRTLGGLSGYVFQMRFYRQLQIRCSEALLSGRLAHVIHSGGPEYSPTPIDHCDAVNLECFEED

SEQ ID NO: 1013207 - protein, 348 aa, Homo sapiens
NPPVSLTQAKLEQWVSRSPYSLDQLGQIAVGELMEDEQLGLTIIASRSPVKSIQADPGAGTRTSESLRKVPCRPLLGLLCGSFRAACPMDPLERSWLTVSVAVDVQNIEPRGSLLRYLVRIDRRRTLGRAFIRQPDRFGGLTVHRVVGRCPVDYLEIVLPGGVNPAEAYVVLGTWKGSNSRGNLTLCKGTHWGPLHTEFVTKGDLKLNRIVVKGQGLTRAIQEGSPGVSIHATELEPTELQKHTLVHVVVRAGTTSLSTPYFPKENRRNLWRTSGHRVWRGPCPEGPYTKKGPRGPTADACNLCNLVVSPGKRGNPGELTGASDVCFGPHHVRVGDTAPQDRQRHNKH

SEQ ID NO: 1013208 - protein, 214 aa, Homo sapiens
ALIIICLYLLPKSVYALSPEQLHNQKLTNTNILETLEEIETSLERDPAHCSIISESLHQRFTRSATHPFDNNSDEVQSIPSALRINIELAYLDGTWNLTSDYLSYEAGLNLATSLHNFRPIDCLRQPCGIVADVLWLCDKSDVGTSRISESPTMCVITYINDSRQTVLAPPIEPVSARFSAFTQDSDSQLHQGRIQTENRLLQPANERIARRVN

SEQ ID NO: 1013209 - protein, 104 aa, Homo sapiens
MLIATTPVCDNEVGSTMLNNIFRERERWLTNGDAKTVNQNSIAPMCALWAHSGFASQDQSCLPREKRVKVGFLVVWSQKKTAPLIGIVYVHQTLNMFRCWKPLK

SEQ ID NO: 1013210 - protein, 238 aa, Homo sapiens
RCLKKYNVVKNWVEVEIAPDIREENSLMLTSLSFKVLKHPDNKFRVRLRALEGQPSLAQYSSQDPHYVLSLTRSIEPMLAGERGNDVPWRRRWVKGDSHNVGVPDRSLHCTRYWWMNQDIHVHGTYLYTSRCISLPLRCSAHPWDKIYPLPLQAHGLVQECLTFLGPKLATEQRVNMSVCDRLADSISGHKEPVRIAYNAQSTRDPEGLNSQSPDIKGEGQSFCSGASVRDPFSIHHW

SEQ ID NO: 1013211 - protein, 223 aa, Homo sapiens
THASGGIPSSALCGGGELQRDLGYWTKTSDLLFRNLKETMCISERYPIMSRVLRPDARLSDKNAVQRSVATQFKMSLLAAGGTILQSKEPAYIRMHRKPNDAKAGPGRFDEVLIRHQVKYLGLLGKTCACRRVRLVPIRRKVRSFPAKVQVTVPRDVGHVGRTAGGWEWLCLVRNLGYTAKNEYKMGRIKIFIRFPKTLFATEDARGGRRQSLGTKDPKLTVR

SEQ ID NO: 1013212 - protein, 105 aa, Homo sapiens
ILKFILISLCLFFWFFERESPALSLKLECRGAISAHCNLRLPGPSNSLALSSQVAGIIGTHHHAWLIGVSFPRVETLNILFSSLSQMAMNGIKGLQIVKSIIGEF

SEQ ID NO: 1013213 - protein, 178 aa, Homo sapiens
RHALGRDPVLGDTRYTSHGVLRLQLRAQCPPPMARNDVVPRITCEHVVILYSCSFHASRSLRYNSMVAHLNSALGPPGGHSLLWFEQLDRVHRVKSQIPRTCSGIRGRPVAHVAADDVALYLESTRHSSSMPGLAVAAAGPKAGGTVSAARSGLRVGSRRRAPCPGFPFGWTPGSGAP

SEQ ID NO: 1013214 - protein, 244 aa, Homo sapiens
CLPAQEPQERRQSWLPSRNGMVLKPHFHKDWQRRVATWFKQTGPKIRRRKARNAKAAPDRSARRVGPIRAIVRCPTVRYHTKVRADSAVSPGGLRVAGFTMNGGPDIVISDGSEGWRNKVHGVPAGQLCSGPEGRYLVLNSSSSPGSPRSPKDRRDSVLREENVKAGLAPILNRTQVDSPVLVTFYDERKKRLEIMHVSEEMKQFSNSRSSKSTVIGRCANGPGSFWHYGQRKMRKEGPQNEDR

SEQ ID NO: 1013215 - protein, 346 aa, Homo sapiens
MKRTTTNEVGVRSPKRSAPSGTSSAAAVEWEEELLYHVEEIVMEVHLEGNRSPSSYRAVSMVPKEMHGIFVLEDSYSSRELPEVLRDDKRLCTQHHEIILTVSYGHFQVHREVTSPFNEAMAIEMDYWVGDSVQLLQDSVQRWRLVRTEAFSDDELWGELHVGAHSLQRRDTPHDLYGWNMTVLLWMIYRRGSRDSDMVAQSEEQVNFKCAAESCIVYLNVVTWVWAAPRYRGALQPFLVRKRGGYPHYFSPVIYLTSQVYKRARWEAQPQKDRVGLGGPTGQGKKARTIWTKEGAADRQENGSINQGKRTKPSKRHEDRIIITAGLQHRTNDDPTNETLGDHVFL

SEQ ID NO: 1013216 - protein, 91 aa, Homo sapiens
PWITALAASSDGVTSGEMERVLRSKCEYSPDADGLEIAQTTGLPVWDAFHALMKPRLLRIACTRVGWYTQSRRERYIIDVLSEMHDRSIDN

SEQ ID NO: 1013217 - protein, 70 aa, Homo sapiens
RLIHGLPRTRGRLDRMAGGAGGIFQAYARHLAEGACMQDGPLELAVLSGMLVRRFIAVALLIVVGHIVAS

SEQ ID NO: 1013218 - protein, 106 aa, Homo sapiens
MCNLGTFPSEHTNFGVKLSPERRGPFPNPKILPGKTRGFPRASRHIPLIIFPIEKKGCPPKKIIIYSLNTVAHSEHRPRFPVYLERYVTSTPLILESESCPPWCAG

SEQ ID NO: 1013219 - protein, 101 aa, Homo sapiens
KGEEIETEWTTMGRRGKPRCTGGLWVKAEASTGVRSDLLAVGLTIFGAVLSVYYRSIVRITCVLTAAIKKTVPRRRNVQVVTETTTSTDVWCMPRYHSASK

SEQ ID NO: 1013220 - protein, 102 aa, Homo sapiens
MCPQLLDTAYEYRPETTAIETRRENRYPGGLLGTATAYNLRCVTHYSGRHMYQRKFNNVLYADQHVKDVSKAVSLTGHNNPTARPIMWPGPPLELRPVAFTP

SEQ ID NO: 1013221 - protein, 96 aa, Homo sapiens
GTNSSSMTCTWIAICHRRGIRSLRDLTPDALAAAQEHPPPGAGGHPVERYRMKGDQSAMYTCTILPSYYAPAMCTSAARGLRGPRSQAVERAQLLV

SEQ ID NO: 1013222 - protein, 218 aa, Homo sapiens
MIGAVLACVGHDCVWCVHFSVLRLSECAEKSCYLLDDMDNEYLLESDEISGIQPVHADALFIYQNSLVLLVADVTECLSWCTAEIALAIVSWFDLAMEIRPRRDKEEHEIAALDKASGASSDECLTLFPSTISSTYLSRLGVSIYMIRGHTLSPHTVSHGVIATFPMSGNKFDLVNGLIVVEPSGSNTTYELREILTTPLLQAPAPLSKFSRHKVRGK

SEQ ID NO: 1013223 - protein, 107 aa, Homo sapiens
WVGFLLLLSGSLGFFLVLALFLPNLAKWEFRQGTHTTRPAPKSGAADAETAEYTALEDIAEPDLQEDWQTGFSTVAPAHIFERQDEVSPPTFDKTVQTEAGRVPSMP

SEQ ID NO: 1013224 - protein, 316 aa, Homo sapiens
MASDDFNGTPWRICPSPVDSPFRVVVQERCCWACYNRDSNFAPRPDLPFGLRSYRNCTLGEPTGPLVPRANWPTCIADTPASALPSKAPANWPITPYQDSATQPAPFSDSALGHRAILRKGHVTSKLPPVGRAPHLRPRIVQSPAGSTHTTPHLPMGTTELGPIAPLLPLARTSLHAYMATPEGLGLTPPGTSLTQSPLWLSATGWPLPALLASPPALRATRAQHGTSWLCHTLGVAPHHPKPQPPSSGAAHRPAPPPLNAPRHFTPGPFPGDPYGPTATPHARPPTDPGPTARTPRGPSHRPTRTHPLINPPPPT

SEQ ID NO: 1013225 - protein, 116 aa, Homo sapiens
MSSIRHSYSLRGRDHATRVAAGGYAAPGRPSTGTSAGAPPPTRPLRRCSTRSCTSTKRTRITCWPRSAARARTASCRLPLLRGSRAGRWRWQCATTAVGNLRPILRTLREVPVRGA

SEQ ID NO: 1013226 - protein, 135 aa, Homo sapiens
AGAGIGRRPCGVRQAPLGPPPPPLLRGEPLHVGRGGGLCGRGVGVLIGVRDLPPVAGMELLMPGLRLGRGAPWWRTYARRRRSGDRGTGSTGPGCADAPSCVVVGDEGAVGKTCAVRQLSLCPTDCLSPEGVAVP

SEQ ID NO: 1013227 - protein, 114 aa, Homo sapiens
HTLLLERSYETINATKGSTKVQLLEKVSSASHVLLSESTSEKPALPVVAIRTYPLIVIPRGTIRFQPKHNDVWGVIRWKRWFNEMRDVGLESLPCISDGVRHLVLSTSVDALLF

SEQ ID NO: 1013228 - protein, 150 aa, Homo sapiens
FTDAIIPLEIEVLVDADPACGRLSDIATGPPVAFFTYVSLSHERQVMPDSPSCLPEIRRDEQRNRVFAAKAYKVLVSLTSMNSAVSRSSATAYASVPRTPSSCQLVDFSHVSRWITRAPTMSQVQLSRISPLLDTYNIQIANIEKLDVVM

SEQ ID NO: 1013229 - protein, 183 aa, Homo sapiens
MACREKVALSDGPYWHGVHAGERAHPEGRTPWSCNLICRIACATNHPIQWRRSLCYPAAKAIRRLVPAQPKLEEGNQYRVTHVGSRASCSAQMLRGDAINGQATERRDSGVPVVLPVVDCAALSARPVVKGACVGPEDDVTPLTALSGRVSPGWCPWGRFSNWALERSICFVALVVGRALGAP

SEQ ID NO: 1013230 - protein, 76 aa, Homo sapiens
DAWVDQRRRTTHAVESPYKVPDLAVVKNVTLWQAQEPKDDFGNLDQERSVSNLYRNYKCSLIVNPCLGSYLESFKS

SEQ ID NO: 1013231 - protein, 189 aa, Homo sapiens
MSSEEVKQVESGTLRFQFSLGSEEHLDAPTEPVSVPQSGAAAFQETTHCPHYWALLSSLVPQSSLLPLHQLTCRDQGCQFPSWLDSPGVPDSALLGQAYFTAAHGSQASPAQAQEFPLEAGISHLEADLSQTSLDPGNIHCRTVTGAAVHAFACPYCCGNPEQELCRAASRASKDAPAVLRLPEILDAI

SEQ ID NO: 1013232 - protein, 97 aa, Homo sapiens
SDVLTVLACSVPGFEPGCDVNALYHHKELGCDYIKKRASIGFHRVCPQFCHEGQKTRVADFTVMYVKSVWYRCATRKCETCTHYVVNVPLMSVILIP

SEQ ID NO: 1013233 - protein, 34 aa, Homo sapiens
PLHNVSVLALEAAAVAVGHLFPPARPLAALPGGG

SEQ ID NO: 1013234 - protein, 154 aa, Homo sapiens
MHRCVALPPRTPRVVVPSILYVGGATQSLSKFNNTRRITLKVCEKYTAAVVPIKPHSITYMALTSFSEVDGFRGVPKISQEHIHRNLCTRAYSSVRSSLPVSLGHGTYLTLINIALDRMKPVGSTSKWNTTRFAFSGPPGAGEGKGKESPPNFP

SEQ ID NO: 1013235 - protein, 126 aa, Homo sapiens
MSCCCCGALPPACAPAPDAGATSPCQTLARARADLTQPWQGEILAPLEHGAPSPKDMNAIGELGALKAINSQLTCGDRRCPHHCAGLRATHCKMSVRQTNTCTSMFCQGGHPHVAGGTFSTPDFQD

SEQ ID NO: 1013236 - protein, 163 aa, Homo sapiens
SHPYGTLYITDEVNESLPYHQINWPPMVLNLRVHRLRRDYSLQLLHYLPRIIPSNQATCDSLTLTIEYYSRLNARHCVLTNYDHNDVLHLMQAVPYIRLNNIRCKFPRASKPIPLSSATRPGVPTTAKCSESLWSKPQILMPIVLELKLPLHTSLSETTGPVF

SEQ ID NO: 1013237 - protein, 45 aa, Homo sapiens
THAVWRDKEKKKEKEKKAEDLDFWLSPPKLPAEVKRWKTIYNYET

SEQ ID NO: 1013238 - protein, 281 aa, Homo sapiens
MALQALGLLVPAFPACVPGRSCALTHEAWRLLLLWGLLLLVPELTARPLSRAAPVSRALAARAPGRLHWRLAGLRAGWAVMASTEPALCGALGEPSCLDRLLLTACPYLHGLAVPAVKCSCATREFCLPVSLFTWSCPSVNLSSSGSANGNGSAPGSIDDPKRTGTLMRQEGKYALRVPWGADTQKTSYATEVTYPEDSTRNRPMRHSPGPFGPNTLRTPYPKGNIYLKTNVTMGVHNTQTGEKTAGHNPYKSNKPHTIMESGSKQRVTTDTWESRSNTIQ

SEQ ID NO: 1013239 - protein, 106 aa, Homo sapiens
MSVVILGGPRARHEDVVRMRKSVAVTSSTIFSSLSRLTRLSVMNEDIVYTGPFSQANQSCIEPFTRVRLLRTTERTLRELTLCSGASSLSRSSLFGTWIWMSTVVY

SEQ ID NO: 1013240 - protein, 98 aa, Homo sapiens
LVVAGDIAKRTKKVWDRREIRGPCYVVPPSEKMVKKIEIMQHANVHLLLICVQNQDEETSCGDLDTVVPAMKTVAGFVPGQYNTTITLSQVKSCHQND

SEQ ID NO: 1013241 - protein, 169 aa, Homo sapiens
TLKEHSQILYGIQTHSLSTLIMTLWSFDGARPTCAYEVERLEQLGTWVLMDQPTGLCYATRRKNLSLLAVCTAADAELRCLDLVPSLQLDPARDLQGHCGCIFTGSPCFVLGGVVPGEVACVPSVRTHNVRHAHRSLPAIYDYDPLYRGGAANCWRDARGRNDLRVIEP

SEQ ID NO: 1013242 - protein, 165 aa, Homo sapiens
FAEKGNLALPKVLRMGGERKGPRYCDRGRTVGRNSAGTGSHGFLVRPVTDSVRQLSSCALQAPWFVGEQPAALFRACVGLGRKVQADNALRWSQQPLVEFGRDVGVVKEKKQKGSSLALKRWQKQCIHAPTEETERVYEDLRVSIAKSLVGQDHGPLKECKIFRC

SEQ ID NO: 1013243 - protein, 154 aa, Homo sapiens
KKNQKKPENDDDVEIKKQLSKYESQLSTNEEKVDTDDRTEGYLRADSQEPSHFDSQQPAVLEEEEVMKLMLIHRKSTMNMYPEGARINAIHISTIHSASQTISFTTIMTTIIFSIITTTKTPSSQSPAQGLIPAEGDVKRVRGCRHLVARGSVL

SEQ ID NO: 1013244 - protein, 237 aa, Homo sapiens
MAESSDKLYRVEYSQELGAPLARNAARASPKDIAPEWPSWCSRPCCDGKVPHWYHFSLLLEGGPLHPDTLTVAGGLEFIMRLTDGMTQPESQEERRERMEECQDKGQDGNWIARQQKTLGDFARSSMPSPTESTCKGVYWTTQIRNRARCRRGPKGTHGWKHGEKTTGIGPLMGHSWDNTIQGHGIGQKETRRRSQALHGPEDNTRRDPVKGQQGSLATEGQTQPLKKREPQEHRVK

SEQ ID NO: 1013245 - protein, 86 aa, Homo sapiens
MAQFCRDARVVTVNNNEDVFPNNKMSCLRSHESMRCSHPHRGALEHEGVNYGIVFTEIDSDASYIYPCAITHAGRVISSVNGAKAN

SEQ ID NO: 1013246 - protein, 174 aa, Homo sapiens
RPLPYCWGSADRSVLRLATATPATHVSTDVLVNSHVCVPHGSAFLPWARAPDTHPRGHVCAGSAPGTVGAEHGVSRQSSRGSEHPLVQDPPSRPQAVVRAAVTIPRPTQHLSTPAARTAFGWAQQKGAAGQTLTTLADADRARLPAPALGQHLGGEGAYRIRSQQRRFQPSGLL

SEQ ID NO: 1013247 - protein, 141 aa, Homo sapiens
NSPWKPKRGGSGEGARVGPPPSPAWVGPCVGFFPFSPVKQTPQTRCGETPPPPYRLDGGAALLHKHPSFLDGGEREKQTRRKRGREEDTPRPPSPKADNSGERGLTAPHKEHITPLTRRRDYLLPENQFCVKQPQPMKKNY

SEQ ID NO: 1013248 - protein, 134 aa, Homo sapiens
MVEGRGKARIANDGGTILTLSGCCPSCEQRRWVDIAKSQDAEVGDGTSSVTLLVCRVSEAGETLVWTEGCTARRSSYERFRTATQLAELTRSTEIAVTAKQGRSKVEQTEAAGKVCQDRSELQKLISQQKSFLC

SEQ ID NO: 1013249 - protein, 190 aa, Homo sapiens
GRGPPLPKAHPRPPLPPRPLTSQHFSWGKWPVGMTGRCSVLQMAQDAERGGSLPLLGLVRSERSSQAPWQLLPRPGYCPRTMCRLPSASSPTPSFRESILGRPGTQAGSVPCLGRRGATRACSEAGLSAWLRAIGSARYEDGPGCITWPRGQSWQFPSVTLTEERLARTRHGGARDPCSLSASIRGTDLE

SEQ ID NO: 1013250 - protein, 141 aa, Homo sapiens
MRLFLEKRFYRRRTLGKVGSGVSRLPTSHVVYLAGPGHPGMKGLNGTLEGMGPEVPAVRAYSGRSLDSPIRHKARGLGCASFGHKSVELTLGITFHLGASKAPWLAKQFAGLVLEWATTRTYPKWIGHARPERQEGFTVGT

SEQ ID NO: 1013251 - protein, 224 aa, Homo sapiens
GNIITLLIGSQAFKIFIHRGGYIKQGEVQPSGKVVDERLILAKTVGTGVGSRVSSAGACRENSGDVQWPRVSGHKIVYGRGTVHGVKLRRLVVNYFTNGRETLKRYSQVTTSHNRKTKTKTETKQTQKTPTQANDHTRPLNNTPPPTHKTNDTNRTKKHTHHRSTTNATHRTTEQTRVLRPDADTTNTPDDPDKQQGTTAEHRNTHLAPPGAPDTQQERGGNQK

SEQ ID NO: 1013252 - protein, 136 aa, Homo sapiens
GSHATRPTTTPDVDSRLPFGSKSNMATLRDQLSYKSVKKEEQDAPRNKDYRWYGVWLRVGIGTVPFSILNERTWHDELCVLSSVTRDDKLKGETMSGVSRLVASLFPVERAEQTCLVGKRLISVHRAITRNDWYII

SEQ ID NO: 1013253 - protein, 319 aa, Homo sapiens
MGLPSKRTTWDAPTSRRTCRLDTGRLSAARPFWPTALPIPYSRRLWGPKVPSVRLGLPHQGHAPGDPLLSPSTTYRVLTEQAALAHYRATEKAATLHQWDTAHPHCCVLHQQGATHGDLHRRRKHTRPGRTRRPPLGAPLRTLIPWPKRQRHALSRHHLPTRPPHQTDLRIPANTPPPMAHEKVTHAAIRHIKHKPPQTNQRATSDHAMDRRHQDPEAQPHTPGHYPPTPPSSPGHPTYRANTPYEPKRHLATHPQRTRTTHSAPHTTRRQRHTEHTFRGTHHPVYPRPPALTRRTATHTEHRHHLSTTAAHTTNHPRA

SEQ ID NO: 1013254 - protein, 391 aa, Homo sapiens
MRFLYECPWRRLQELRDLIPKIPFRIQLRGANDVGYTNYPRQTVRLPSSRELAPNEQWPWMYYRSVPTPLELTCPTMLLRHGKRDGSARRPSVEKCCQSRIHLGRTVGPEPHSRDLMYIHHASERNTAALGPGKEAWVTGRHWQSVGLVACGHSTGIIGPGRRDVERSATGDPLQNTMAMGLIQHPHSGEKPRPCSPPVIRHTYLGSIHKGTHNMNHRSQRGGQGAAGLDPMTWRAAWPQKGLGHPLDMFAAVDMVGANACEHYPQMVPEGEDLTYTHHEPQTIVGGVVPIETVWPLGIAEHRGTTCAPLGIANPTQGVEHRLGNVRGLGTMTPYPGGKHTGRTRGGLPAGTPCYVPGGAIWNRGATGDHAKRDMDRGATTQRGGLHSYTT

SEQ ID NO: 1013255 - protein, 218 aa, Homo sapiens
QFRKINGFPNACWGWGGEDDDLWNRVQNAGYSVSRPEGDTGKYKSIPHHHRGEVQFLGRYALLRKSKEGKGWHGLNNLNYFANITYNALYNKHNCQPDTRAGSGERVLRGRECTFAFTHRHQEQQSDETPPQAGGQRVYTRTAEQNLLCLTDRTHRRSRGKHADSTTHQTPSLDQPLELSGVSSADFLRQQLAFCLHKTRRLSRCSLTISYPTSCLSR

SEQ ID NO: 1013256 - protein, 148 aa, Homo sapiens
PTRPLKSFSSPSLCSSGNMRPTKSRLRDLFCMGAAVPGPQRTDSHRTEVFLQTLPLQLEHYAISEPRRSSHHASSHRANLASSVRSCGISETRPGSLHQGYSPHSPTPLGKESAVRLGWLAQGEIQSYVPCVPTLMRAHAAGAREALR

SEQ ID NO: 1013257 - protein, 115 aa, Homo sapiens
MNIEHIVCGALESNSRCHSTSIGEYGVLADRVSPRTGEKVGARYFDKNVSEFAIRGKPGWHYGLLIFNLLQSAIPNYATKDESLGGSLLATLVHAFVLPRSCPRGVVQQVFLEGL

SEQ ID NO: 1013258 - protein, 250 aa, Homo sapiens
VDGDHCGHLRRQAKGQVTVHRCALPDGSDGGCVIVVRDMRTGDFRHLSIDWPAQAWAYFPSVLVCAVVASTVPNHAPFPDGDLASGLGDQSSSWCTSHPRSAFVQHAWAPARLATHYDTPRGLGREGEGTLGCLPWKRRAHPWGSELVSSCAVGNRCIRWRVESGNPYLDTSDFIHHFSNTYSTKRGLRVLPKWQTVFPAYWPPLQGAIEVWRARGRKRNETFEQKQILSRPSTGRNPRLSEFIGNHPKG

SEQ ID NO: 1013259 - protein, 337 aa, Homo sapiens
MLVVRNNQVGEWDAQKANGSYPRMQSEGSLLCTAVGPLLAALHNCTLMGSHCAVVPDPNGRTAGRKEKSMNNLRPCRDLQLLGVLELETVPHTIGLTCQRDATIEGTIPSDVNHEYCYIDAFVPVHGCLRKSSRSQVDFPCEQLLIESSRNTTVIDLVLGPGLLALVTREIDLLKILRDWTRGEIANTPLREPQHDYSPKEFPEAAPYMSTIPNQDWFAVGPLRTHKSGGSGGRAKLLAFHWTDRKMPMSRFRTPESTPSKAYRHGPRQGGYSQGNILILAHYAERCHRGGPPRCEKANPGDDRGQGCSYTVGSAKNKHWPLIVWYNYPRRNFCFQK

SEQ ID NO: 1013260 - protein, 183 aa, Homo sapiens
MLQLGYAYAYESINLTRTTTTCHTTLVFQVPIRCRSLLIPFARYVSTPLYVPPTTSTWHIKRRQPVTCNRIRRTKGKQPGESHRNPLQPVKHNTPTPKRTHNPTHHNDWHPNPDTTPRVPATRSFSSPHSSLCGEPSHLLCQLETINLPTLGSHGIIISSLSLRHNDSLPLSDIIRIPTRTDQ

SEQ ID NO: 1013261 - protein, 136 aa, Homo sapiens
MKILYAEKKAESRSYASLHTPQTTYTLVKDAGADSIERTIDESLEESDYHELCVVGWFKLRWEAEELLSSLYDLGSANRARRIGRRSVEDLQNKGISCMCLQDARSTNRSQTYDELEEAHMAWCCAKGVVRSLESW

SEQ ID NO: 1013262 - protein, 238 aa, Homo sapiens
MTHAFAIHASAERVSRPMRTRPSACDLGGTLIISFTSDPIYMLLLRQQQCLMRKQARIAHTFIQDAVGISEHEIDTNIGLVLSIIEHTRDAQGDIVRLVTLVCGGAPEEPPAFRTYCVVCCVVNYEGCSCDIGRMPLMPRVLSRLVDARHTEYASLEASYERGVAHVTEVGPYEMWQDLVLGVAYSPQGGGDVGTTDIPYPRLNKEDCGLVRGAPSHEETVRHPVDKVEQLKERREYI

SEQ ID NO: 1013263 - protein, 138 aa, Homo sapiens
MASLPTARLRAIYRAAETVSATRSVRLSPSRVVRPPARELESSTVGLRVPWTLSGGGSRLVRPLTSRMSSSCSERILRAVAFSQLDSGTAWRGGSRGGWLLERVLPVTCCELRQVGPMVRALEAETCVVESYSGPAQN

SEQ ID NO: 1013264 - protein, 273 aa, Homo sapiens
MPHPPPTGESPRRGSNETSKTGKNTPRTQQQTQKHTQDTPAQKRQRTHTDDHSATPHTPAQTATTATQPPHPTDTQTRSHTAHHQTKPHPERLDVTKTAPARDAHLRAQHAPQRGPLSPLLPCHPPPPTPPHAHQWRDEGTGTVKLGGDVWWDRNIAQYCPPRPRSCWVWTLRRGFRRGSRGCQGGPRTLAHACRDISPAAPAVHAGATDRSSATAGGRGGLDMTGSFAMVGGQGRTHRSRARSPWRRSDGDQAANDWGARAHSGRAVGGRES

SEQ ID NO: 1013265 - protein, 35 aa, Homo sapiens
GAVAWWVRLVPGGVGGLPPVLRATHADAVAGFAGA

SEQ ID NO: 1013266 - protein, 86 aa, Homo sapiens
RVRAVSSMEAKGFGYWLQVGELSCDIRVAIKRNGPYRIPRVKNMLYVYNSKELLEDLSMITIVKVFETSRLPVEANEQTMWALLRN

SEQ ID NO: 1013267 - protein, 72 aa, Homo sapiens
MVKAYSKYAVTHTTTSSGTCTLDGKRYTTWVDSTRQKGRSSVVDGEHAKGLGSRRLIQGEQGGADRKARAPG

SEQ ID NO: 1013268 - protein, 279 aa, Homo sapiens
MSVVLHQWAGQLAYALCAVASLAAWHPVCAHNDNMPGSPEMNLPTVVRCSVKMGVNLTRSNKETVKHSDVLYLGCEATYHPLHPGMRSGARQCKPDTSVVSMCLLVSPISTVEKNADGNTSQDPKKMIQLHDQTQLIGTVHRKCANKCTPRGIPLTLDGTDGTGVHEKPHSWMPGTRVRHGTLRVGKKENLQQNAINTSVLNVARRTLQKIQQMGIQDSAKGARTSTPSHTNRGVGPPRARCNTDKPGHHAANREDRQAPSKTSGEPQHKQPSKPTGTK

SEQ ID NO: 1013269 - protein, 239 aa, Homo sapiens
VVCLGADGEAEPTMPDGPELGFVATSLCDPAETLYVEDLVSTEESEARSASMGLREQYVEVCAGVIIYPGLSILVMVARELLTLDENGPTASVRRQRPTCGGWSALAVLDEGKMTAGLHPGPEDRGFLRETPAMTQVFNAGLGQRPSTTLACWVLPSCQYRGSAEQVVNDPSFIVRGWIPEKHIDFSLRSPYGGGRPGRVERKNANERAMAGAGGCGTTEEEEFTVQLSLPGAAWIGTP

SEQ ID NO: 1013270 - protein, 167 aa, Homo sapiens
HSYSSLYPFVESQGDSYCLAERRILGYTTTYAKARNFGMAPTGADYNTFADACKSRIQRHRSPVNNPASYFEASHLSYITGTRTVRLVDLSLFRTSESPFFIRAFALVLVLRPRSPVPLIPEAKPQSASSGEVIQTAHPDSRECQLSRNIHNISAHLESRVGSILEF

SEQ ID NO: 1013271 - protein, 124 aa, Homo sapiens
CRQNTGVVRITTPKSLGNGNMEEWQLTSRNICTLNWEHGSIRDKSTSISVDRSDLLNCGWHSTIMKPVDTKFDQRSAVCKHGTYGLLSELCPGVSGTNQLEIRLSREPMDTHAIDYSPSGREKY

SEQ ID NO: 1013272 - protein, 290 aa, Homo sapiens
GPGGSPTVPGCGEAAPAQSVAAATPGAAPEPTARRACRLPVWTAALKRSRSVGASRISCRLTRDEEEEEDEGMEQGLAGGRMRWIPGSREQLDEVIHQLHWIDIYSSSGETESLRECSVSIGSLLWFWVVQQPDEHLAWTWVNEELAKACWTDSQASTAEGTDGLAQASAQAWKLIEQPLQVFPEGATEGASAAGLRETRFSPWSDAAGLLCMDEPSGPVLKSGLARTMLEVTATQKGSLQTADADPKTQGAEPGCIKGDAQPRVPMADHGPGTADRLDQRTTHESPSKK

SEQ ID NO: 1013273 - protein, 497 aa, Homo sapiens
MLFHYHACWLFELISTSQTHHCSDAPSNSTYPDRTTTCTHGCARPLAATAAICALRYKRQCCPLSTLTCALYTCDLYTCALLLKQRAHLRAPVRLTPVHNYTHTHAHNPARKPWHAPTTNLDPPSTPSHRTPSPTLPNPYQQVAPRPLKRHDAHTLHCNAPRHPPPDPQPGNGEDTPPPQAPKRGKNNTGSHTTAPRTTHLTRTGGNPSHNTRTPNPNTSKTQRQHDLDPPNRQHEEHTAPRHPMHSGARTTHAGHTPPHGTKHTRTHNETTSKARQNTTRPRKAPKQRTVGPLGRDHKHTSSQTAYSWEQTHKQATPNHLGTQNQPPRGSTHTQCTLTHAADDGHKTQNTQSHNTLAYTTPAQGTSKIQPQIQSTQPRLSGAAHKKTTHHPQTCDITRHESAPPSECATPHQPEHPTDRLAPLLRAPTTTRPRQNATHPITNTQVPLHPKPQQRDSTTKNQARASETPPNLNTPHTVRDKKQADQPPHRLDTTPRS

SEQ ID NO: 1013274 - protein, 75 aa, Homo sapiens
MNLLLVKLIRNFRDLSIETIAITEYYSVITLSHCRIGRKDFCTYALVRVTTSSDERVPVTMNILLKSTAYSAQYS

SEQ ID NO: 1013275 - protein, 136 aa, Homo sapiens
RVFQADQAGFLQEQQATAAVAAFVRNGHGGAVFQLSQAFDFLRVTTERLDVHADHGDQVGALAFIEAIQVRLGLEVVGVQVFLGHLGVGVYVVGEDLDFQVHAFFGQVGLISIEDLGMGDRRCRHDQFLAGLGQTC

SEQ ID NO: 1013276 - protein, 305 aa, Homo sapiens
MYCDSLRLSSQEGSVSCAINHDSVLTITMCLEQLHMHHNHRLYQTGTRLEAKRATDHLSLCAVWLKTGKQMKRRLFQRDSQSSLRVSPLKHFMDQCDRVSCTILLILYKTTTHDIQRAGRRIHLHLTSARPRETSNSKTEQGTTCTQEQLWRIQQPRCHTTSAAPTAHTRRDNSTNGPPPPLQSSNATTSSRWALHHLGATPHSVLPPHHPWPPLSAGPSISQLSNTEQQIGDKLVHCLAQSDSRRLRTPLHSQTLTDTTRHRISSTAAHIAVPHAINQGGRLAPPAPAAPGPAATPHTRHPHDD

SEQ ID NO: 1013277 - protein, 144 aa, Homo sapiens
MIAITYIRPDRRDHIVETDELSTAACVSVENGTSGSEQEQASLDMPGTMTVCVLSEEMPCEFSDTKACHINTSALALGLENTTSLGEERSSGKGVQGLTRCIPYIRSCLSHVPSVTLKTQDLALAHGVENVKPHGRPLRFTKGF

SEQ ID NO: 1013278 - protein, 167 aa, Homo sapiens
MNLILCDCDEFRKIKPKNSEQAERAMQKRVLVWCMTCDGENLVSMTSQQGPPSHKTTVLLLRGSDFGGDCLWVPDVGIGQGCPGSRNSQSGNVPCPQGVLAGLCWAQVACVRFEMVSFPTRVNDTLQAEERYVGAQDRLDPCFQQCKLICRDSKAQYAELGPWGVIP

SEQ ID NO: 1013279 - protein, 145 aa, Homo sapiens
IFNLKRQGLTPCHPGGSAGVLSQLTAASNFVGLKVIPPWPQASVRRRGHHAVLAQLSPKLTSFLVFIFCAQKFSTRVVGRGESVTGGQQSLVGLHETSLLHPSAGSPRQNSSRGLTLSVKIFCGNITGAHTHTAPTDIIFVWIFL

SEQ ID NO: 1013280 - protein, 69 aa, Homo sapiens
MAERLADKYEEAKRKTGGYHEQDEKTTSQFSLVSSQFSTDSERDMKKRITADDLINFDILGKCHRNRLL

SEQ ID NO: 1013281 - protein, 160 aa, Homo sapiens
MVIARQKPEQGSPYSVDEAVHKSIPMAQVVDTLQWAIASYDPESLMHCMTRVPTDVCDTERRKAPMLEFPRRSSAPLCQFGPRMSDDYTGRWAISLSVVESHFVTQGRYNSRARASIAALNATLWGMPAQADPLSNLLWPRLYTMAGTDNTKSLQPATFE

SEQ ID NO: 1013282 - protein, 131 aa, Homo sapiens
SYCHRLTALHESTVGSRYQPAIWESRDLIQHAQSIRVIIHFRYCMGLPSRHMRSSFRKMKMVLTMVASLLAVQQAANCMWGLEWTLMILLICQRKTVYAAGPITPLSEMENRPAVACRSSTDIAHHVINQQ

SEQ ID NO: 1013283 - protein, 176 aa, Homo sapiens
PELADKSVPNFMSMKGHARSLKSLGYVKEQLGWKHFYWYLTDEGIHYLRDIPSSSPRMIVACQPYAASSVLGDWTVPRSRRSGRVSDLSETQKEGKLTEIPTDGAAVPTWCRPETADGWWLVLMHAELPVLRGGILVRGRGHGTSVSTWTRIRDAVDTRNLYKGNGDTLKGQQVGE

SEQ ID NO: 1013284 - protein, 73 aa, Homo sapiens
ALAQGHVAIDAGELGGAATDDLCSSPCQVLLLHPPSGSPNCFCRHCLYYQRISDYIDAASGNTDRATGCIFYN

SEQ ID NO: 1013285 - protein, 263 aa, Homo sapiens
RTFRTERAYQKQPTIFQNNEEGPVVWRKLARDEAPDGTTRSIVWASRHHKVGAAEPQQDKKGNLAVPATCAHDELPCLHLSGILGAAGNWKIAYPEATPLALLRNQPVPRLTPLVFPSFQAIEGTYIDKKVPLHWKVCPFEGGSISGVVTKMKMRRTMVIRRDYLHYIRKYKPLREAPQEHVCTTCPRLLQGTVTDSVTSVTVGLSAVALSKTVRFNVLKVTKGCRNKNAGRRKFWGLDHRVALPNNETKVNYSHSQNKLIQQ

SEQ ID NO: 1013286 - protein, 215 aa, Homo sapiens
MVFSILMLVLETKITFHTSTTYTLVLTAFGIALPAEEENKLEDVVQTLLQDQLAPQVCRCCKAIVIDLRQEVLMHRDRELNGAQDRCIIVDQFVVCFPGSYVSKVCCGYSVSETVHFAAPSGQLWALETGNGNDSVSHIANAILHWRSYSTRLHKQKQKKKTVPLSATSLQPSVDELREYRATVSASSCSRLSSTPPDAMADHDGSSTGGRTGNE

SEQ ID NO: 1013287 - protein, 205 aa, Homo sapiens
MLRDLGCQDLLYSSFQAPCASDDCTESCQRMIRVGIFGPRRTRWRLVQHEDCTYAMIPLDLQSILRTIACALDGLLRHGMQTTRVHMMLHPWVLTTSHIGQCFKLGSLSVRPGPGDPGLMGFNVYDSDCLQLVVFHPCTDNAAVPWMCWVLSKAGSSGSQYILDLPAEALQAAHCPFDFVLRQRSVALELCVTAFEAQKPDPKSA

SEQ ID NO: 1013288 - protein, 88 aa, Homo sapiens
MQSTPESEQRTCSSEDGSRAYRQYSGTRSHDRKRHRQLADHSDRPIDERTQLEHEEAEGRVEGREHAQTTRTEKTTSTDEKTGEKHKP

SEQ ID NO: 1013289 - protein, 328 aa, Homo sapiens
GRVGRPTRPVDSRCSPCLLTRLSGLSDCLSKHIQKQDRTIPQCNSALWLEIISWYTAPQKGEQLVGKNQRTGVYKGDCNSEMAPAVVYCCLQMAHDTLFTNSEKPDKCRPRIVAGITDRWFSPHLIIVVFEPPLAYGSSRFRTTVEPEVVDGPFLLFIDSKKKHGHTETTPKIERTPHHSTEEAERPVSPCTRKGSSHHAKGRESPKGRTLSVDAHTYILPKCVNKWSECHTRSGRGCSTDSTISTHVKYMVFTVATARSPYEHTRVPKSLYRLSGEHTCGRCIRRCVAVKLSFVVKTRHKSGPILWPFTEMEGPDVQCEMCSKMIAQ

SEQ ID NO: 1013290 - protein, 327 aa, Homo sapiens
HKEGLKKSKRNSVKSYPACLPKTSPLASPVLDGTAVPSDTDVVTARGTRNRAQRVALITVLPLTSGDLLVTVASTQGSACRLYFIDQLKLDAARRSRRSMHHSTSTQQDPVWSLHTCISTAKPRTYTKPDSVPNTTQTLPFNTNNEPGGDHRQPETQPIRSRHHAKDYQTQSQNAATTSVTSNFDPQMNLGTKRHTRSYPHNGDYHAAIYPYFLERPTTHTTTRLIYQNASDLLSDSTDQIPELACNLCLAHHGFRDAPTDLNNAPYTVEFLKASKQPGQLTSQGRDSPILNVSTLAFPGTENGSHGDTYGALTFSRKAAFSPPKMI

SEQ ID NO: 1013291 - protein, 93 aa, Homo sapiens
PTPHCTHSNRDGIPNAYRQRNNSRLYTTTTKAPTLEAPTGYYNPSADANRRLFIQESPIRDSDHHLPITLYYHRPYLSVSAIAASTSEPRLAQ

SEQ ID NO: 1013292 - protein, 253 aa, Homo sapiens
QSEIMEYIVCCCLEHSSRGRKCRRGEAEKRLLLVDFMQPSPVPATRIPGQVLGEKVLGIVVQNTIKLANLTESLWLLTFQRSACYSRQYCDVCYMCVLVLKTPTLSIPGALDPVLGVQDRQEQKSQYILLLQPLDLLCSADGLLGGVWTAVHKHYLSLLSYVGCVDSALALPCLPFAAVSLAPVRKPLGLHPFVVALDPCCWAVLPCLEHELPCSGDAGGPCTGLLRAWLPSPWPSSLALSPLVHLPFPGIGP

SEQ ID NO: 1013293 - protein, 164 aa, Homo sapiens
MSALAEPSQASETHVTDRIIILSQGLQTLPPTNSFILIDFYASLRYTSVLTHSTINLTGKTTAVLVTTYLLIKYHSPTSQGRRIILDHQTLSISRTTILYAQSTMGSHSYHALVETNIKRLYVTRENTLMLHTTLNPPQFSLTYSRHNPPAKFDLNPGVCTPSF

SEQ ID NO: 1013294 - protein, 243 aa, Homo sapiens
NRRSLTGPASSDLAVDQGKRGKEPAGTGRGHLHNIPFIHRTKQTTHRVTMAVKMWAAGEGGGPGGEGGCGKKNTGSPTMGVPGGNWVCFSPRGFQKIKKQLGKAKTVKGWQGEGKSRGWGVCWATGVKGWPSPCGDPPSPSGLGRKGAACNPQGQVWGCQMLQAGGQKGAHKGCALQGDDGMAPTVLGQGAGVLDLPEEVGWHSRLDTRFSYLLRGRPWEPALNSCGSKGRQNSGAQKNNPQI

SEQ ID NO: 1013295 - protein, 230 aa, Homo sapiens
QTWWNGDSEKSKPKGKSMSLAAKLRVNGRNLPFQLDLLTQNNQKTRRTIYDDHRKISTIVNLAYDTIWAPELSGLPSQGILMACQLSPYCHSSTGQSLPRQSETQDNPHQSGGTVSISVTATSGERIRVSRLFAVLVRTWAVHTIIVDIGPMVSSSFIASGKYIILNYDDVRTALSAQSSAWPRVWLRAATNCEDHPIALAATGNIYKPPRKANAFAVIERTTSDGKGCF

SEQ ID NO: 1013296 - protein, 191 aa, Homo sapiens
TEPSASTVISCPPQRIAFLNEHHGQVDIARTPIGRQHWIPGRVDTSGLQSDRCTDENSPYCCEEADNAWLTLLCYQVALPSDTSPGLGSKLYNTRELSRTLTQRTLVGETYLNRTELQKKLANRLGAALLEPPPTVTPRASNGGWDTTQPDDENFQTEITTYTFSKRRLRLPLQVGRTRPLINSPEPNIPS

SEQ ID NO: 1013297 - protein, 201 aa, Homo sapiens
ERLGQHDQRERLDDLCTRLQMTSTKEQVDEVTDLLVSFTSLSLQMQSMEKRQQDEAPMTSCHFTHTKPHCMSQYQEKAQHLGLGDCTMSGEDLALTRRMQWGRGCSSLTRNSETTVPDHSIQRSLCDKGPQSPSFFTVLAETDQTSAAALQIRRTALSQQTSHCHHGLHWQRSRPQTLLCVPSMAMGLLQYSRVWALGGHT

SEQ ID NO: 1013298 - protein, 193 aa, Homo sapiens
MTSNRPWYLNKRERRKKKTRRETGALREEPPHRGTQDKHEIPQALTVGTQTGEAPIREASTTNKQTHKAKMTRPCYYARDQSNVRQTNEHDPRRNTSERNAKTRKRSQWSVTPHKVLATKESSPESNKQIDNSTKQRQQTEQHAQKTALTSGRQTTNKGQQNESKRWEDKVARQAGTTRPREQTEYNRGQRQN

SEQ ID NO: 1013299 - protein, 258 aa, Homo sapiens
MFNKYTGKSCKAARIGCNSGAKSLHTPYATGPESGRNLTSRHEWDTEDYRNNSQRSTKHDHHKHSGNDHEGASKGPGGGTHLEHEEAPETAQNNLNYRGPINPVCDTDEHHTRGRQSMSTTSRNPYKIPPTTEERTSYSGNQRESTDEVATGTKRDIKPAYITRKKNPKVKNTEENLADDQRKGDPNAKDSFTHRQKFWRNEVRGETTIAQKVARATTPEEEQIAHQKEGTPKGDNGWVQPPAEQHTRQTKKVESTPN

SEQ ID NO: 1013300 - protein, 62 aa, Homo sapiens
MESVFATHIYHLLEHQQKHARRTCNVATNECYNRRGRLAWVVQTCSEQQCVVVKQRVRISQN

SEQ ID NO: 1013301 - protein, 314 aa, Homo sapiens
PIFVPACVDYFWVKDAICLRELPYGTKGSEDLLLRVLAITSSSIPKNIQSLRCRRCVGRGERATRLTEQLSWRACHQAQYDGWVNQTGDKAPGGLAHEGDVGVQDHRVRQLSYALECRRQRSGAPKGGKSNPRTQNTTALESVCKGQGEKTNVGEKSESVEAEYTNAGVAEQGHTMGKDRALPHVPLSGGIGSTARLTTQTSRGTPYQAAQAEPLGSKQGTPRPNTWPARARRERPNKDQPERNFKHRDDANTKGAARLGHRSTARTPSHPLVMQTKGANREAPRPDEAYTTEEQPVPQPDERQEPNNHAETQV

SEQ ID NO: 1013302 - protein, 168 aa, Homo sapiens
QSKRQHVYPDKPQLPGSWGPHHWIPDPLTPRHWIPVLVFGLLFRFNLDTGSQTPSADMPDPCISSTMPSRPRHWIPDSQVLHPPDSGSIKQVRWVPYCAQQCGILANLQTAGVPDSGIPKSRLPSPSIVETVISRRQILIFQGTESQALNPRISDLKSSRRRVPNVQA

SEQ ID NO: 1013303 - protein, 195 aa, Homo sapiens
YPTRSAQRVRFATKVHPEEGIQEWATSSTMDYIGPCKYIPPCLDSELTEVPPWRSAGLAQERPWSPVYERDEDNNLLSEKQKLRVKKIHENEKRLEAGDQPVELLARDFEKNYNMYIFPVHWQFDQLDQDPIDGYLSQNELDSTCVLPRHHAMEHWTTRLKRDTVTWTNDKYIDLDEGPDDFGIKQKDIDKDLVI

SEQ ID NO: 1013304 - protein, 194 aa, Homo sapiens
MIASAGGGPLSHEHAKSDRKIARRQWDAWRQYSHTSDMHRWVCTTSPIKSRSSSIGCRHYDSLLAGPVAEYLTSVNEIGGDVQKHAEMVHTGLKLERALLDTASQCQQPAENKLSEYVGTISEQIKRSDNLSGRRTEDSKLYNHLSAVRETYPGPGLGWLWLPRTGPYVKDMNDGSHVLYKPEVLKEVQKMWIR

SEQ ID NO: 1013305 - protein, 148 aa, Homo sapiens
MERPVNLGFGIQLDKKIMTDYAPLSYPQTDVYLMCFPIGESCSHLKSVQCKVVILRCRTPVSPTLRIDPRWRTKLDLRDDKDTIEKLKEKKLTPITLIRRALAMAKEIRCCTNTWKCSRATTQRGLKESDMTQDDPSKSSDHELPVQE

SEQ ID NO: 1013306 - protein, 76 aa, Homo sapiens
KRLVRRFDANASTSESDAKETGLPFMNSFLREGGHVWPKEGCHMPKHPGSLADKNVPNLHVMKAMQSLNVPEGFTV

SEQ ID NO: 1013307 - protein, 76 aa, Homo sapiens
KNPPFGGFFYKQAVRSESDCDHRRGRVGDQLATTDSREEFEDAAFGIGMNSQNFCLLAFTIDMLIHLHFMHKMYGL

SEQ ID NO: 1013308 - protein, 154 aa, Homo sapiens
KRRYGRNTGISVWTRQEPAQEGSGVIATPGAEPAHCTTPAPFFPSQERPREKGFPDPGWSVPSMAGLEVLFASAAPAITCRQDALVCFLHWEVVTHGYCGLGVGDQAGSPMITESPMGKKKAPFFVGGPRFLGGPPQKRGAPFGGGGGWGGKPK

SEQ ID NO: 1013309 - protein, 518 aa, Homo sapiens
SRRTHGALHTQRDREDYCMWGGGMVQFYDLLNIYELNGLPSETNTLYIFNGDFVDRGSFSVEDDPSPINRDFKAALYPVITFTILRGNHRDRQHEPESTGIQRVQVKAKYNSPEWYETSYETRMITRVASRIWNQMHSQRHNDCLNQRHREDLDLPLNRDRHCHTMSNDKSQAKTHTTRRQQSTRHDPPRGTTHSGAPQPDDSTTVHKHGTTEHIRRPANTRKTTDGRHTELRRDTSRDPTPPSSTRQQRQRTANDTRRHNKTEAKARPVDQQAHPQERTTPHHTRQQTRQTCKRHTSHTAYRREQQQERESENNDSTQRQTATEHETTTTRERDRRSEEATRRRTANEQRAENESQASADQQRNESDTRTRANKVSREDRGEQEHVTKGDAHDNRAKTQKQPRNEQHQRTPTTTPHTIAHNARRHERSRQAMNNTPTPQSNRRHNQHEPEHAPTNHDNARSTGHTQTTDEDEQSTQANQTIKTHDKPENGEQHLNHHTPTHSNTQEHAQTRRHAHDQ

SEQ ID NO: 1013310 - protein, 169 aa, Homo sapiens
YGRRDRASVLAARVDPFGVLASSIVLPVALGRSHGVASGLGAGGCGRARCRGPAARASPELPEGPPFPALAGCWTLAIFTRVCLAGTDLCPLLSPGLWLQVMPQNPETRCLLSSPCASPQRRLPPNAARFRCSDAEGMPIVPLTEPRTGARAGTKPRRTSRTRTCPLPR

SEQ ID NO: 1013311 - protein, 195 aa, Homo sapiens
MADGENSGHINDVRHANIWRYSHFTLQLLKGYTEVLKLLSTGRRMMLSIKDYDELDTVFMLQIIGVKKKHVEFELDNLCDMEMVNKVGQTALDVADEDITGYLEELQKKLKICSIVNEPGQEISTNCINKQILGQVIRQQEGPVKKTERDARLMGPREHKRSRRNGNHRETRNTGKMKRRRRAQQGLSLGGASER

SEQ ID NO: 1013312 - protein, 259 aa, Homo sapiens
MFRLKYRNVNLSKEIIQGRKFSETYYTRILPTLGETNALGSLGYVVVQTVKEILLVFGRIVANSLGKEKEVNVTKMKSGMQKIGHTVVSQYSCRKKAVHSTRWTSAPVEASSWSKVTSEKIQPTLRGIVERASQLQAASVGMAWPGNRPRNEVIGHPLEAEHSGHGGVRRMRQRKPAVNLSNAMEGSGADMGPSWQMKTRGNIRARNVSYEATETRTLTHTGQQKGARKRQAQTSGEQDPTSISEKEQHGADKETREDK

SEQ ID NO: 1013313 - protein, 245 aa, Homo sapiens
MSQHLHPAQHRGGGATVHNLNSVKESPHERMHRHIELAWAFIHASSARVLIPELRWVLLTCMGQDSLPHQEAAQARPRRHQTKPHTTDGGKQPTVQRARRAIPPTRGPRGKTCHTSDTSESSRVNGLAAFAPLQSSKSAPPEDRSYTIPRQTRGVETKYSTGPEQGTQGRPSTRRHRARKVLGPASHQGTPTHSRPNHGRGEPTHPRETAPRASTHYTGHKRPPTGSARREHPIATHDRTSPYHA

SEQ ID NO: 1013314 - protein, 284 aa, Homo sapiens
SYHAHSIKAAKVVSTTAQVPYILSHRENSFQARSPCSCTWIVLRLPQLVNSKPITIASNPGLPLPVHVRRKATWQALLIINALCYHGQADGAGDVEPPLPVTGGPTNKISTASQVSQGTGFPMFLKFMEVVYVPSTVKRGGFVVLHLCHLFAPIGESSPEKVRKALKILVEQDGLGAFTTSDHQIRNLVKPLTCPQAGAASQSPLPQYVTVKGGHMIAVSPHKQVSNSWTKGMAQSSTGSARPRIARGTSRVCFTFNYVKAGCGIQWLAEILRSPGQPSSVSKA

SEQ ID NO: 1013315 - protein, 99 aa, Homo sapiens
FTMVGGTLYTYLKTGGAYKGSHRCSVQQGLYCPACSPLPPHFHLVANQTVPLNYSANFLPARSQRFEGEIDGFCVSESNAIAYYVSYEETAEVKYSRVQ

SEQ ID NO: 1013316 - protein, 66 aa, Homo sapiens
EDNRVLLAMVKPIVYFEIAVDRRALGAVSFELFADKVPIDRQTIFVLWALERKDLGYKGSMRCYRN

SEQ ID NO: 1013317 - protein, 146 aa, Homo sapiens
MLTERKILGYIQLAQRPQRVYGPYGLLTTLRVTAIKNSCTKEPRRNPPHLAISRLHHRPDLSYSTMRSLYYEALYLQYSKAAVVSNFTSLMALRYIMMSEAAMLVHEPRTSCITVRYLSSGHVGNAACSRRNGARERAYTCQDTKQ

SEQ ID NO: 1013318 - protein, 179 aa, Homo sapiens
GNGVWPGPQAGVQGRESRFTTTSCLPGCEAILRGLGLPRVTGLYRPGATTPSIILVFLVETGFNHVGPGWVSISGPRDPARLGLPNFWGLQGVSHRTQPPFNLSKVWVPVLNLFLSNLILRVLTWKKLFITRVLLELKIRLSRDSLKRGSHKSGLNGPFSLSRGLPRISSLTSLYTVDI

SEQ ID NO: 1013319 - protein, 353 aa, Homo sapiens
MVSATDNESRALSRYSVLKRQCLKHETEWQCNSKITSSKSKRRCPSRSTNYLAGPDGTPLSCPMMRNTLYCFCALEDSPRCYVTWRPCQLYECFVGLDADNNSSLDLLRVLALFNRQPMFTRRSTDSNSPCVRTALGGEEARMAHVARRGACHRSTDDASVTAVVDSLRRPRSPLRSVSLTLRSTLVNACAPRHAAAPPSSPTTGALPTIPARVGTYGGYARARHSVRPGTSSCRLSSLPKAPPHMLPPLMACFSKHGPRKHTSPACYLQTLTPNKRSQLWHQPPRSTIPPLGYHSPSSYQARRNAWITLIASRLVPLNGCLRSHIGAQRRTLLGSNGRFPGLRGRASGGDDA

SEQ ID NO: 1013320 - protein, 105 aa, Homo sapiens
MLPYQVYTKSAWHDTYSTSASLSPNGPSSVPMCTYPLAVGHVCVAHARQKLETCIVVLHGLDHDPGHHSQACLENVGKNNRLVLTSRFAGGPSYLAKIDRSTKSG

SEQ ID NO: 1013321 - protein, 217 aa, Homo sapiens
MSTRIHPCAHNETMGIRLGLCGAPNWGRTNDTQSSACIESLQRIIVVPTEPPYGSHRRPLARPPDGSLAPGPSGPGLSFGFGPACVWDVYGPHRCLGARTRGPAQLLAPTWWCALASPFTRPPLASLGRYLDGPLVTPWVPPPTILRSPPAYLGRAAACPRPAPMPLGCYFAFAHCGSRPLPAFRRPHFHSWLTPLPPACPTTPSRFTQHLASVALP

SEQ ID NO: 1013322 - protein, 108 aa, Homo sapiens
TRPGPCGNNSQTCGGFVRSHSAGYQREAEQSSVGPSERGGQSGAERGMIGRSSCTRRLLGEWRRSDPGRYWLRSEGKGEVAHSRELSGSQHMRDLPKHAHEKRLHTPW

SEQ ID NO: 1013323 - protein, 152 aa, Homo sapiens
MTASVHAGGGPWGALVALGWGTAGGFRGGFGSGILGSGSRLWTAVAWWPSASGARGGKAEDNGVYARHQVGPALVKDMKDKSLEEIYLFSLPLRNQRSIDFYLRGHLSRIEVLKDPCHVHKADPCRAKRTKVQRQYCMTIRGTTNMSKRSES

SEQ ID NO: 1013324 - protein, 291 aa, Homo sapiens
HAVRPRVCPDLTGAQGVSSLPVPSSPTEEEEEEEEEEEEEAEEEEEEEEFLRLHGGMHVQGGPTCHCHPLQARASPAEERQNACPTTSMTQGLHRCCPGWPRNNGSRTARPRAGLAVNEHMRGHPINDTVAPNEHSLPRTSLAPRPRETVCFTMLHQPMCLPHAPPANRHLPSTPPSAPFQSFVLRQDPPTHSARASSPTRRLAPLRRLPWDLAPPGPITETHTPSPTLAPNCKRLTCNAPTCQPGPIGPGAQHRHQRPGAQASQHETRIAPPLPLDIPRDAHPDSIHTEP

SEQ ID NO: 1013325 - protein, 290 aa, Homo sapiens
MGMCAVRRAPMCAGSSGRVMVGGPVMGVILSVGLGSLLMSPTVVSRLKTSSGGRESVQHRGRRERQSLRRSGLLNMCTTPEGRICTRLSARQRRGLCERGISPRSWAGIVVTSDYNIRIGLVSSECVEMLDRPSSHVYPGVFAHLQTGSRSRHQPGGRRAMRDQCRFKHGIRFTRRRGTGVRRAREGIATSLVARGKASAIIECDRRGHREIPGGRAPNVGNTGNYWVPWVLRVRVGYRVKLTTLLRVSVKKLRALSREEHKSVCKATWYVGPFVKCSGPAETAILACQV

SEQ ID NO: 1013326 - protein, 376 aa, Homo sapiens
MSQTREQCPYHGLYHFVGCETGVVVSSVNQISGYPHEGLPYSEADTRISRKIVEEKSVTDIKKNRHTNTSTSRYASIVPNYSGSGIAWLSECVDAQCAVTLPWDSLAMEKIAPGKDWPKPGGTYDVRYDGCPWILCSFLAHPKSRSKPGPTAPFGAHAILPRMCLYPKDWVRNKRSVIPWLGATWMRLDVASNMPWFMGALSHLGRPKFILFNTLEHVHQLVIDKLVPDCKAVYEVESSVSLRAPTCWGFQWSEQTGGSGQTDRLRTVSHNFAWETADMNEPAPKWKRSLGVPHASDRELAAMMHIPGATLTAAGKRPRSWNTRERNTTRGCQGWDDAGQRKDLEWTGTWQRDWEERRRTIHVRLIQPDEAHARDS

SEQ ID NO: 1013327 - protein, 222 aa, Homo sapiens
EIDWMALNGINLALAWSGQEAIWQRVYLALGLTQAEINEFFTGPAFLAWWGMGNLHTWDGPLPPHPWHIKQLYLQHRVLDQMRSIRHDPSAACIRWGMFPEAVTRVFPQVNVTKMGSWGHFNCFLLPGSFFLGFGKEPKYAANTLGEPSFRDESVIMRVRHKSTIYGGQTLFNEMPAPSSEPSYLAAATTAVYEALTAVATEAVWLVPRAGLFQRPKPSKAT

SEQ ID NO: 1013328 - protein, 263 aa, Homo sapiens
MRQTEPESLQSCCAQYRWWSRIEMREPVYGKDGVLAVAGTAGWNSTRLSVHPLGGPITMYRVSASSPPQLGPHTCLRGVFCSRCLGSYNERTPGGLNLRATLERDREYPYDGVQDESYNAIVMKPFPLFMFTVRLARGTVTHPQKCIGTLSGGASRLHRHWPTLRRWSGGVPPKGKPQLNPWEELGSFDVSPNSKVANPKMAQVRVPLNLSVERLSAFVAVDRFTYPVELKAWEGPLPYFFNRVVGTRLGSRLRGEFTPAQTG

SEQ ID NO: 1013329 - protein, 297 aa, Homo sapiens
ARFIINDWVKTHTRKVSSAYLLGKGAVDQLSTAGAGECPLASSGQWKTPFPDSSTLPPPLPANQTAAHVSVPMMAQTNEFNYTEFSTPDGHYYDILELPVPRWITRQHVHCCPVMKQEVPLSARHQAFWVPSSSAHWKGNMTMAAPVSWFCPMFSLGDCKIDLRKPLENLGNDQTCTDSSKADFTSLSDQEPLHVAQAPRRTRDDRTVNASGTVASSSTAVIALSPSMAPEEINHGQSPSLFAGPATTPNRERALFTGATSLGTLAPDGNDAPHLGTPPAHASRPDTHPHAHESKRP

SEQ ID NO: 1013330 - protein, 263 aa, Homo sapiens
MTLISGPNKARGGITHPKEATKQKPNNTQIPKKTNNTYHTHKAPETRTEHNNKNAKRNKHKGTINKRKTTATITHGRQPQHRNNTTETTQRKLGNPSHPNPSADPPLIPEDNHPTVTTDSDTLQANYNQYTKAHPHNFGSTRNDTDTTNAHLTTERTQQSTRTHSAYTTHFPYTKQRQTGNPNRCNTSSHSIHTTRTQDATPDTTALTTSTRDRAQSCDTSALHTPIRQLSHNTTHTSTTLSPKDHPTRAHDRAQERPYSTSA

SEQ ID NO: 1013331 - protein, 189 aa, Homo sapiens
MTECDRMELFTGHIVRSGHLEEDSAPPIPFQIDEEHTPTIIVEERPLTTALASVLSGGDCTGVTLSLVALGRFIVFRVGLPFASTGGLRFRMALGSPKAVLHFGDTLVLRVLASVPGTASWTFQRVVPIGGWPLSLKESPTHALKGHFPCGLVSPQAIFHMSKLGDTVVQLMATLRLSWLTQGIPSNSA

SEQ ID NO: 1013332 - protein, 286 aa, Homo sapiens
DHNNETDLKTIAEFYFQNTSYALYGSLRSDPLTYCVNFHTSRIPLEGGRTQVFPVHCLHKKINDTNVAFCISTSNYKYAVILDDCIADDTNPEETPERPDPELTIQERTPGNHTPNSIKTLSGQHLQRYVEDGKNQLTPGLAEVHRHGRCSCAETRSSARPWWPPKCTFSEQLLAALGYRTTTMASTRRAAADASRNVAGAGGGTGVLLHCQSLLSPATVKEERTMLEDHLGDAVRAGHMSPSPFKQLDEKLCWPKTQRLLPTLRAARQALKGHLLPRAANHFLQS

SEQ ID NO: 1013333 - protein, 37 aa, Homo sapiens
MEGEHKGPTEGNHLGGEEPKHLVGGGNDKGEENHPTK

SEQ ID NO: 1013334 - protein, 135 aa, Homo sapiens
MASLRDRKCRSIQITLVRVVLHVNALQPTSLRYDSHAKGSGLISYSMSFVQGSMAPKGIINELLTASLEPSLNSSERPFGLLSLEEDSCECLAWAGCEKKIRMYSQRNTKPSAVKPLRTAYFAHKTYTWATSAVL

SEQ ID NO: 1013335 - protein, 228 aa, Homo sapiens
MGHAYAYRSSVEIVCRSSFPYFRDHSLQYSAVLADIAKHESLGSKLRYREGDYRILCLVLQEVWHYHKDACETEVTHLTGKFQVISSWRQLPTLQLWFFRPEKKREQWEEKIGCCCMVLRKRLSVPRKHLSEPAPWANEQPFFSMSWLVGSPLPDSASFQKAGVVSLFHQAEVLGDEKPEREYRSGLSYRSCSTCTLAVGIQGTGGIDPGEVHTVSGLNARANAIACR

SEQ ID NO: 1013336 - protein, 216 aa, Homo sapiens
MNRLFTSEMEQSLTWEQDPGEQNSGSLCKPSHSATLPKFPIPTTRSESTKPHILTQELPVLCEMGMLLRTSDVIQYNERTYMTRIADLTEQNSAIKAHMTNLIEPRGEQGDGLRELNKQESASDMTSTFPVAQSLTPGSMEERIAELNRQSMEARGKLLQLIEQQKLVALNLSPPNVTCSVTSQSMDLKEQEDNSRYLFQAAGSPRKGSKLYVLVF

SEQ ID NO: 1013337 - protein, 418 aa, Homo sapiens
MRHNTASQMFNRRGALSHDGHPELHHTYVNNLLPEMTCTTEGWYKQSPEHPRGQVYFLSRTIAFNTNSTLRLRVYRYLYFSKYRRAETMIGIISRGIGPIYMSEHIARVSCKKTTYDHVKPGKHRTEVKTTEPASRIGLANKYERNMKSWQHRNPTKHWTHGLPQEEVTQGKAIANTAANHTHKGTAECTKTPTTVRTMQNTQTKTSTMKPTHNQAIEDNRPEPREYQQNTHTANTTPMRHSADDTTQQRRDTNDGAKLTSKPAANDTRTKTDNPDIDTSSALTPTNAENEKQRDYPPPPRPTPAHSTTHKANANMNQRVRTRGRSDDRRTQRQPGTHRDQRRKNERSEDHDHDTPASAHTNTAAPRRHVAPCRTDITPEHRHRPAQPPTQAYTTSTRPAHDAPDPDPHRTTPTSDTP

SEQ ID NO: 1013338 - protein, 221 aa, Homo sapiens
KELSPSGGGAAPRWTTGVSGASTHWPEIVRSSRLSAVLTRSSLRNGSLAQCTPTSYVHRTLRDRYETVRRDASLCVSNRVSTHLKSIGVRRCCPICEACGSETGLRALKSGPEEQHSGHKHSPVPALAFSPCTHSRGFSAGHDMELYCVAHPQLTGFHLSSLNAQGGGVRAGQITGESVTFPAIYSWLPLAIRSQLLYTLVRQHLSHAPDSRPWRRYQAHG

SEQ ID NO: 1013339 - protein, 102 aa, Homo sapiens
MQWGFPYILVLRTEMPLRNREQIVAVVTEDFNVKILEWERPIRGMVHIVKILCSPSRVRARYRHDPPWRECRSNSVYTAFKPNVGCRILDNVDPFSVNILPF

SEQ ID NO: 1013340 - protein, 96 aa, Homo sapiens
MGRNILRIEDILNGDSPHRKDGGWNVKGRKNKDEEEETRKRRTRGYNRRIEDKSYHVAFKPIKKRKEEKSPGLIQNQIGAVTKVTFDVPPRRKQSH

SEQ ID NO: 1013341 - protein, 66 aa, Homo sapiens
IWQNVTLPAVFYVPIRPNIVNLITPNLRQETTDSPMLSVNQLVISRVLSLGGTGMTSSALEVPSMF

SEQ ID NO: 1013342 - protein, 200 aa, Homo sapiens
MADSERALGVLAGGRAMRPTSRALQKVESSVFAEIIIMPGDPSSGVQCRRTHRHTPPCSVIEMILAAIFFVVYMCDLVNTKIPFSQLVPWSDFFRTLIAAILYLITSSCMSLLREETDVQNRRRGTGPNRYVSSLAMMPMSSFARSAGNDIQPAPTDPADGPVEANFPSVSLVQSANNSSIEDNSSHTANQAIFPADRIP

SEQ ID NO: 1013343 - protein, 126 aa, Homo sapiens
LRVRSRPSRTRQELQLSPVKGLRLGRRGEHAAGPESGPRVLCQMTAEGSDLLSEPYGSANNRTLAVPGVEDEPLAERRTPAALSSSPSRYHEYRGRCIQQGRGFRFGAVRGRLDPLQGPFSDVGIP

SEQ ID NO: 1013344 - protein, 158 aa, Homo sapiens
WTFLYRRMTQNPNYYNLLVLNGLGEVDHMLQLVEHAWVTYTLSDHMMRMDVGLNYMIAAYYYINYTETIELFSMSLNAKTKVRGLIEIISNAAEYENIPIRHHEDNLLRQVVLQKVPHKLNNPEVAMIRTSRPNLLLQAHLSRMQLSAELQSDTEEIL

SEQ ID NO: 1013345 - protein, 338 aa, Homo sapiens
PFAPVNVRRACTICRSMHQEVYEMETLPEYNALRLQLITDVLSCPGNVCSCVVKQIGVGLSEAGDSVTPTHTGEQSCEFECVKRCYSMHTECPEPNSEKTARDIMRARVHFGTLGHNSGSTICQWQRVLPRGVQEPQRLAVGTDAMGEGRKGVGNRPATPITPFRYGERVMACEMPSARRCSGPMVVSFNGGEKGPATWLCCFVLKGNLLFHESLKFANSPCIWRRIPGAVSCGPVDIYGCRNIILQGCIPENHGILARGLGGEAPKFSTKVPGFRGTPKTGILDGLLGHYGGKRPFGGPQRGGLPSPEKMDSIGPPPSGHNTGRSKLDKQRAIREDV

SEQ ID NO: 1013346 - protein, 140 aa, Homo sapiens
TRRRVVVGFCFKQCLDGTRRSFPTPVGRPKPALRHLFTAPSDCPKAPDPPARERRRRDRPGTTSPPPSSVSSALTHWTDSVDHNPLRPMGCRPMEIHNTTKGTVTRRDTGRIPKSGPHEFQSPLLRPQAYPINPGPPFYR

SEQ ID NO: 1013347 - protein, 327 aa, Homo sapiens
FLRGRLGRNRDIMGQHLGEPWMVRVALGLTGLVLSLYALHVKAARARDRDYRDASATAGHRPSMLFDAIFIRRRVAAGGYRARWTLVCWDRDESSLINPNRQYYRLCIVHNYQRSEAYLLGLCLAVTTAEEPSWSRDERSMSIRCVSCVCLGVLSYAGSWGSHVSFSGVVMALSYGFCCGNRSTHHSLSRRVRRVDCRARMSRGDRVPKRTPRMRPIGREARRTVAAIQSRGAVCILRILWRVGTVLECLWPYKGRAHTPGVSPGGPLKKWWRSFRHECYTAAFRTVAQITPATIEPIEDPEDVAQDRISVRLFYNAKMPSDLMVRQ

SEQ ID NO: 1013348 - protein, 129 aa, Homo sapiens
PRVRKIIEDLRAQNLPNTVVQLPVIVLQIDNARSCCMMDFAVKYDDDERGTMLNQVLWRTTSHVASANGSFDDTNYHYRRASLETEDSDGSQGGSCLFIEEEPANEERIKGLANAPRFAPALRFEPLDA

SEQ ID NO: 1013349 - protein, 211 aa, Homo sapiens
MIVGAATGGILLLLDVVSLAYESKHLLEGAKSESAEELKKRAQELEGKLNFLTKIHEMLQPGQGPMTPEQCSHQAEMPGTGQDKMADFFFFFFLEMESSLYRPGVELQGPQLSAQFANLRPPGFHTISRASVSRDSVGLRAPCHHAGLKFLGISTGDGVLTVLATRVSISVTSLICPPRPPKGAGITGVSHRAVPKCRHNNKGDKEGKGKA

SEQ ID NO: 1013350 - protein, 131 aa, Homo sapiens
LLGPCCPHSRFCWGSKFWKVCAQRVLMGLACSSQHWVGGRWLVQNGDVGQPPLPSDERRHPCDGDSSPWCKARLDPWLLTGWTDGNDPKGLGRWPWGLRGNPQLRHSLGLVSHTGCHGTHLLCIVPVFPIA

SEQ ID NO: 1013351 - protein, 270 aa, Homo sapiens
RAGVAVPGAAVPGALAWQEDCERWAAVPGERGGLWTHRAWPLLLLGQLHHLHLCALEPLSCGKLQPRVTEELWQAALSTAQPQPRRTAVPSTLNYATVACPSPCKWVMAGHKQATSGRPLHHCGLVAVTVPCRPGAHRCIVMVCEQPEVLCFRLCPGPVRFPRVHPPVRCLSAAYGGRRRSPVEVERLVGQDNGAGGGCPRSRCVQANATDVRAGSRASIVGQQPLEMRVRERKKRIYEEGLRRRLGKGAWGDQSQGIHRGNEGSEEEKE

SEQ ID NO: 1013352 - protein, 45 aa, Homo sapiens
MAEANNPSEQELESEPRSWSLTRAAGPGRGRPGGPGVQQQLELER

SEQ ID NO: 1013353 - protein, 103 aa, Homo sapiens
MQFRWAETSVEEQDATDMCCGRTAADPAHGACNCARVWPKKPPYSLVKKISRSCSVNNKVSENNHRKPAATVRSFLRSKFEETKGQVTAEALDVTESSLIPIV

SEQ ID NO: 1013354 - protein, 155 aa, Homo sapiens
MRLAKPKAGISRSSSQRKAYEEQAARTGRQRQKWGYDYSTWTQASVDSDRSLDDKPYKCTECDKSLHVSSSTLFSNTSKDPITVNTEDPIMCADVWEEVSSQSSNLIQASTDPYGGKALQTVMSVEKSFKAELKSHSATREFILEKEAYQCDECG

SEQ ID NO: 1013355 - protein, 179 aa, Homo sapiens
MALPIKEEDADAECSTRRTPWIGAEQAEAALRRRRQDRSKQLEDELVSLQKKLKGTEVMNWTIYSEALKDALGEAGSCAVVRMATDAEAERSFSEQTHPAGSGGRRWICAQERLANEAFAEAGGELRRQSDESERGVNSHGESEPNEDEEKMEDSGESNLKSRQSEIAEFAERKYEEVG

SEQ ID NO: 1013356 - protein, 211 aa, Homo sapiens
MWCCGLCLAAALLLLLLLVQLSRAAEFYCQWSALVLALLCFTGVLPWPRSSCLLLPLAGRTCGEPLSIHRPGFAANASEYVLLALRLPTVPGDPGRRAAMDVPVPLVVDLSTNPTERQSVAHCMRPSLRGSVPCSCLPVQRNRPKPWRLAHSLAALCGPQSIVRSRVLSFVQSHLCMRFLASAHCHVHGPTLWLTLPLVQVEYISISVLDS

SEQ ID NO: 1013357 - protein, 84 aa, Homo sapiens
NAGSTAIISPNIGCLEVQSCHHHLLIHPFPQAPDAPPPGVSPWQIHAYPPGRAPHPDATSTAIQACHPLGPYRSSHTQRLTPGI

SEQ ID NO: 1013358 - protein, 30 aa, Homo sapiens
CTGLEVFGWARERCQLGAAEPREAEGAVAA

SEQ ID NO: 1013359 - protein, 166 aa, Homo sapiens
GVTLHRAPRGVACHRYADSPDGAPHPIGLSGKVQNPACHLNSHGELRVIFGVYFHQRFGTGPSRFTRTLWLGTRFAVIILDRREVFRFAYYKLLKKADEGLASLSEDGRSPISIRQMAYAFLTAAIILLHTFWGVVYFDACEQETVLGLGPGWIGSHLLTSGTDIP

SEQ ID NO: 1013360 - protein, 291 aa, Homo sapiens
RGGAYGPSVPAAEEATEARGLRGAWRGPGKTAPILDAGAAHPPAAVLSCAAVASCRLEDVTWGLLEWAHGFWSPCPAPVAVGCVLGGRAWRSELGSLCWLHESDGAGISGHRCPHLHDEMAPHALSPLPDDSLFVASLSSPRAGVGLSQRSPAGVMECVLPTYQSSPLVSGDTSWGAFQVVGAVCRAWEPGGRGLRGPHMPAAGHVPVTCCSRPDYRLLRGYRSTVARVLTQGLLSPPRREGAGVWQSELVRVFAGSPLLARALCSTLAGAGADPLVHCVPASFMSTLSLR

SEQ ID NO: 1013361 - protein, 118 aa, Homo sapiens
LYTDIINIFLYRFSVIDLIARIELRYSWLCPSQVVLDVLDAVHGKAVIDCNFPCLLITRNQACGKEDCLHLQASPCYVHMLGYVSRVWNRVLVPQGIGAHLVPSPILLSRCGARQTGQ

SEQ ID NO: 1013362 - protein, 155 aa, Homo sapiens
MSGGARNGQGQLQKVECAVPLHDGSQEWASREGEWPGGARHVQVAGDPVLTDRDTSQEHFAPAWDEDSPTEHRNAGTRRPHSHHGMHFIRYVNSAELTVGTRGPKAKIGSFWTQELPGAYFGNGASYVRAYILVQTGEDTQGPRMLMCTTLRNSG

SEQ ID NO: 1013363 - protein, 241 aa, Homo sapiens
PAGAQCGVARLGCAKMQRREWCLCCCPAAWGNACREPGMSLAQWPPTACQPTWTEPHASRRVSLTSVSAYLCFRPDAACYLTTFVLPSLVLASGGRWARWSECTLCDGCLMCQSGVQRVLDIAQQLGQMELAKKHKKIRLRCQNGHPCFSAWACAWQYLSGGKVKYMQNPGKFDELGHVPWGPQVAGRALSVTCTVHVPFHEMFVSRGGHGSAVTYFLCADRPTRWYLCLTRCYLARPSAP

SEQ ID NO: 1013364 - protein, 238 aa, Homo sapiens
MEAEPLLYPMAGAAGPQGDEDLLGVPDGPEAPLDELVGAYPNYNDGSEEERLLLPACKRLGVLKNVLAASAVGHAHLRSSTWVGAARGTLGSCPPCLSSSGPRETENRGPAVSRPLSLPLRCPRSCRHGPLAAVGWGWGVDCRRKVMPGSQTHEPSAWVSRTGRSEASPRQTCPSVCDWECQAVTMGRPGAVWGFAWPTGVSLVRVHSGRWRQCREHAGLSWSAAPVRRASALPVSEG

SEQ ID NO: 1013365 - protein, 33 aa, Homo sapiens
MVGCCCISPATEARDGSRTGRRRGRGPELVSQR

SEQ ID NO: 1013366 - protein, 217 aa, Homo sapiens
MVRQPNSSGHKSMDAEDEQSSPVIAGHTATYGKVHARVNRLSAPQRSQGSWRVVCAPADSLSTAALAVVVVELGGHLEQRAQTPLNRLSWPGLGSQSGPEYIARGLAVYLEVKKVYFTDEAHIQELSQSDGKIEASTTVDGLTSGLAEEDSCVWRRGQWKAAMWADGEGSLSTWHGILEGVSGSELYDEKGCNVCRLPGLSSVSFIDPSYCKTVDYL

SEQ ID NO: 1013367 - protein, 42 aa, Homo sapiens
MARQVGVLPELLESLPAACAVLLGECGGRRRRGSHARSVQPP

SEQ ID NO: 1013368 - protein, 119 aa, Homo sapiens
GGGGHLWYLLGWGASRKGRLLGPPHPSLSPGTHDSAALRLNMSARHVSAVGHPDACHRDVRDSRRDAEHTIGCVCMCVCVRAAMYIQMCMDVWALGTTITGTRDIYQYRVEEEGGCMTL

SEQ ID NO: 1013369 - protein, 157 aa, Homo sapiens
QPLRPGGSGAYDAAAKAAAACRTCPLRAGDSPSVSYVCPCPGSLAAPCCHLAPLHVIAHGCMPPRLMPLWCLLTLVTQLLLLPPRGPRPRGFAERSHDVACATTATDLVLPILCGTINTTRCDMLLRGRVVSWSTLSRALTSARFLVLLRKRHLRPS

SEQ ID NO: 1013370 - protein, 88 aa, Homo sapiens
MLGALQNRERRPSRFFLLYHRIHFPFLEKIFKFTFGFQKHSEHRCFMVWEFQHPEFCCLWLRLSLASLSSLSTVPGHASLFGHGSDFQ

SEQ ID NO: 1013371 - protein, 39 aa, Homo sapiens
TVGLKYRGIDVASGATASTPDAHGIPRAPPALAALATAP

SEQ ID NO: 1013372 - protein, 297 aa, Homo sapiens
GLCPSSDTPMPWCSCRASQRSSGQRAMETERHPDERSAGWGRRGECVGREAGMGWLLEAWMLCPVLLPCCPDGVAVSAREAVLACTCWWPSAGWAWVWLGVVLLACLPPAWVCVAWPLAPLFSRAPPLPAHSPAVCAGGGWWRRRLLPARGSRGSAAWGREGGGGSTAMPPRVGGDVAKLRVAYEYTEAEDKSIRLGLFLIISGVVSLFIFGFLLAESRACRICKPRRPIARMLSVQQIGEVSECTFTFGADLQGQLRGTPCVQVYVKQVLSPSLGRWCTGKSTRFLDEPEGAPIFL

SEQ ID NO: 1013373 - protein, 237 aa, Homo sapiens
AAWRCCARSAWVMLPHRGVRVRPWAASCLCDGNGRALLPGFTLTAAAAAITLGNVNRVHLTAGPCQWLSLREARDGCGCPHFHCAHDLELLECLKELVVQQETRSRQLVTPSGAGGRIPNSGRAGRVLPNIQAQVGPGTGHSTGLTPMSAKLAPPKKGDHQGVYGGVCSDATRNPRATTKIGAKANRLSTTNLDPYQTNIEQTSTHEPQNIKETPKLDKTFTRCKIHSIESWNIMEK

SEQ ID NO: 1013374 - protein, 95 aa, Homo sapiens
GRHPGCFTSQPDPPLTASANMSWACRCVQFLSAAVSAAADQRAAPAGGALRADADVQGRSCRRYILPRSRYGAFSCSKQVHHAKAVIPTGVDEPG

SEQ ID NO: 1013375 - protein, 204 aa, Homo sapiens
MIAGALCGWGGVAKVCERSSIDWYSPSVMSLDSRTMRQCGSARHASGFGIVPSNGLPEKGHWRTPWSVCTWSADQQKAAWWSDYAGQQSEVLQFNCSGWVPPRWVGWLKWELGLKCLVAGGTWGLWMSLVQQCDPRERNAFSEIDWYGERHPGVQHSIEGAPKGGIYGRPEGGSYGFGTREGSPKEPILNPSHCGAPSIRRKLP

SEQ ID NO: 1013376 - protein, 173 aa, Homo sapiens
MIDSDLCLLADFPRHDVPFYSCWRTGLLLLVLAVGSERILADRRQTCDLVGEKGKESEERVGYYVKSAEYHCLIISYESTVCARAPDTYIYIFRVCREAGNHTSGAWPGLQGSGTKSWEGGQMEGRLNEHSHLQRKLLDHAASIKGVMNMYSHCGNGAASCKVVMISCNRHNP

SEQ ID NO: 1013377 - protein, 204 aa, Homo sapiens
MAACLTVVPFTTASALLLPSVSHAMRTSGPRALRPMSLRSGVIAAPLLTYVVPAPCMRVPCLVTLWPDVLWPTDSRSTLPCHCFTQCSKLSWQHELTHTPGEACCSAAWIAEDSQRASATSIAAKIAAPWSYGEMPTAEKLYQHQPNSRDSETYDLINPDPKGLEKAPYTQLACTGKDVCHGRCLEIEGQSSEQPAEPFDKDQE

SEQ ID NO: 1013378 - protein, 78 aa, Homo sapiens
EHNSIIQRMVLGVMTCLNGRLDMLGLSESGRIAFTGFLCRILSASRKYVACDMVYTLYGNQGFYNGVSIRFMSPSTMR

SEQ ID NO: 1013379 - protein, 201 aa, Homo sapiens
AVVPERLEPRCQPVADKKGGGGGGGAVWTGSWAGGSSPCTLCSPGQARARIWRLRRREGVSMADDPADRHRWCRKLQRGAGEGRGVAAGGAAPRSRRGHGPERAEAWADAGPPPPGQSEARLAWWPAPSSCCTPAMEAPASECARLPAAAALLGGTPAVPRVQRVAPSWLLRLPERRRGQQRAAGSTILIISMANERIEAS

SEQ ID NO: 1013380 - protein, 244 aa, Homo sapiens
MKIGMPDTIRFSTQDDLMSYKTLMNHDGYTDIMYRQRIKMGNEMQSSNESQRREQDPNCSGTSMHEGVSPSAAVESREPEWMWTSRPFIGNPLFPCISVRSIEEMVNKSSTGALNGTDCLPGVDCRTVETISVKKRQRERKGKPLSFMVNDPREPDQVSMVEQQIPEFWPLFDRSLEPGDRRFNGTSCKRLSSTSDYISVCLDTTTQWKHVTTSCPTCDEPCEGRSTSTEWQVPKHDIQKWPNH

SEQ ID NO: 1013381 - protein, 141 aa, Homo sapiens
GVCDAAGVGLVGQGAEIACGRCLERRSASCPERGLPQSQGHIQPLWLTAAARSGVCGVSVLLCDPCRVCRPCRQGPLPVLGWLCKVPWGKWLRVASAGGPKHGPHFFAAEPGLARWWVERWFIKARMGPHKFLNPGAKSRL

SEQ ID NO: 1013382 - protein, 228 aa, Homo sapiens
GRYETWGSAQKNFVERTRDLGPGWDSGRQSVQGQREPAGDALYPMPNMGHHAPESVDPVDHLAELTPVYPLMFIKPTMDLASPEAALLPPTALSSFSSFLDGLHRRRLSTFLYQSARNSPAMLLSLLLGLLRILVLRHLPCLWLLQVRGLPGVRLLPRAPERPSGMRPCPPSGSDVLWQAPARRPSPSTPQLRSAARSLSLGWLLRPLLAQPDLRRPAGLDRASAQSL

SEQ ID NO: 1013383 - protein, 42 aa, Homo sapiens
MCGGRSWAAEAEVPGGRGAEWAGGLRRGCSPPAPAVLPPGWA

SEQ ID NO: 1013384 - protein, 167 aa, Homo sapiens
GEHAGAAAAGLGGGGSGLGPDAWVTSCARYRVVSNKLKKRFLRNAERGGSAGEQFGQLGRELRAQGVSALRWPCASWLVARCQAGALPLGPGSALCLTEAARLFLRQERDARQRPGLPLPPTVGGLLLGPAGQAPLGESRGERSDTLQKAMETKRTRARKRTKPNNI

SEQ ID NO: 1013385 - protein, 216 aa, Homo sapiens
REQSRQPCQLRRDAGGHDWLSWMCMFLRKDDLLCVLLWGGHAVSAWEKRQLRPWPGVVGATSHPGQDEALREDNCHLGSNNSRMPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLSSWDYRLCTTVPS

SEQ ID NO: 1013386 - protein, 114 aa, Homo sapiens
APQSRTDLLRKGGSQNTKGVPPGACLFLSEQIRPRLWSGIPAPVQDGGVHQGVSWVGCFSCVAAPVCHGFFSGLRLCPVPADPPRSRPPDTPRAAPDHCPSAFLLLLLRDRALR

SEQ ID NO: 1013387 - protein, 271 aa, Homo sapiens
ADEEEPCTEEDWERLLSALQGYAHFTDYGCDGDELTTGSEVCPPVYVMSWQGCLARVSVSTQDGLPGTANTCSAPCARDSVVDRVAPCPTALVPCGSYHLVIVLLFSTWEIWTKRLHVCDQCGPGVVAGLGPAACRRLIQGPSKAGSVVLLLLRKQAWGSPTAGPSVWRAECAGPVTQDQLWSLQPTLRTVPLLSMHSAPAASARVEARALQVSGAAVGAEDLALERQQHPLKVLCLQLVALHPDTLPRPRQNTPYPLNLQKPTTQVIATD

SEQ ID NO: 1013388 - protein, 100 aa, Homo sapiens
MLHAGAQHINTGGNYKGIVHRRGFHLVFGPTCIESQNSLVKLPVDAVPPHQLGSPQKIAVGCVTTVVLNYQLITPVAVSSPWLLDCNIDQEAPRNQELTI

SEQ ID NO: 1013389 - protein, 221 aa, Homo sapiens
LSAGSNSAPRSWTGTWGRRTGTRAAIAASPTQAPPPRSPPPPPDSLQALHRLRQASGAAPGSWVTGSAAAWLDCWPTPAPLSAIVPGPGLERVHWGRPCAPAPRKMPAQALQQMLDRSCWVCFATDEDDRTAEWVKPCRCTGSTTMGSPGLFYNGWVRLQKQRGTQYQPRVAMSVQCNADIPNRYSKHGSSGYVLDLADRLISTCLSHLLQPGIMSRIYLL

SEQ ID NO: 1013390 - protein, 259 aa, Homo sapiens
MEDDHALGVVRCEPVETARRCPLSGYRTLTVALFTPDLLSKDRMRRYSRYTVRAKKLAVEPKRVPRGQLQTPPVSHALKMVVVWETVSSIRFVRGQNRLSGNITWSRKHRPMTGSSNATSTVLRGSRSRSDISNVSVYQPPREVILRLQSHVWWLWASPFTIECRVPTVEPLESLSLFLFRGNETLDSETFGKAAPGSAGRAQGTFNSTAETERMGTGGFPAWHVLDLIVSLVRTSFKKHSDPKDVGRSMSCVGEPDGH

SEQ ID NO: 1013391 - protein, 55 aa, Homo sapiens
MCAVAWGGTPQDLLGFLLSPECFLLYSGCILPVPGGPWCGVAQGAAWGARGRVRQ

SEQ ID NO: 1013392 - protein, 193 aa, Homo sapiens
VLLTLIGLLLSGDPRVKPPVIMSDQCTCVLVSHPTVLCCHVAFPAVSACLSSAGGLGSVMCCWWRGGSCWNWGEGGVPVWWDYVAVRVGDVMPGLLCRDGCLCGRACCVCSLEPWPAPSPVALLSHPRYTRERHLLEVVQRPSRYICLVPSVFFLHTESELRVQDAHLISQAIALGRGHLGGNPDRISFQRLI

SEQ ID NO: 1013393 - protein, 65 aa, Homo sapiens
MHWAETNSGDFTRGDPKVGHRRGTRGDFRNGYLSDETFVTRYEPVLDCTGRTFRARLRVNMDRCL

SEQ ID NO: 1013394 - protein, 299 aa, Homo sapiens
GIIIRVPFDAKYRERNRQLWYDVGTAVINSKSVYRSHAVTQLSRLTLLVDTVGPRLSGSKNLEKAIQHYVPKPAARWAGESSTWSHVRIPHWEQGRRISCDAGAKNSNDSHPGLYGSSIGTSIQKALQKEVLVVTSLRGTAEKGLRSQEGKISRYINANLTINLTQRTDANSPQTHGRAAEDKLTKSMADYETLSYNSHPVDLPLLQYYRSVNDSRYIPRQYPGDCAIAPRGTSANQARGATREGNKMASKHGLNEANMGHILQWGSTHTHPAPTARRNTTTTANEPLPTRITRRYRSK

SEQ ID NO: 1013395 - protein, 52 aa, Homo sapiens
MTSRPQRVWDTRGSRAGRNPASGSATPPPAVAPPPWRRPVPAAPSRTQCNPR

SEQ ID NO: 1013396 - protein, 153 aa, Homo sapiens
MRPVRPPHVAVLACLLPSPAPVPWQWPESAAASCPVVLVAKGSLRSRSWGRARLLLREAAIRWQALKGEPGGRVHSVRRDAAFLTAAVGSAPLWDLLPTLDCGVQDQRDCWPCAPWFLVKEQEGAPRIAGSAAETLCRGSRDATEQACGRTAC

SEQ ID NO: 1013397 - protein, 237 aa, Homo sapiens
LRRQEIGARPCGARPIPIPVPAEQIPGPRYGLQQSLVTPPSVLRAGRGTCDIFREPGQPRNLTGGTVTLDDAWLETLYSHEDPEPDKTTYSHIVTQLNAMLLELALPKGPVPLTGERTGLACSFCDKWGVWTASPWNMPETWSRYAKELLAWTEEESQLLSWTFAKEAPLKDRLKLGKVVQFKQHEPTIASCEYIYTLYLEHDLSLGTLGHGDQWPSRREDYYQSHRRSNSVTENCR

SEQ ID NO: 1013398 - protein, 299 aa, Homo sapiens
GWHLRRWRARSGLRPVRPWTAPRPVSLRSPFRSRAPCFLRPAEEVLALWWPQMPKCESLPARGQRASPVHPGPSCAQMGRVGEIHTDRPGKELSPIVIQSSTIVVGRLRSTARQAGVRLFERVTCTRNEARSISVDQTDQSYKVKMSNHHVITWITTSSQSSPPSRLNPDPGTTPLPSTPPPEIASSPITLDTTHNHISCSRRLPTLQTAPFSPPRYPLIPATHGVTEQTYARTRQRNLASIHSRIVERQHGRGRWIYECRRLCSCQLVPDRELDRSTKVLVVAVGAMRILIISSIADS

SEQ ID NO: 1013399 - protein, 319 aa, Homo sapiens
AASLRAFCAPGIPGACLVFCAAPAQAGARRRCAPGRSQASGCSRPEAPSARSSVPELPDLQPWISLRQRWPGTECVCGCTALRGLGRGAGPGAQPRVCIPWYREDPVFLGKDGCCRALSGQFDAIYFHPMYPFTAARMSAGAGLQLGGRCAHLELCNTMGFATVEASREPVARGSVLPTGFLRCINKLWPFMQLDLCQARQQLGYNEWIPSVVELGAVATHCLQCGSQGIHFGRNGSPSVPFNFYIPFGNPVVNLMPVGRAYPMATKFPRLPTGTFKGSSHATEQSMGGEGATHVAHLPGINSYMYKSPLSPLVHAKRV

SEQ ID NO: 1013400 - protein, 356 aa, Homo sapiens
MESQRDLSLVPERLQMTLNKNWQLEVEMCGNKSWQNQEVEKENMPLFLSATFALVMRAGLWKMLLELLLEVVSDAAGGGWPLWLQGAAETNQLTQFLYTYACLRTLLGSGTMKVLLAGGCRAGPLCPDAVLPGGMHTPMKAYYAYQRTLWGNVMLAFVLPKGRTAGSLAFTPWARLKEQYNGNSPGLAQMNGRKGRPFRPPRLGSCRLTPNPGKSPKVFGTTAEAKPHVCNLMAADEVHIVDRKLGRQTCNRVRTSGIIGKEFPQKYSPLARLKPENGAPICHCKGHRATLAGIPQVDPKPLHGLSTWRQVNLAQLNLGPFHRGRKGPLPQTQHPGINKQVTRKKTNHEYTIKCSE

SEQ ID NO: 1013401 - protein, 105 aa, Homo sapiens
MALGEETGRMLEASEDTKAQSYVDECELHVDAGSWTSQWPMMWGCMPHSLEAEWSVLISPVWGAERDTCPYLAGLGLTHVAGPSRDHTQPQASDANMRGPVAERS

SEQ ID NO: 1013402 - protein, 184 aa, Homo sapiens
FSCAVSLQCCRQPWLPSRNGMVLKPHFHNGLAACCCGHVVQPAWPCKILQTVSALCKPMAAPASAPAPLLSGPILAHLCACPTGSGNHTEGAAAGLRASAMEEAQWWPVHSRRRLALDHLRIFLWIRTEAVNKVQLESPCRTNCCMLVTGKYPASKDSFPSIPHGNAHRGPPNAQGEEPEFHMA

SEQ ID NO: 1013403 - protein, 217 aa, Homo sapiens
MASELVFTWEPGVCGSVGLVVTAAQLSGYLCHAPPWPGPPTLHDLIRQLGDEVCVDDDLCTGRKPCPWLCNNECVKMHVAWKCASRTCPAAPLMLAPVCVGAHVCQKNMPWHLSVSCPECPCETQQLDGDRFGQGPLQSSSISPHCTEDSKCSSARHVAQSGMLNGHNIPLVSEPWEQVAPNFWPKVPQKWGHTNSEVALLALGVRFANPYRTHHRV

SEQ ID NO: 1013404 - protein, 128 aa, Homo sapiens
GPELLAPCWGACECLNDVLELGRIKMHIVMSFLWMSELQVLLGFAGRNKSGGSTELLAKALHLLKSSCAPSVQMKIKELYLDDAFPWKTLGPSDLSLLSLPPWHLSCRTTPGPLDSHSPNCCMALAPC

SEQ ID NO: 1013405 - protein, 295 aa, Homo sapiens
AAGLAVADWTWWVPGLGAGAAAMENLFCAARMQSLLSRSSDKAILQLKQQRDNAECSTRKRICPAAGAASCALALACLLAVTGREWNWAKLLLNEGMRYQEQLLDMDWRTRSAGLEAMVQSIDVTQDLNMKVMEGLAGFGNELSVNNGCNQCDCPIARGGRVDPVHRGLPGMALLAVPCRPIDELLAWKLHSRSDGNDAILEEPDAQSHSRKPKSEAARRGSLPEPPFLTDRSPEKRYPCQRAQGRRGSAGSLDGMDFAITWCQSTYAGDLHVGNAPCGLDGPNKRSFAVNEAGP

SEQ ID NO: 1013406 - protein, 88 aa, Homo sapiens
MLEMAQGDQTVGTSKRRLREEPGPNGLRCHHQSPLEACRGTTRWVRVRCRAEGVLREAEHVSPSGLRTISIEFMNAGGCLKGIRATSR

SEQ ID NO: 1013407 - protein, 192 aa, Homo sapiens
MCEDVSACVACGTQGLALAQCEHARPWMATSSAGLHSGCGRAGGSVRALCGDGSLELLAWCPCPHPAAWLAHGDVHPCDRGPMVLHWCEELLRGCIEAFGEWLWEWHTEPEPSPESEPWVPASQAHVQGTALTRTQTLLLQSAVSLNESLLRNAWAERCTPFRHDDGLPFSRPSPDRAVRMGGAVSRNSEHV

SEQ ID NO: 1013408 - protein, 85 aa, Homo sapiens
MGEHSDIKGVRRHRKQSPEDNTIEIQAHSERVHNTEIPLGPGLYTETTGKTITARGENNVTGTTTHKKANKHTQKRGKSKKTPQQ

SEQ ID NO: 1013409 - protein, 590 aa, Homo sapiens
MERASASPTDLATTDPRTRRGRRRGKQWLDRSPPLHAELLIKGSNPPRGTPTQPRGAADPARRPRPHNSSTVSASNPRETVPRNRQHSTILMIRAGEHRQSSRPLQSRGARALNTHTPLPPPPHQPRARITLNAQQPRRYPPPPARRGPETHRHPTPHHAPPAQDRPTRPPYDATDTQKRRRRTEEKTEPTNRARHHRPSTTQSHTAECMIGQTDRHCLATCRPTASKRDGRQALTPPPPPCPDAHMRTCDQSPSQEEGQRHRPAHDCHNRQAHTTTTPTVRGGSALPQTRRPAHTHTTAALIKAVAQDRRREGTVRERARRGLGRADARARRTTGGGGRARGAGALVVRRRASRAVVGARQGGGGRARSARRGGAGRLERRTAGGRVGSLLRPRIQCTTNCTLGATHSRLVAPPTRTCAARTRAPSARRRERGERIDEKRVALEESGRLINMREQAEEGRQLDAREWTLNITKLSEHEHHQQSVTEEDDSGRQAQVQHDVAQSLARATSTENRGPRAHTPQQPSLGPTESHATDRDSGRRAQQNACSANTNCARTPHITDDEHTRRPKHVKLHVQLERTHTSQTAPECM

SEQ ID NO: 1013410 - protein, 198 aa, Homo sapiens
LEAEMWFLRVCGRLSVNSAVSSRTGGWSAGLTCAMQSAAGSAGPPEGSGRFRLDACMACALPELCAPAGLVPLDCGWWLHVAAALAILPVAGLRLCFNGHHPRRASLCGSHDRRFSRHVNLRAGTAGGHLCRDIPETVPLSTVNRQCTYGATRQMASIDRVGVHVPGYDRGNPGNITFALDGEGERPEICLIPMGDNL

SEQ ID NO: 1013411 - protein, 242 aa, Homo sapiens
SGHPGLEERASYGRAVCTRSVGSKNLRDYEGLMASVRVPGSKFWKRSNSNAPGAASRHVYGAQHPHLMIHCYMALCSGPRAKMPTTPVKAKRVSTFQEFESNTSDAWDAGEDDDELPGHGWRESLNYRGGHGDVQTCELRNHKTSWKGAAHAAVRGQGIQEKPRHEGRASLHATQMCDLRLVERRSVRDHTYCSCRTVPGDAGPLKKVPDHYPNVEQRTRLGWNIFSPKHISEDQVLSRERG

SEQ ID NO: 1013412 - protein, 153 aa, Homo sapiens
DAEEWVQQLKFILQDMGSDVIPEDEDEKGDLYDDVDHPVPVSSPQRSQPIDDEIYEELPEEEEDTASVKMDEQGKGSRDSVQHPSGDKSTDYANFYQACGTALDLFLMSVSFKRGDVIYILSKEYNRYGWWVGEMQGAIGLVPKAYLMEMYDI

SEQ ID NO: 1013413 - protein, 253 aa, Homo sapiens
RLQESKDTRKQRCPEQHCGPLLLLLLLSWASRDEAAPDQDEIDCLPGLAKQPSFRQYSGYLKASDSKHFHYWFVESQNDPKNSPVVLWLNGGPGCSSLDGLLTEHGPFLIQPDGVTLEYNPYSWNLIANMLYIESPAGVGFSYSDDKMYVTNDTEVAENNYQALKDFYHLFPEYKDNKLFLTGESYAGIYIPTLAVLVMQDPSMNLQGLAVGNGLSSYEQNDNSLVYFAYYHGLLGNRLLDFTPEPTAVLRTV

SEQ ID NO: 1013414 - protein, 197 aa, Homo sapiens
CRCHRTPSWSGVAARLLFGAAGLLLLSPAPSPSFLPLLDTVRALRAGLLSVPAPVGLPAGRDPEDACGCVPLCAPVGEGEPCGGDRRVPGRGVYVPRRGSGECVERCRYRGRIGGKQPWAKQARQSPGRKAGVSGVAKSRNHGCAGEDGTATDRNHAEGGTAENADCRARPTRAPEKPTAGGKGPIKPGSRERGTHG

SEQ ID NO: 1013415 - protein, 154 aa, Homo sapiens
MGGVRRDACFSLASGTPSPRPRSGREAPPRVSRPARLSLPRSPCVPSAGSPVFSAPVRAPHIFSAPVRAPPVGDVSPSETIRALFIPAPSPAHTGVCKDCLFCLFVLVSTRAFQKTSLFNRLIFPYSERSLLSEKFLEETIGNDPVSSRDHLPA

SEQ ID NO: 1013416 - protein, 118 aa, Homo sapiens
APATLPADMRRLLPYMVLDRKELVSCCGEMLHIRYRLLRQALAECLGTLILVMFGMEGSVSPVLCSAENTHGWYNLTINLDLMAEHDTLRHPHRMDRSLEAHLKPCREPMHIDAFLAS

SEQ ID NO: 1013417 - protein, 294 aa, Homo sapiens
LTVACCELSAGVAAAGMAKSNGGEWACCAPCVPGESLSGNPGEPGPVAPDCLQPPMNSALSGLTRSANGFAERRIDKFGFIVVLQGAEGALEEVPLEGCLRQRESKWLDIAQTTGTNGWPRSTKRFVLRMPKGASRTSLQGPVALAGTLSCEAQVNVTAEPCEQFDEAGTCPLGDPKVAWTCLAGVTMHRQYHNSNEMYVSHGWGCQRAKHWTPNSSECLKALTRLDTGARTYCGIVGTEPKCTPELPGVVVASNWHTDPGLETRGPIWDDLDTTHLVEERTLTLYFTTKGKNA

SEQ ID NO: 1013418 - protein, 110 aa, Homo sapiens
MELRSPAGPDGVPVRRSRPLRFRLRSWRPCGGWCRAREGYLTAIARLCKSEFNVYSQEVINVLGEIEFMLENLPEWLLVNQLRRTGSTCLEEGYIQPQPLGVVLIIGAWN

SEQ ID NO: 1013419 - protein, 300 aa, Homo sapiens
LSPAEPASIGDKNMMTMITHMKEQRAMERRDLDDLQKEVAMTEHKMSVEEVIAVKYNYQTVCSGFDPQQMPMEILGPGYGPNCTHCHRLPPLELGQRFCLADSSGGFSILLWIGAIRCFLAYWYPWLGTEDEPSGDNLYLGIVAGWPVVIITGCFSYYQEAKSSKIMESFKNMVAPAKPWCSGNGENDAMVNAEEVGGRGTWWRSRVETECQLTLLESSQTTAASVDKSSLTGESERPDSLSRLHSTRTPWRLENITLSITNNLCGKARDRGRGGVHGATRNVMGLNGHPWHQDWRWARA

SEQ ID NO: 1013420 - protein, 85 aa, Homo sapiens
MSLLISCSLTGEPHAGLRSLRVSGIREAIPGRGRAVHGEDDASESALKPENIIVGLGKPGEGPRAEQVGAVEHSWVGRTVTVFRC

SEQ ID NO: 1013421 - protein, 105 aa, Homo sapiens
MVNRANWKAGVDPLVPAAKAWSLSLSGGGPVSDCCGSDPDAEELRDRFPYLSESYLITHRCLPGSISHSYTWMVEYVLISWNRLQLQAHTTPDGSESGCVRLVAI

SEQ ID NO: 1013422 - protein, 80 aa, Homo sapiens
MTLRGRPYRPWPTRTLLGNEQLGCKGENDGGNWGLQGCQYGARIQVGEVLKRKIRKRRATGHGSEHIVNLRGENGDKEFP

SEQ ID NO: 1013423 - protein, 329 aa, Homo sapiens
MFFARGRDIGTLYEGRYVDECDLRLRRPDSSTHWDWMEDVLEVLYFCHLNRLQGEGRLFWLESTCIRKWWADRKDLNVCEIGTRGSECGTVGGSNCSIFSKFRGHIQTSVGPSRHAAPPNLVEAQGKNGPRWVNLSVVPSTLEWATTSPVSGAMAQKKRRASLAMGTRITKSEKRLGAGMLSGPQNSCLHADNALNHSKMWRTTLARAGGELHPFSAEYLAGGLKNFPAAAQNFPARNVDAVAHFFYNVLYPFPPSHNTVRSVGRRDNPLLKQGVNVRASRGTKSARGQNAYVGAGCTVANKSFLGKPVTSSVPTFLRALCGVVPPPWL

SEQ ID NO: 1013424 - protein, 261 aa, Homo sapiens
MSVDLLVSRREREILSACETCLGGPSCGSRHMLLASPWGPVGPNPWAPESLPHCFSVNVDHSPVRELVAIFGSNLGNCNRTDVGLRGPVGALPVVANSWVPQMPKIKLSMGCSNFQANSHLARVPLTFRRRFGRHVSSPIWLGRRDRAKRSPTLRYHPLLSRALRTPQQTGGEEPPPPCGGERQRLTFITPLIAGGRGPSVATVGGVRNNRGSVPVTSVCAPQGKARSFGSPALCNSFVPPNNWGAGTTYETHPYPVGNCE

SEQ ID NO: 1013425 - protein, 304 aa, Homo sapiens
DGSVLKSGQVLQRDKMKLVAAGGDVCGFRAHGDHGRLKQKQWIKTSLSDSWHCLPHNGMSVCWLVLADDAKHQECQSMCGMVVTDLSKHPLNCSDHERFELVTALLQQQHTVEPLDENWKQPPVLAAAHEGALRFCDPYSTVTPVFHISFFATSRFHRQVIIHVSLRLPLENRTELGYWQRDHVARQYFRVYSLTHTSYVTKVTFMERHAGEQLRRRLSNLFPYPHIPKPPHSSDMAPRLNHVLPVLASCDPYHARDMVKVADRMTPITARRQCSTLTLWLHFPCGGPPALILCRTPALPYKMT

SEQ ID NO: 1013426 - protein, 246 aa, Homo sapiens
MPATCCLLSALGTVAGCRRCCSMDYVTVWGFPSKATIPGKTVIVTGANTGIWEADRLGTWPGDGGNIILACLRHGECVEAGMQNGHPRWETLKFTMSNCPATWTLGFPSRSIPETFCKQISFDPRQDATWHHFLIQHTLRFVHAVLTPHLDPPVLTGFRDCTFAPYNPTLWGSPINFYDQNLCWLEPKPGNEPLQPPRYQRGKSTPNPPRIPPCVPNWYAQRPTLQNMWNRTVWYTLAKTDSKRYL

SEQ ID NO: 1013427 - protein, 277 aa, Homo sapiens
MPWPGSRLGGVVIDHRTPASVLNRDGGPRPRKIGARIEGFGLREGSPGPEYTPGPLSWALGNTGVGPGIKRQGPRATREKERPQAGKYEGHPGHGHTLFGQIYTRQEPKFKGRKIRAPGSRSISPQEGHGSPAKKGCDAMSRNDMGERQHMRQKDRPRPYKKDIPREGGTQERSRPGDSTRRVVFVGPNKGVDPPKRWTVRDIFTDRSEPGDRLVGINKTVASQVLLTTAVNSGGSNQLVVKEHDTTIYSVRRRHHQIVGTEHHHPLSNTEYTVSAD

SEQ ID NO: 1013428 - protein, 73 aa, Homo sapiens
ESRQQNMLAEAEAETVDSWRQGDDVQRLLCAGASPWDSRVQEDPVPGPGAGIPVAKCVEERLKEMDVREMGLF

SEQ ID NO: 1013429 - protein, 124 aa, Homo sapiens
CAGSHWLKCPGDPRGGGNCWLSCLALCCRWCPAPRLPAPCPAPVSRLSCSLVFNVHAADCVVAHCPKGADLVELLLCPCDVCEASCEPVLPGELRSSVLHYNYHLARLRWVLAATSLGAWPAAA

SEQ ID NO: 1013430 - protein, 263 aa, Homo sapiens
NNPSEQELEMEPRSCSLLEQLGLAWGRPAAPGVQQQLELERDACCGWEIRKELKLKEGAENLRRATTDLGSSLGPVELLLRGSSRRLDLLLHAAAVSCTPDVVLPDPAGHPTMAPSPLVRVDATCSASQPGADSGGPGEAVGHLMLKVKQGGLENIDPGATCNGEHQGPEAACVTASADVAGTSKTKIGIIRMQLRAGACKAVPAGEPGKPRMTTKGSPDPGALWSLRIDSLRATNFRSGSTAVGRRVPTKATEPCTAAAKAP

SEQ ID NO: 1013431 - protein, 75 aa, Homo sapiens
LQPTSAIQRIMLALAMGRLQSRKVMCRQAPDNGSTGSVSIMCFVNAVRIVRETRIRNEFRPFPRLTMAQSKHGSV

SEQ ID NO: 1013432 - protein, 209 aa, Homo sapiens
REYCDAAWSRPCRGEWCMGDLRLGAVLSAGARPALSGACPSLQGHIQRAVADSSLLRAGESAVVCGSTHLRWCDQLQGPLPVLVRAARCLGRVVRVQGWGAPQKGPPFFAPVLDLPAVDKCLQDEAHGYYLCRKLKQRQSWECARDVYQKPVSSGALGAYGSVCACLLDTKQRGITVWHLETKASPRTHFQVHSFHAQKEPYAENLRVT

SEQ ID NO: 1013433 - protein, 141 aa, Homo sapiens
MLQKTKRRRYLEVRLGRRQRDTYIDASRHKKDKERQRNNKQETKKKSKHQEKNRIERRNKRRKEPKEQKTHKKPKAQKDKNHETTEDDNKKKGKEEKNKKIPKERTGTKTQRKETNKTEQRRPKQTDDKQPEAKHSGKSKT

SEQ ID NO: 1013434 - protein, 143 aa, Homo sapiens
GDIAPRPSWGREHAMRTPQLARYYHVAVLVRAPARFPPDQPWGLRLFNRASTFVCVRPGLRAFLASLWLGTRFALSSWSQGHFSAQVSLLLASVVWFILVHVTDRSDARLQYGLLILRCCMSLVLLQEVVPLCLLTSCLSKAA

SEQ ID NO: 1013435 - protein, 78 aa, Homo sapiens
RCSCRCARSSCDVSCAPVGPVRLLRERASDGPALSPFSIGASGASWPAASRSGKCKAELKILKRPSASRFLEKHQRSN

SEQ ID NO: 1013436 - protein, 265 aa, Homo sapiens
MLRHLCSFTPNSTTLSTVLTLSSHHALLTRPERRDTGLQRNPRARGTTAKQDSLNLFSQHHSDLINQLAEVDTAPNYLSSKPAKGAQPSPDTSVPPYSAPPTTGHLTKHAISPSPMHNLAHTNLLRSPHTHTTPNSHPAPKTLSPLLTPPFNPDPPQQAHHTPPAQNATPLHTRRTLRRHWHSISGQQRWPQNEDRRRATATPTTMRHHVAEVNDPDRMENPRHAPKHRQKALGRPPSTVQQTQHPPCAKDTSTTRATPPPPRTK

SEQ ID NO: 1013437 - protein, 289 aa, Homo sapiens
GVGAVGAKGDGARNSAVSAQLRTLPPTPSRKKTQPELSAAAPEGPTLHLCWGAVSHGSQELLQNRGKLGSLQASHGEAPEAPGPHPPGLTTLPWGPPPEARDAGGRETTLLAPQRGVGLAAEGQGPDAQVPGLGPWQPARVATTGTQRRSSTHPSAGSRPWQPCTSLFLKSPQGHGMAVAAGRGGGPVAGGRPEEVSKRPRGYANPVWTALSDYGAQLRHGGAGPEARVTVLEVAVPRTPPISGRRRLSPGATARAPVRIFPSNYVSQRVAARPPCEVAASWHCQLATV

SEQ ID NO: 1013438 - protein, 130 aa, Homo sapiens
LAPVLHDAMLPMPTPEADASSVCDHVKKSSAQAALDWPERAGVQAGWRRRSSCTPPCGKMIILQHDACSMLAREDEGCSMRSGPNCHAHPRAPEPPVPAATPGTTGTLQQHKQVGSKGSGAPGPGNRSSR

SEQ ID NO: 1013439 - protein, 238 aa, Homo sapiens
SPRSPRALPADSLVHTVHKGWSPEMRCAQGRCEPGRAALLNLSLKPQKRALRPVPTLPPGPACACLVLEGAAGHFGCALVLCAGGSGWEQQVLECRAVLAGPAGAPRGAMRAEQRESWLIGEAHNTAVENTRYGTCPCQLNHIVELSIASQVGNQRLMRAKCWNSHNPEGLRHVVAKGRNTQSIPEWRLTEPNATHGPLDTKVRGPEDKPLARTGTSRAGGIERDDRLQGTDDQMLGT

SEQ ID NO: 1013440 - protein, 97 aa, Homo sapiens
MTQFDPNGRHFADTRRDQGATNGGTHPILKPGAPQTLRQSETKTRGPPTRDIVRATPAPQHTTDTHMNTASCTPRQRLLQHTTATAVIHSPPNRPTT

SEQ ID NO: 1013441 - protein, 78 aa, Homo sapiens
LNTVGAPATPVTHCRQICKILNAHMDSLQWIDQNSALLQRKVEEVTKVCEGREQGAGAQLPGSPLTERQQPWGPQVPR

SEQ ID NO: 1013442 - protein, 166 aa, Homo sapiens
GELGVGNIAWASEAPAAAPASGCCARCAAWGPGCQGRTFSVLLARLMVTAQCPPQRCMQSPHCTTCPLWEPPVNITCSTSRVPCVWIYLRQTRGHMPKTSYYYEDGVVPTRTDGFLGPQSDFSVIPKTNLTITMHRLQAVRTHGTQQHDRPSPECQTVYEDSSATP

SEQ ID NO: 1013443 - protein, 92 aa, Homo sapiens
RLTCLACEEVLAPGFGEVPAEAPAHCAPLCPLPVLSGPDLVSALGLAVRREWLGMRVLTPRLWRGVLRAGTTVSLLCNLLLAHHNAHPSMSG

SEQ ID NO: 1013444 - protein, 127 aa, Homo sapiens
GGIRKKPFWEPERFCSAARRGRLEDLVHGLPWSCARALEVVVAWMRTAIARRSSVRTVSCFMRARLCADMLVAAQVFICLATRMMGTYGTEVLHLWGPTSRGMYSSESGLVHREAHENDCRGVRVGR

SEQ ID NO: 1013445 - protein, 307 aa, Homo sapiens
GEQLVYAATPASAAGIPPWMWLFGEACPTGAQRLLCVAWDSWTWPPDLAHDGRSLWLNIRGTEAAALSMFHVSTATASDDRWFPDAASWAWCLPLVPMGFPSLTLVAGWLLEAMAIGPCKGPPQLALLGLQLLQGRACACGADVLGPYLLKRETHRYPGLCKWILGPGCLTWEWAPVPKPYGALSLRVGRFHHMRHGPCALHFTLARMGQLECLTLALDWCKVPIRSTMGWRIGNMSGTNGWWKPLRTTPPRNNLDHSCELAHVSTPGRVCHLKKVITFETGVPNEPLRRYRKAFLLIPKRCVPLSM

SEQ ID NO: 1013446 - protein, 33 aa, Homo sapiens
MKGSPPNLQLSPGSRTEHRPAALKKTSKSKKKQ

SEQ ID NO: 1013447 - protein, 111 aa, Homo sapiens
MYAFGYGISGNPCRWAGALESDRVLSDTGGALLLGTVGGALKCRVIQTGWCGALGRAAGRAVCPGWAARLGLTPASGCRGEDEERSFLCGPRGAGERPEEGFRAGVFPGAA

SEQ ID NO: 1013448 - protein, 238 aa, Homo sapiens
GASAILSRMRFVVALVPPERRSGGSRAALGHRKRRIKKKLEYGASAGTRLHPPQLEPTAWRLYQVASGAARLQKTALASRVRSAQDPRRQAPTSRVRRLRPRMTAPNKLGVSGERTDPKRGSHQQVEVRRRSTTKRQQLLRSHPELTELQRDKHWRNRVRRRKPQKTGPTGRGAEGKDTKKTGLAKLRSGGADRQNDVPKKGRVRTGRPRKDGSSESGAEDQTPRKTSLTSRVRRSRV

SEQ ID NO: 1013449 - protein, 51 aa, Homo sapiens
NALMAKEGEVCPHKDTCIQLKSVRKGTKGKSVVHIRGTHRKRKRYWSAVQR

SEQ ID NO: 1013450 - protein, 194 aa, Homo sapiens
STPLPSHAGGFLDGTTPVQRLLPAQPSIPGLWPGYGFLFATGLFPELPVGSRKALAPACDNILPGCLRVVLLHCFLASMFLIRNLVGTLWRILCSGYVALFFFFFRQGLTLLPRPECSGRIMAHCSLDIKWTPCLPSSWDYRHQPTLSSCTMYYILLYGEKSGNFPSCVGPGRGGPPPLNGAKRVHNRGITNNR

SEQ ID NO: 1013451 - protein, 236 aa, Homo sapiens
ASLCLAWPAGVNMAGRSEGVLLVGGAGVMFRVPGSLCVLHRAAPWKMAALGGFPVCGSKLAVLPGALSAVVLGCCASFALCALCAVNSWWPPCANVARAPGVNGALYLLPLMPREAVPYPDDAGNVCQCSLNDTSGTFHVGPPLANGGGTPSVLTWTGPVREMDQSRKRPAPQQIQQGPAAGGPNIETTNAKAKQKMADKILPQRIRELVPGIPGLYGISVAFERKLDQTIMKDNG

SEQ ID NO: 1013452 - protein, 242 aa, Homo sapiens
MALSNQQKAVLDERRGCWAPSTPSTIQEYMHLVLYCFASSQLSTVLSLLYRARYLMLLVFWGRPPRDGAAGQQTSGWCLHGVMEYELSAALPGELRLGVMHASTYGPNGPQWWSSVHHLVCPSLREQTLSSGRPCSTRMEGYTILSRPHAGARTHDDLTSGTAPSYRHSSPDTMHRLWPMHAAHIERRVLPGNGIHAANIRRAFKGSPVTPGTGPVSTLGSESGTCHQTRALLLHFFSGKQH

SEQ ID NO: 1013453 - protein, 261 aa, Homo sapiens
RGVSAGSAEVSGGQQSVAPRARRTQGRMYTLLSGLYNVMFQKDEYCILILGRDNAGKTSFLGAVENPIEQELQGDESTPRSHHHRGPRDIGTVACGQRLGSVFWDLGGQEELQLYCWAQGTYAECHRRSLYSSLTSTDEAEAGMSSKAGALDRLGEPATAHDAAGPRSLDAWPYRAGLWRPCPLKSRDIKHGLQTTATSQDRHGEIAMSHGLRRPVTGKGVREGIEWMVNVCRCGNVHRPAAAQGTSRRRTRAVCPGRLDI

SEQ ID NO: 1013454 - protein, 137 aa, Homo sapiens
MQLAGCPPRILRPVSSIPLALSPGEPEQLKRVHLTPQPQCGPLCTSGPSFEDADTEETSETCLQMTVYHPGQLQCGHISVNKFNREKLPSSEVVKFGRNSNICHYTFQDKQVSRVQFTLQLLKNSTAQFSPFDNKKI

SEQ ID NO: 1013455 - protein, 123 aa, Homo sapiens
EQTRPGAACGITMGDAFHHSQIKRCYLYDFWSVTVLLAWPFGVVLLFWLYCDEGIKVGKAKLLYQVLVNLPTSISRDIAETDGDSEAQIHSLLENPPPGGIMCHFGQSLIHVIQVVIWILHHA

SEQ ID NO: 1013456 - protein, 228 aa, Homo sapiens
SSCGDHGKMMQLPMAPRLASAPGSVLAVLPPIKLHTTSGKMIIRSRLQQQLAREDEGAQAAPGAQLPCAPPVPRTTPYVPAATPGHHVPPSVMHAQSRLARQAAWLHTVSLEPAMYSLPCLPAALASLDCECHVCHVSTSSAVWRILPASRCHRCDVVDGRDSGSRTASGTAPVGFHYACHGTRWLGDAALAHPFPGTRTLPTHLSLHANPATCEHWTPSRRGSLPAC

SEQ ID NO: 1013457 - protein, 30 aa, Homo sapiens
MDPVPRPSTRRAVVTQRMYLLNDMRTGVNQ

SEQ ID NO: 1013458 - protein, 216 aa, Homo sapiens
ARLVRSRFFDRSSRPALTRSSRPALTRSSRPALHSEQPAGPALGAAGRPCTRSSRPALHSEQPAGPALGAAGRPCRTRALRGLATRGQRLWRVYWVPQQCQAHRRCARISRRASSCLPVVQGSGPCCSAYCLEPPHFPLVGLLVRSEPSIEERLIPCSTAPKSQSINPKGLRSCGRTAAELAGSSICNPDCGIPLEVKPTGAPEFWLRDLLEETYY

SEQ ID NO: 1013459 - protein, 209 aa, Homo sapiens
MAGTVGVVWIDSSEAELLGLLGAGLSLGTSVIKYCAPGSHLVCSWPSADLRVDDDLPGALQVEAISCSAFLAFLSEVVGGGQFILFWGAGICPGEDQTSSIFLPAPWSSVTIFLPRRSSGFLVLEGLVPRISTSLGGEARYEVGKLCVTGEGCQLHGVLVRVLDPSLCLLKPLLGQGHDLVCLKQDLGAAPVPCGMQQTRLAEDLAAGN

SEQ ID NO: 1013460 - protein, 276 aa, Homo sapiens
MSAACMTLSAVADDDAAVTQLGLCGLPPGPVLLLALEEVVLNGLSGVRTFALCVMERAMIVCQVHSCAWCDALALPGLKNGGGLLELGDLGLVAGERAKHVDAQDDPAQAGWVKPNPSDGNQLTSCAQLVVETPETERARCKEASAVQCPKEEPCMTPATRKGAQGARGQRTGSGLTTRKGAVGGLEQTENIDASAEVTDQVGQPGNKAEKGFRDTAWTSYNQWNQKGDPKGTISGRTEQFGRQRREVQKQRAQARSEAQLEPNTYTALEQIKKYT

SEQ ID NO: 1013461 - protein, 144 aa, Homo sapiens
AVLVRSLMIGSPVGVWSSLWAPRSQTAAPGAGRRWCLAASWPATRRTSEPSATAGCRRAAGPAGPGARSCPPGRGGADQNNVQHQPPGEPEGVHQQSASPGGLHDQRKRPWPELSVTLGYFFRIKEIKSPEMAEDWNTFLLRFT

SEQ ID NO: 1013462 - protein, 252 aa, Homo sapiens
YWSDSRCIGGGAALYPIAGLRGPQVDEDLLGVPDGPEAPWTSWLARTPTTTQEEEERRYYLRKRLGVLKNCAWLCQRRGQCSPTASTVGLLQMQADPAATTRTLPAEVERIGQHWGLAPNNPTSKNCLMAHQRDSHRRPALHTCAHQVFLERSGLMFLAVGIYALLCHATKYWERYYTACCPRLVGPWALAIVPLLGFHWATTSPGWRQKYHEYSHYKEQDGRGMNQRPPTGLPALRYLRGLPRPSSTASSI

SEQ ID NO: 1013463 - protein, 180 aa, Homo sapiens
LVPVRKFLDRQCSPKPRSPPSTAWPCVPAPPRLRCWRSCASLLAAPPVAPAEAPHLVHVDAARLLWPLLGASWRSTGFLPPGVTQHARLDQYVLRLGTSELKPLPNVGRLSLTCSIKQGGPLDGGLSYQLHPTWDGYLDPSQGATSSSQVELWGILATFPQGHGPCETTTFAPLNNNTHL

SEQ ID NO: 1013464 - protein, 297 aa, Homo sapiens
MLWSSLGSSRIAVDDVFLGHRACLSRSGAQCVLCCAPVFAGREEGLGRPVPVPIVNPNVCCRLILSALADEDAAVTACWPGGAPALDLLPGEGSERLRASTCTGEKGKLGQYIRLVEPGSPAEKGGACWRGDRLVEVKGENVEKETHADRVVSRIRAETQRRATCWWSSPETGRAADRSSASRSEEELLRAPGKRRGRAEADRAGRRGCTRGLATGTIEPRQKADEEATSAAERGFGSRDLDQWTEWDRKMAYGPTTLHKRTRPKPRASTIGAERPQKPREEGFRAPGPRSSIEDGE

SEQ ID NO: 1013465 - protein, 366 aa, Homo sapiens
RRAPKNKMRPLQCLLHSLWHHRTPRSGVDGSASDEESGGTLPPPDYSSLHHCRTQPSSCTPSLDPLPGTRGPGPWCGLSALVHHLTKAHPRPTTEPQAPQPASTFLGEVDQMGMTRSCIECKTEWHKTDRDEDGLMTTLLRPDNATRRILHRAHQRSRHDTHKREKEHIGPNKTRRAHIQDITTTHNTAIHDAKNQIPRDKNQWRRGERAHRTAKTRRAQDRRRQAQRDIESTKGTEAHRTDQRQRQSHTSRTKTEAHDNKTETASHVGKQEKTAKETQTLGELHTKEHNHTEKDTHQGNNTPGEAKQSEKRHEHRRQHTRNSHKQTHSTTRKHRQVRQKTHKAQTPTNTTSTPASQEGTRPTEPQ

SEQ ID NO: 1013466 - protein, 55 aa, Homo sapiens
MWHICGCLMFLVELYGTQPPFDSSLRAGGGQGLYLVLGAIIGDWVDKNARLKSGP

SEQ ID NO: 1013467 - protein, 201 aa, Homo sapiens
MVPRELAHARARTCRGLFEARGDWCGAEAGAARSGGEEPEPVDCCLPAKGEEHVCNSSQESEDGHQIMPLSATNRFLLHCTIMSLMVYIFISRKLLNANTQRNHHLLQRNRKQDNLTSMLTCLMKRLTCLQIALEEINRHKLSIKDLFSEYLYSKIVRETSVRITSSKFSNRYMDSQEQFLTAINKGHRLYHLAMIVIACA

SEQ ID NO: 1013468 - protein, 293 aa, Homo sapiens
GCYWSGILRIGSPSHGACTIERVALPWSLAGWDLVPNPGWTQVPVCPVCRCRGPGGAGALLGPSLGRCHGVAGPRGFLPSLLAQSPFGRAELIVRLNDDDGPDPSRPVTYRDNRMESPRRLLCCLPTPLKQELPGSTETPAHLSFPQLTGPPGRYLTTDLAPCIWNRLARYLVSEGSGLGAIEVMGTQDPGNMGTGVPASEQISCAKEDPQEFIALKRLAAPRMCRLQTCKSPEDSRPQEETDCCNPEDSGQLIGNLLGVKLLGYQVPPFDLAHYVWLMSLKEKRKPFNATTF

SEQ ID NO: 1013469 - protein, 369 aa, Homo sapiens
AGLPSDVSGIGAAVAELRFAQMTPAGGCVLAVSPDESRAVPGRAGSCPLCPVVRPRRVDPARNDSLLATLDPAVPPYVKLWLTVVYTVFYALLFVFIYVQLWLCCVTATSGQLPERLLFLLPLLGLPCGTVLFSFYFQRLRGRHFASALLVFWLLYCFPFCACRFFTLKAEMNYVLTRRVDLSNGEVQSISSSTYVQLPVRPFYPGTSPLHQALVIALLGASLPLCCHAWLTSDVGQIFGRNRTGYIGHPLFANFGPLTVPGGPFGRPVVSAGLLLSPDPVSTSRTTPLQNVSLWLTALIPLAELPQLGLLPRDVSRAHFAICTSPSVYCPYRTPFGACLTTVSIASLIVRHHETSPSLGTDARHTLLP

SEQ ID NO: 1013470 - protein, 48 aa, Homo sapiens
MDHVVHGQCATSCSLTYRIDSATFSHYKLAICSSQMTHEMNKQHTTIN

SEQ ID NO: 1013471 - protein, 52 aa, Homo sapiens
MSNRNAEDWGPNVLGRTSEGSCDKDLTHRALTEEKPITTTRDSEGRTQFTSE

SEQ ID NO: 1013472 - protein, 205 aa, Homo sapiens
MPCETSAELRKCMVGSWRYERAAWRGAGDDPGNGNDCRSGSPYLLASSGTVKTAIAMGMAQALGPDYAITAISLADEIFSLEMSNDRGRCLQAFRRSIGVRIKEDEEIIEGEVVEIQIDRAARGTGSNGGLILTLIEHRDGDQSTIWAPMMIESLTKVLGPGRGRDHHLTRLTVQDLQAGPFLHTAPADYDCQWDSQDQVRCKLA

SEQ ID NO: 1013473 - protein, 218 aa, Homo sapiens
WYWPEFDGVMTAADSGAGQETKETPPPKHGPTVTEACDRPQTQPTATSPLTSYRWHTWRRWGEGWLVGFQLGCRFAGWGMGPGATHVSPWFSTQPCPSLDIPSGPICASQGVTDQIAFDSPRPSGGGIMNPPPEPDPEPEQEAQSWSRMPELGAPYPTDSIRPPIPNVALSWDHSEGYHAVLDARTLGSIAIGRNEDREVLEEAPEVGKVIRSDEAHP

SEQ ID NO: 1013474 - protein, 48 aa, Homo sapiens
GWYWSRSPLDREPLAEAILAEVCTALSTRRPGGRRIAALRCRPSMTYS

SEQ ID NO: 1013475 - protein, 254 aa, Homo sapiens
GIWRRRSVDMCWWCRSYSPGCGGVAIRGLPEVLSPGCGDCTFPGVEAAGRRTGRHVHVQAGVTVDVTIMMMVGRSCVHAGHVLRIVLERACAWMCARVQGVRMPMFINEAAACHPAWRGVSREEICRGSVNILREILAPPYIITLHDIFENKLDVVLILELVLAGMLFDFLVGEVMSADWMDDGHPVSSSMILGRLFTTLHLYSRHRITLDLNAGSTIMLAGPRTVPKPTELKLTRPSGTRAPKDRGCVNRGFI

SEQ ID NO: 1013476 - protein, 322 aa, Homo sapiens
MPAAPGRGPRWPGPVEAPPSPLSWLLSPGVLGPFEPARVGACSPVRRGRRSGVTAVRVPGPCGGRRAGRAGQSPWATVEPVVVGARVSVCVLPLRDSSSFFLSFVLPLVRPCGRSSCDVRPPEFVRDRYARDVSLGAAMRGRVQIRRVLGGSSYLSGPPLSRFGRPTHIVFLLADIPIFSFKRERPIEVARGTLGLALRGPTCALACNGTLRSEKPEVCYAPLSEYPASTLRNLFAPGMLQSFLSRVEIKRRVLYKRATTIVRHALGSYSFVIPLNIYARGLQLSSNGGIVVRRVRFSPRKCSLTRYSQLVIFGIRSALSPP

SEQ ID NO: 1013477 - protein, 292 aa, Homo sapiens
KQAGTSGGKERCFVSSSRALCKSFVSGNRKVLLAKLSATGVVQALFQHTRPSLKPQNSARFLCFRAPGYSVTQSSPRTSCTTAVQVSATNEPDAPARLLIGVCIASPAGVHDTVTTPRDHHETNVTRKKEGRRPDSRDIPGATQNDLVHKTQAQKPYTPSHTREHTREGHKPTPIEHGTIEDSMGPLKVPIPMEKQESNTRRQRGAQCNTTNTAEKRGKTRATHTLETTPYPHGKQDDDKRPQRRMKTQTTNHHQYKGPAHTAHRGNPRKTQYPRSQTVAQHREAHTRTTSQ

SEQ ID NO: 1013478 - protein, 292 aa, Homo sapiens
MSGWYWSWSYGYSLAFMDMYLLNGYYFEPCWARNEIFNVKAIYLCASSCRPTPDPSTGASAPVPADPQHPPQKWLVSISEAPVPCLHLSLSDAHALMDGVMCTGVSSTPPVTHCCPRVMPDTGAWQFPPQVKLQCCSHVGAQSPLLGDPVMPGLQQGTGSPDIGPTGTAEWELYMIPNRGQRDLTVPPPVWLAENFTLQEGSEWLCQAPMYLRVATHRLDPETCHGPWKVNTTKDVRRVNADGGMTASLTSCRNQQPPKNARPIDALLGPTTPGPPVSLLTLAPGGSCPPAS

SEQ ID NO: 1013479 - protein, 206 aa, Homo sapiens
MAGGSADLDRQIERAAVADELIDWRAKSRPCALSAREILVEESNVQRCGLAQSQCAANIHGQFYDLKELVQKIGGDVPETNYLFMGDFVDRGFYSVETVPPCCWHLRFAILIASHMIRGNHESRQNHAGLLASYDECLRKYGLGDCVAATCTEIFDYHQACQGISRWQESSCVHGGPSTRLQSRTLVSEYGRIEAEGKQVPQMMRP

SEQ ID NO: 1013480 - protein, 87 aa, Homo sapiens
AVRSGILGYGTSAQWQRGRRPVMCPWCVQILLWLSTAQVWGLTRLMLDRTGGRCWDCGWLPVGVYRLRLVGMELCWHGVGRTGEQMA

SEQ ID NO: 1013481 - protein, 190 aa, Homo sapiens
MHGRVQRFVVGDLYALLIHSRRAACTMIINSAFGMWLTEEDEGELCAAVLSRLLAEDFGQALEQLMIVHSQAVDPPRYPQCTDMMWVDCQEVKKEIPGYHSVSPLEHPEATEPGTETLMPSDAMGSLCNGKSLLSNAVATDCILTFLNVKGPELINMYVVQIEDNVREVYCQARLQLHALSNFDELDSLA

SEQ ID NO: 1013482 - protein, 95 aa, Homo sapiens
DKPERFDSQPCVLGWESFASGKHYWEVEVENVMVWTVGAADTVSERKGEVLLIPQNGFWSPGDVWKPIRGPCPTHRGFSLLKESLCPGRAVFLGL

SEQ ID NO: 1013483 - protein, 109 aa, Homo sapiens
MPDERRIPLTRSCSFADSTIGRIHFELPQSWPFPVHATMSCGKGRRPYLEKNTLGAKYPFPLQFTHAHGIFRLKVHRIADTYPPTGPGGKASRLARTYRYVGVPAYLSR

SEQ ID NO: 1013484 - protein, 374 aa, Homo sapiens
MVGILGISEKLPWTARRRRAFLLVIIREQPVSCEAEDARTPDLHPSITVSQVSRGQKAALVLLSACLVTLWGLESHQSTLSRYLVLHLASLQLGLLLNGVCSLAEEHAPHPLQCTGAATWRTVLGLPGHDPIRPLGPCCMHVPSSFYILTIPKCGQAPPLHVWECIASSLGPRARQLNNTSLGRSDGDLATKHEIRLADVVKKGEFIHAWAHMDAGAAWGPVYKHSGNNSVPSLDSLAPEAIQDATANFQTHISPISTTHFSTHNCACPYTTRDCQAMNCPKRRTEWTTLAIPVDFTPQVLSDTDGRAADWPPIKQSRRMDDLTVRLVRAPHEPTLSGPCTCGKFINIVAPKRKETQLLEPGVTVWTLTKGHIT

SEQ ID NO: 1013485 - protein, 303 aa, Homo sapiens
SSLRGHRRASSGDRLKDSGSVQRLSTYDRCARCLVPCLPVLVPMPVRHVVCRGPGLASFQLQLSQAGGAHIMLMLLLRRCTPPRRHQSRHAKFALTRPDPCALAQGPSPRLRPSHARADEHRPNDLTWYAEAPTKRLRRTCRGWQSVPDAEQAYAPGRCRRRSPRLVETLLRPAVLNGLNQVVCVDVDASSGRDVLVHAKAGSVRYRGATCAKGSRDEREVSEPGENIRIVPGSCHERILVTHAEHMMQNDDQWLRRHKRLAEKVLTPGSLGSDSREHGWKPMPVLQDGAQNLGREVLSLRTP

SEQ ID NO: 1013486 - protein, 244 aa, Homo sapiens
MADRGCPLEAAPVACLMVRESLLSCSLELSEGDITQKGYQTEKGKAACTLYTALFKGIDPSLQADEYEFLGPHKPLALQPNAAEVSGPPAPRDERFRSDCPHLKPVRSSLCAKYKGEEDAMPFQGDGSCPCALRLWKPTPLQNTSSASEDEGSLRRTRATHLHVRYQSQFQRRALGRPGHSEGRVAHFSSLLDIYSLNITPGERKNQTACSQIDEANHRSQPTPLDSGATEKAHQNDLRYRHTE

SEQ ID NO: 1013487 - protein, 164 aa, Homo sapiens
YRDGWVHDQVPFDGMWIDMNEPANFIRALRTACPNNELENPPYVAWGGYGGTLQAATICASSHQFLSTHYKLHNPLRPDLNAIASHRALVNVLVGDTPIFVISRSTFAGHGLIRLATGLGDVWSSWEQLASSVPEILQFNLLGVPLVVGRRLACYLECNTLRVS

SEQ ID NO: 1013488 - protein, 84 aa, Homo sapiens
MSLPNLGVGLTYGKDLSALINGSLRDTKEPQRQRVRGKAEQLRGCKIRHNAPMAWPPTAFVPPPVRTPQDFGHLAPQLRASGSL

SEQ ID NO: 1013489 - protein, 292 aa, Homo sapiens
YGIGLLTCSCPCCDCDLDPDSLWLSPVRPSALAWCVRDGRIELAGWWKEEPLSRSCATGALKVSVWSTGAAERRVAWEDKDEFSDVIYWFRQIIAVVLGVIMGSYAIYEGSLGIAGKRLEVSYISHGIISFEIDGFSFLFPDKAIRCNWTLAAVRSSIDSTGTKREYPNTTRVPYTGDLSWHNVRLQDSYHWTLPWTTTATDTGQSLDSRPPPPGPETAHTTMTDAPDSPCHAPRQQTHQTDTRNAASPRPYPATRHALTSGPPHRRSPANPTLKEERVSTDRGGQTGPEDT

SEQ ID NO: 1013490 - protein, 118 aa, Homo sapiens
SGIAAVGGPHLPSGAAQWFLREGLLLHLPCAASTFSLLFTAVVERFATMVRPCGLRAGATKTSRVYGFIGLCWLLFRACMEDRMTFDWLLELPCAAFDLKIQTICPSNPSAYILLLPG

SEQ ID NO: 1013491 - protein, 419 aa, Homo sapiens
GYGIAEGVRAGSQGGVNLLDHEPVGFIAGRPAGLCSGAGASRLAGILSAHKIIASSPEMNLPTVSCAQEDGCEPDTQSNKETVKHSDVLFLASEATYHPRSSLDEIGADCAKAKTHRRISVMPAGVDQSALDGEKNACWTLPDQDPKCLIRLQCTNKHLMVDARKAANKSLPAQGATPKCHLRKATGTGAQPHLGHKASHRAQQAKRPNLSTRSARAQNSNEPVGNGRETRGTSSRTQPQGTPGNQEDRYPDEATGGRRQLSAQKRQGGSSQDIGTPTATGRPHAPNTDTSGGEHEGPRRDSEQHTGTKDKPHTKRQQRETERTTRRERRAKRGGHTGMSEDNSSQEEGGKTQSETPNAHDGSRRPSEDSRRAWNNRGNTGTQTRETDEGKAHRRRPANRTGTSRSERQEQSPTDSWTE

SEQ ID NO: 1013492 - protein, 44 aa, Homo sapiens
MGSVGDNLPNGACALENDISESDRNAVLHTHNTLLCVAYTITAI

SEQ ID NO: 1013493 - protein, 302 aa, Homo sapiens
MSPPRKSSRWRHYVRQKDQGGLKPVVEMDGDEMTLYFLAVHHARSIIHAYVDIQLACILDLSAPKPGPERDDAGSPLHSCYWPPRKYQCGLYDVCHPMTRLDSRRMLLGSSFNACRHDGGHSSRKLGRLYHAETIQWTAWTTDRSPAADHDLCRCITCITSLHVHVCSPYDLGSQAGPAKLAPIMGTVNIAAALGTKAYAHSHGPPREGFSSQRPIEPLFNSELDSFFTTQLRIISIVPVKTRCVLRGGLRATVQGTSPPDTIACPDAYAHATTTSGARSHAATIGATVIQEREPRPLLVAT

SEQ ID NO: 1013494 - protein, 102 aa, Homo sapiens
TSPMIDVKMMERVVEQMCITQIWRGNLLGRITREDRAMVLFSSPPDDPPDLFPHLPDSGMRKVFLFVHHLSNLLTKLEGGGIHLQSLYSGGVSHLVFSLGPG

SEQ ID NO: 1013495 - protein, 266 aa, Homo sapiens
RDPFTYSDARIQCGPGLESCCQLALLGFCSGASSLPARGPDRGFFPGLICAARLGAQKEHGWLLWVLQLRAGVTAVAAVMLLSWQRVAWDLLVPASMHRLSSSDHCRLNEWTYLVVLLISHPPSDFLFNEMPGPGAERDRGSMPDDRCLEASPHDYTMVGPHTTIGNIHHGDPHKYPSERTHVSTHQLQRGHQNPKTFQCPKAHNGLLGHMGTYNPPLSTSPWYPFPWRAPITGTFPLEDHRDPAFTQPGRHIHTQELHTDTKAYA

SEQ ID NO: 1013496 - protein, 184 aa, Homo sapiens
RLVRLEYGMSGPAMSREGAHPGSCSSGAGLSPAPAPLTVQPLTGDPILRGSALAPPEAGDLTDIWSPGWMLQACKMKGFPFCPPSHQKTWMPYDTGSIPTAKRTQYYARISAVMGEEPKRTQINMGTFTISSKPPDATTRSVRRSIYDRRETDLHRGRIQRMPLQPSRVDFVSHASIRPTTVQA

SEQ ID NO: 1013497 - protein, 483 aa, Homo sapiens
MPPLLSKHSIPARFPWLAARAFSTFAFSRWGPQSNTRATLGSLYHLGSAALTHLYGLRDFAPPGSHRTTPNFLTHYGTHTTTLRAIPESGPHSWRPGTPPIRSNVSGWQSHIGNVPPVLRSYSLVNQRKRGPQTPFPQPTAGGHTSLCAHPFLHTRFETELPGLGFYIPPIGIRPKRTVCAILRRFRRHQQNSISWIDKVEIVNTAFPAILAWHLPPKTGLYQTLVPLCDADLSLPRGLAHNAAAWARERKLSGPPVVPAHWPLYAHGHKFPRYRSFHTPTANSQRTLALRVKSQVVHFRPRLWSAPLALAARPPLLVVRVSKPPGSLAIAWCAAPGPIVCALRAWVQPLWAATPLCPCPSFALSPYAVVQTSDNALNAPESSGSYPALRDHSRLGLDHPFSPYSDFRYPPPDSVNSAPVQSEVAHFVTPGSPPVFFPPLTVARLVGVPTLWVPPFVSPAFLRTFVDAHVQCRRVPCAFASAP

SEQ ID NO: 1013498 - protein, 128 aa, Homo sapiens
LQVRSGLPGLTHAVGFYYGELNGQRGLVPSNFLEGPGPESGSLEFWDISSRESENEEEKSPVLDGASERHDPRITIQGPPVPPGWHCALSSGSSSRTKLGESQSIAEKKQGLLAKAKELLKRLGSRKD

SEQ ID NO: 1013499 - protein, 124 aa, Homo sapiens
RGGCSSGAARQSTLPCARDGWGAAAPLTCWMLNEEACLSLLPTCPKACCCPAGKESEAVDSSETPLSEALRRPVPPRDNVWLGRHGRCLTTVSVVNDGQAAASTFPSHDPVHRQLTTVLASEGT

SEQ ID NO: 1013500 - protein, 150 aa, Homo sapiens
SCRLGLRDGTAAKWGSACSTWLLGLQGPAQLILSLPSPPPCSVSLRWCGRLCAYVRRLLQCPVRPGVDWREGARQVSARWRVWPDDPTPADPRALIPSPDPWLRTRVLNPELCIRLEFATWPLLIPPVLPVGPWPALFAACCLVEQGFTF

SEQ ID NO: 1013501 - protein, 393 aa, Homo sapiens
RNTCTWPCYCFASSQLSTALSLLYLLPCYLMLPGVLGKTTPQHARLLLPTTPVLRAAPRVHWTSDLLPAPSLHDLLLCQSPPHLYHRAPTAPLLALAPPAHPPPLAPDAPPHHPHPPSTFPALVPPALPRTPPTALTPHSSPPTPLPCCHPPHLTKTPPPPPPPSSPPPSPPPTPPPPPPLPPPPPPPPPPLLPPPPPPPRRPPPSPAPPPPLSPRPPPPPCSPSPSLAPPASPPSPLPPPSSPPPPPPLPPPPPPHHPSLPTPLPPPPPPPPPPPPPPPPFPPAPPPPPPPPLPSPPPPPPPPPPPSPSLPPPPPPLSPPPSYPPHPHPPLSPTPPPSLPLPPSSPPPLPSLPPPCPPAPSPPPVPSSHPRPSRPLSPPPPPPPPPPSRPSP

SEQ ID NO: 1013502 - protein, 239 aa, Homo sapiens
LYGSELRDGGGTAVQPEAPQSPSTRCMRSLLLPLPLLSGAPVPRSCACAPGGPGRGPDLVHVDAARCAVAPAALLEEHRLLPPAATQPELTSTSSAGTMQLNLAYVGAVPHRRHQGRSGPTGCWSLSATRGSTGRGLSYKFTQLDGYLDLLTEEASSSQGMRLMGSARANSTDFEEKQQVYEWKDLVSNLDRTIHRWYGLRACYQVELSRRGMRPDPHDSRQTYSNNHAKGFLNLLTMP

SEQ ID NO: 1013503 - protein, 132 aa, Homo sapiens
MTPETRLRGMDFTSLVPTLTSGMALTVDVDREQQPMRAIRYHRGKGINQHAAIMGGLKGGRRAGQKHKGPLDTPGALEDPNSVGHSSGGTRADGHCVHCQRDHRAQDPAETPSPLRAAWWTRTQATVIQGDT

SEQ ID NO: 1013504 - protein, 302 aa, Homo sapiens
PGTAPDYRESPPGCPEPAAGPSDPPVIGDEDDDEELLRWSLRITEANLTGHEEKVSVENFDAAQGAGALVSLQARCSLVRNGGRCTTLGKLYCHEGAAQWRLLVHAAARDSNEHTAAPMRLGCWTARAPVSPSVVTAAATSFQTCQCCSLILDYCERRGDVHPPRSSCHVLQGWLRCACSGGEIVLALELPAQKLGIIYRDLKLENVLLDSEGHIVLTDFGLSKEFPDGGSKEPDLLLLVAPSRYHGPEIIRSKTGALARLWTWLDALAILPLRACWRRASPFTLEGERNTQAEVYSEDPEV

SEQ ID NO: 1013505 - protein, 408 aa, Homo sapiens
RLVPAPGVTGICAAVLGALPELGGRWQPMSKLREPMLELPRRSLAWRPPGPEDEAKSAVPAPVLLPYAASPGLSTTLTSTTLWQCPPGEETNWTQWQGTLCSALHPPGTLLSMHGAPAHEQHTMPCMQHYMEEAGGPGGHGNIEIHSVETAGPGEVMGLGGVQTAVPCQANVILRQPSGDNINGHVTDVGEGSEGPRKNGHMKGGTDRMHNKKGMVEDPRRKHLARHRKTTGTNKEGTTKKGKKKETEPKKQDEEHKYRPNTDARKHTQRDTKRETRKERQNTRGDTQTNHTKTRTRRNTRREKEAQHRNERENTTTHKNEGTEKRKKKKNRSKNRQKKRKSQTKRKQQKARIKRKDTETTRKRENDENRRETQEKQHTKQNKKTQQTPNKHERKKKEHKHQHSKHKR

SEQ ID NO: 1013506 - protein, 283 aa, Homo sapiens
QLYAPDYGIWLPGGRSRTVVDGWCGRGPRLCSAGPFLLCRPCGTSTTVEARELGPICCLPMLGKEEAAAKDLIGGYRTECDLHVAVACEPLFPCAFWEVIYGSHLQGNLSLLSPNHSLLPPHLLLNASHWRLPAPRAQRVTIVGLYLGLCVSEGSWGTALSCTSSSGTPNMKTDTNIYIVKPWPLCGTLVHADAALPGHGHSFLGLLGSLRNALCKTVHCHMTTTNMFTKNLTRYLANDVVGFEECKPFLAAPSRLRSKGSGRSEEKGPRLGKSVPFLGLALM

SEQ ID NO: 1013507 - protein, 207 aa, Homo sapiens
ELPGYPRPGGYHQLHQVVVLGRCCYPPPPACPHRADNVATYAGQFNQDYLSGMAATCLGHLEEPTCPTCTPGAPGAGYPPVPPGGFGQPPTAQQPVPPYGMYPPPGGKPPPGCPHIDIPRSPVPGQPCHTPRTAAPGPTWAATVSYPWSASSDTPWAAAGSANYPGYPGSGTVNPEVTPTKIWKARNITDAHGLTHGEMPRTGKGKE

SEQ ID NO: 1013508 - protein, 268 aa, Homo sapiens
MNKPYPKSRFCRGVPGEVVEDAPALVGSADSAVVCDSPRCITYPILLDAKIRIFDLGRNKGEKWMSFRFVATWCQMNMMQLSSEGKAGFFVRSPPSSSFACLPVNTATHIATALELGVDESMMPYKIQSTLVSPELEIVSGECFSIIFSHICCFAISAYLALEAVRILCPLSTLVNTRCGKEWLPYPGVGSHPFHVIRIKQDVVLLLGLTGSKHGMEVPFGKPQGTVARFHIGQVIMSIRTKLAEQGGMLIEGLTHGQVQVSWAQKGM

SEQ ID NO: 1013509 - protein, 275 aa, Homo sapiens
NWMRASLVSSGRNCYPSPHPSARRERAFFHLERHCGLCSLKSCFTIKKLYNKERKQKQKRKNQKKKKRARRARRPQRRHPRGAQNNQDTPGFCCEPKGRHQIEEETPTIITTTGKQSHQQFTQTMNQIQAKTQATTTMREHLRTKGTPKNQQESRRHKKKGTNTRPHTQEKISNNTPSYLGGANNTYCTREVRGQERGEYIRQYGGGYTPRTAPADQDLLTTLRQEAQQRERSSIERQHNTPESGTVTNEGQPTEPTSTKKTQAPRVRTSFAEDR

SEQ ID NO: 1013510 - protein, 195 aa, Homo sapiens
MKAGLEVFLLVSLLLLAWGYVALVAHPVMPHASCHLMPSPLRLCYFRSESLSCAFPEDVIGTMLAIQTSHNVPLCVAEALKNPILPGCHDPGCHDAVMAPMTLGCLDANELDASSYPQARSADGPTTSPHRLPRLGTIWRGFTPCRQHCEKRCACSLCRRDAEISSGSHLIMAPRGMAQRRLTLPEAARHSTMAH

SEQ ID NO: 1013511 - protein, 125 aa, Homo sapiens
MPAEKQMQTLNSSASPFNHSYLYLSFSVHYAYCFEKHGYPDEILHVARKLHTYESSQDIIISDRYWEHKMAYQSKMAFLSFWIELKPSLIPGKVDDPGLDNQDIEPAWSYKCTGDGNNANVGPTL

SEQ ID NO: 1013512 - protein, 120 aa, Homo sapiens
VDEVPDIELARARNLISPRMEKALSQLALRSAAPSSPGGPSQGPSNLAWGYTPNQANPGLGMAFVPVLLRGQICDDHRDRDDNTGRQTWVTGYCRVDVFEQLLVSAVDGMCLYTGNELCS

SEQ ID NO: 1013513 - protein, 63 aa, Homo sapiens
MYPGFRRCLGLVFGFVAPVPWTVAVSLRACPMPGRSSRRCLGPSGPIPSGPRPAVGLRSGLPV

SEQ ID NO: 1013514 - protein, 135 aa, Homo sapiens
FKTVHSHSNHRSNNRNGWSGAPGPCSVFTRIRLGDLLKGVSRSYWRDCKILVKDQLGSEQEVKRDRVSMQGQSTKKPARFTTYGGISLNNVTAWNMFVTLGACCDTLTHNSGNMTLGGHRFNVDQCDALGPTQRV

SEQ ID NO: 1013515 - protein, 214 aa, Homo sapiens
MHCPTHGPIDARRRLERQASSVCSQWHSELRRSMCHSSNLSVTSAVCSETVLWNATSIGWVGWSQDPSRWHLLCKNMMPSSEDERRSVMTSCAVQPLAGGNDGWLLSDKAPAIAGPASSRASFAGVTHDEPHGGRGLVIDRVLRFIGCDLLRFPQGAWDTPYFYISWGPERGPKTTKSLQQVHPAFTLINQKWYYGRHERGPGQGLVSCSVALV

SEQ ID NO: 1013516 - protein, 147 aa, Homo sapiens
MDVLHIDRTCKFSMASLGNSPEALAQMPEASTEDLHCLAVQECTCECLDPLTSKRGDPSPAAIPLHPWAWFLLPRVYSVVPGWLFLQRVKWAVPLISLGYCPKGRDCSLTNSGWSLFLVSIPVIGCSSLVPLIFLGDYRNPVPVLGP

SEQ ID NO: 1013517 - protein, 328 aa, Homo sapiens
PGGGLGSGAEAVKRAGSARRSDLASSRAASSPSACDERLRPSVARRRPPSSPRHRAHPPQRLRLSSVAGASTAACVNLAGILRCSAAREACERARPTMTCWCPVGTDLLLAARVADEWTGPSPFKSGSCAATVHAVPAYVSLRGAPLDVHERVVGRSQGLCVLREVQVRPINHRPGTLRFRVRQPDRPFCPSFHTKYGHDWAEAQKTAAIEGTFCDPSSRDTQYILQTDNQDQSYEKHNPLANYQFPGGPAFLLGTGSRDGPSQDQFYLARREFRVSYTRLRAEGTAHMEESYREQNKGAYLREMRIRDLWPSQRTFSARMKNDLQVT

SEQ ID NO: 1013518 - protein, 70 aa, Homo sapiens
MAIEQIRQDGRECTCTHPSQETCRNIGTLERVPGSNAGKNSEKGAYKTKIAQKPMYSQERGKNTKPRKKN

SEQ ID NO: 1013519 - protein, 102 aa, Homo sapiens
MRNLCTPPRHGAPALITQGFGDSGRLFHPTYPNYLNLFQPTAPSRLGVAEPEDRRNNPPKVSQEFSSQRGRLQTGNPCEDNSVGDGPFLREVPWFLTHWTGT

SEQ ID NO: 1013520 - protein, 103 aa, Homo sapiens
MGSAAAAPALRETSRKVREGGCWGDSPPTIPTAMGPSLHTPSVRLTIGGARRHLQIPVAPLARQPQRETETQAHSRDNTLGAARTWLGGRGPKTQTMKRIAQR

SEQ ID NO: 1013521 - protein, 208 aa, Homo sapiens
MAAEKQVLMAAAAVAAVAAAVAVVAAVAEVEADAEDDRPYGRFVGNQRIGDSVGFVHSSDYSGNPGQLGGKQHETVCHDGYWGANVEPAMTAARSYDRSYSQLSTSSVQIDVDLRTFPHARETKHVNSCTDAFVVPRFHVLRTLCPSLSCCHAWDVFDEYTPGERCAAHVLLLTPTGCVQASDPPVMAVGFSTCLVFGPTCFSSVQRV

SEQ ID NO: 1013522 - protein, 108 aa, Homo sapiens
MSNVIFFFSRKANGWRGSTTRFHSSNLCLALFLYLATRDQHAVMCAEGGIGKSETANPSDCPSLLLHRPPAFPFCLLSPCFSPLPLSLARCLDFDDHGYNNYEFWRCH

SEQ ID NO: 1013523 - protein, 207 aa, Homo sapiens
MALVALVAGARLGRRLMLGLGLVARALDGGHGCSRSRREAAEAEAEVPVVQYVGELRMPSCLIAVFVWGFSFSRGAWAVPSFVVPSSWALGPRAWLPQNGPALIQPVPYRLELEQTDFICCLRLMEFNTAVLIRLRMLRKSGWMGRQGKILRNMEYKQEPGKIKKMWLRVCVGRASTGLPLTLERTSGGERVMRVSMRAEETNNIGC

SEQ ID NO: 1013524 - protein, 170 aa, Homo sapiens
MHLQHLATLLYPMINGTCLALTCRTTPSRSLYFWLVLTALRAFGVRTANGFGRYGSLPASLHLAPALCGRASQLVLLFLLRAARLAQTSRALGRPIQRPVIPARSRFGVRQRSRLRRCILGHADPTPTHFLPPFLPVYARRLPGQAPPALGQGGRSLSAESIRLPSPRVS

SEQ ID NO: 1013525 - protein, 280 aa, Homo sapiens
MQMPISTEEFFGPLCWCPLAPNLSGFAEMLPLIRTPRLQDARLPGPARPPCSCPQPHSLRARGRANRVRVPGVRRNRCRVPRSPKSGPQAFITGEPGVIATFEGSFPTARFFPEALRETPSGGNIGDRSPEPQTSLKDAQVRLELVRVCPGAVLPHLWSPPCVALPRRLSLFTIRCAPSLTSVHVCACWAHTRVVLCGWAPWVVFPPESSVPCDDWLVVYASHEFDVVDSNIRKVVHTSVRCLFPANTSILAHVWVVTYVGCPPVPPGRWCAPAPTENIL

SEQ ID NO: 1013526 - protein, 207 aa, Homo sapiens
DGPSRLGDGGAISDRPSPGGPHPHPGVPVVTQTCTNTRLSDGTLERPRAGGKTIRLCRTCSGVKRGRAAARGRCCRGERVTHGRGGRRSAKRRENGSHAPISAIRENVTRAPSAHTSGDRYEKRECRLQDGRDTTRYDWDYEDKIHTPKGARITTREKTPGEHGPRHPQHEDQITQTMRRHRSNHCEDWIRPSTEAEQGNRHLPPRV

SEQ ID NO: 1013527 - protein, 474 aa, Homo sapiens
TEPRYLLRDMLLSSGCIMDLWWPPNMSVTCLCSSRDIFLSIVRPVSRGDSHRLIGDNVSATKKGLDVTTPVYHDDHSSPITTGQNHRIVRTITWLPRYDVLFTTSRCDLSTSIARETHRKPRCRVRLHPINKEFSESSASWSLRKYLTLDNAVGTCTTMASGKLPQCWVTSMCPHTCSFALQLYSHSSWRVLPCVATQQTHSISLSVGYQWPIPSNRCPQDFTRAYHSFRMVLMEKPCGVVPFPARKSGVPLAGPPGSAWVGFIQGMSPTLVLTLVLRWANPGGILENLLPTFVYAFHVVPLGMESYMSKCMKGRMGPLVPFATMGTRGSDSRECTSFPAKRGVKIPGFPPNSPKFFHLWIRQKTHFGGLVPLCSKGGHARLNPPILAASGSLSRMGGSLDDSWATPLGSFPNAYSLVCDVSWGSYATTHLRLVFGGASAQTWHSFLDVGTHWCSSGARTPLTTAPPLCTVAAL

SEQ ID NO: 1013528 - protein, 266 aa, Homo sapiens
RRGRVRIFGVIFHSQCWDAGMSWAPWDLGVGPRPWQCCGLPWALGTLPCEAVPGLGVPVPGLVERVPTASGPVARCLESVPGGMCGPQWAWGGTGLECPVACVACPPPTGALRSCLCLCRGSVCDGFSLRLEKICGPGFFSEGQYKGSGTDHVRWPSQWLLEAMNEAPPVNRRATHYWEVHADETRLRGTPNILRFIGSRVCNQGHACIALTEYMNRVWTIGTQLAQAIHLKPQCTMARVQELHHGHLRTFAPRALTSYLERSKEG

SEQ ID NO: 1013529 - protein, 261 aa, Homo sapiens
GVPGLRTRSGPGYRVGERLSVAAAMRRDVRILLLWRGPGGEDVADPVPCVGEEYPEEVPPRAEEITIPGGRTPRRRCLAHIVDYSEAEQTDEELRGGDPKGKRGVLWVYDVSERGQTLRRIRKEGGIEKWMKWGEHKTVDKRMADRYLDGEKKDEEHSWIRGEMQWEGAGGVRHKISEDAREQPGRDIAADDHEAIEEVVIEGQQEKHRRKGTRDHRGKAGKSNQNTTHKDEDKENMQNKPEKGHNTDEEGTHRRNQRQEK

SEQ ID NO: 1013530 - protein, 129 aa, Homo sapiens
MGCRTNQTDTQSKHEGRTDRSNTATHAGRRTPTTNTARTEHRGNTDGHTQQTGAKHKTGAAVTSKAKTAKSRRPETESRMETKKGKGTGTKTAEREQQGAPGGHPPKQATAPREDHTREKKAKTKTDQE

SEQ ID NO: 1013531 - protein, 281 aa, Homo sapiens
KDGGTEGRTPPAHADAQSSARPPSHTHWHRHKQGHTQTHAHSRAHPPASLPACSPAPGARSGRVDDLKLPSRPSFISPACFIAEKASCPGRWHPSPSRHRWGMNYEESQDVREENHAADDSEGGALDMCCSERLPGLPQPIVMEALDEAEGLQDSQREIAAHPPPYAEPQIQLRSHQLEALGSHSLTVKEQACACSLPHSVLRCLWGALVQADMATSGSTELPTNSISIFCLTLLKQLETPKHWLNSGDVDMYPGTDAGSYLVPCALVLGTTLVLTLLVGH

SEQ ID NO: 1013532 - protein, 188 aa, Homo sapiens
MQKKSGRERRRPPPDLHRPPGGHLESPDPEEAMATSAHSWPQGAVLPLPEPAVSMSITDVGGGPTWGSGCDPSLAWGQKVSEDGLGPILLLTSQTCAALIAENMPYPVTFIQEQGCDDCNGLVATWSTDGQAQEDRKLLVSGHTHWTPDSARHRKHTWNRDWRAKRQLTDTGDSYRQLGIDPTKDTPG

SEQ ID NO: 1013533 - protein, 251 aa, Homo sapiens
MALAGLAVRAVDPLPRSGLRVPAAPPALACVCPVARLRACGATALCVAAGLRSMACGVTRGSGSSRAVKINDRVKPKTFPLTLVAEQDEWDATALCEPGPVRRFSVTKIVEKSLCPFYVEKTFTVNVPRELIVTCPSTFSIDDVFRRDSIIGEDVAIHEVSDLQKYHKQVHLVQLQHVDADSVKCSGKVHLELRLSEVIIMTLGSYCHKARQRIVECQGLPIVNGQCDPYASCDCLQEPFRSEAKKTKVTM

SEQ ID NO: 1013534 - protein, 293 aa, Homo sapiens
MFLSFEALSTKHSAPSLPHTLHVLNLLTPPSTRSAIPHFDPIHPHISHQHWLQHHSRSSSPCSSRVNWGTSATTNFDWFNASHRNVCRDQAFATPTLLLPLKHGPRSLPNTCPRIIRHSRPDHSKQPTTRPAQITTRIAARLSGVLPHPRARTDQRKIPLPHPRTPTPPTQHTSRAPVQHNETPNPHTPIARATSDTKRPANQPPLRTRALHGEERNPKAHPPRETQRRPDRDSPGPTSQDPPEATPARNLHDENAPNPNPASHAGTRHTPREQRGRAPSHASQTPRARPPAR

SEQ ID NO: 1013535 - protein, 74 aa, Homo sapiens
SEKKIFIGLIPHDQVNFVNGILAVSLTTSQRGPASEPVSMAQMFLEHAARTRWSGVKSEDDLCIVHGFHLVTLV

SEQ ID NO: 1013536 - protein, 286 aa, Homo sapiens
GLRDAPSGLKAVVGEKILSRSYSEGQEGWGVEGAYHGSPKTCASCLPADKMSDILAEGITIVEDINKAAGTHSQSVRPFICWDPTEKSVQALIKDVPGDPDISPYKADHIFFTEHTAPSPVTDDARPDFSPGKRMVNDRRKGDSTPWTKPTPKKDPRDDLHASKRSPKKSIHNTTHHNRAPIPEGQKGTHATGSDNSGRDGTRPIDKKLANRPRCPPHTTFARARYPQGPKSGVHQATGDPHDTEPQAATARHTRPGPVDTRQRDSTLHRARSKPPEHANDRTQGA

SEQ ID NO: 1013537 - protein, 135 aa, Homo sapiens
EGVKPPGAIGVVTHDLSYWLHWSLISAPLPLESRPEIHVYLTTRVTVGVVAVLVTVRNAHDGVHSGFPELQAITPRGRMCTDRVEYHRWRYKWVRAWARLRPVLSARAAPSSPPHIGRRASSTWRTLYGVPPRTR

SEQ ID NO: 1013538 - protein, 243 aa, Homo sapiens
SEPYCGGGETEGVLASPHLPAPVRILEYAPCLGSWAVPSWESLTGLKTKELENQKLGSQGGGNVIPGLRDGSYVTSSTRPLEAPCSSCSCVSCGALSFSLWLLSCCLTVPPDAWLGAWTSPPGPLFLRYGVDVWMWPCGQLPCGLPYHMWRQRISTSPISGDYCGRLCGHSSNGLLTSGPWTHNSVAIYRGKLRSGIAALPDGPVMQRSRYSPFAPLLAAAVTCLYMLRLQGHTTWVTAPWKF

SEQ ID NO: 1013539 - protein, 331 aa, Homo sapiens
RKGGHKGRARQYTSPEEIDAQLQAEKQKARKKRSKKKVEMGLQVDPKKEKKSLDSDESEDEEDDYQQKRKGVEGLIDIENPNRVAQTTKKVTNWIWTGQRSFRGENETEIEKQKAKERYMKMHLAGKTEQAKADLARLAHHPEHSGTDGCPERHGTSDNGTRNNDDCHTRHGKRHCTSLSLTTYPATRGTRRCPGTAAALPRTSACVSPTLCPWRRCTRPSMARSPPMACGRPPLTSRHKKLDRSELTRAHHAHTARNRHTPTTTNNCHTPTPIPEHPPNTPHAATHTTRPPTLRDGQRTTPTHTEHHHPDNNSHHTTTTTPRAHGQHDPR

SEQ ID NO: 1013540 - protein, 95 aa, Homo sapiens
MCTPLGVLINAATILGLLFSRREKYPPRIIVLTERQILPKEDYSTTKSSFLVKTRSPVGAQMFSNQDDGRQTTGRGPSHTAGGELCGNLFLWWEP

SEQ ID NO: 1013541 - protein, 313 aa, Homo sapiens
SSCNARIRDKRALPLGRGKQSLCPSLSACLSLGMDLPAWKLHCPWSGLPAPGEHRQQHIGSEAVAGRQQSDAPVPLACRLAAGPGWCCWHHVTQCSPWVPHVYRIFFTELQWEFQASNSENSWFPSILTAVLPDGRAPVQHPVGRFGCRVTVMLGGVWQPGHCDSPSYPQPQQIYFTAGFHHMLRGMCFSSSQASAGAGLLTLSRGRVCPRRCLDGRLPGNSASGRVPPIASGINLGVKGTSLVLRRDLLTAGSAGHTNGLWHQFARTTTQLDPGPFEYTALVLADECGHPGQLDSRSGANTVLRVDLGVISP

SEQ ID NO: 1013542 - protein, 135 aa, Homo sapiens
MLSGACALEWHGLGVSPVPASKAQDGGLLCPRWSQEPDFPRTQLGEVSHLVERQIPRSKTGGNRARAKYPRFPSTLTWAGVWGCWGGEDCPSHPDRHLDCPQSEILRQGRKHLGPLQFPQSSSVPKPLPVCEFLL

SEQ ID NO: 1013543 - protein, 107 aa, Homo sapiens
MSLSRDVIPPSAVWVHLTTERAFSPTQPSAAYDSEEWHFPFLVVVSARVETLLFSVSLLVEVSCVWESPWVWREWQVHVRRLVVSTLQAARSFALFSQWASRVTTKM

SEQ ID NO: 1013544 - protein, 183 aa, Homo sapiens
KQACTASWSFLVIDCRALPVALSLMPLTGRVWLDGSVLLNCGPVLSRSCPAVVSPRLSSPLPCLAVACGNGCGVLDPCALTSPVPALPAFLLLLGAWPGWGPRDLLADSRSAVCLRGGFVDFAGAVPPLTLLEQCLLGVFALVRLALVPPGTVALAPSFSGGAGVIGELGPGQCFPGPFVGPP

SEQ ID NO: 1013545 - protein, 246 aa, Homo sapiens
PACPSHAERSRSPNALSPRGDRAEPSSLLTPRAYPRRPQPLSALLSAPRPASLALCPMKLAAMIKKMCPSDSELEYPGQELLRMVILGSSKVGKTAIVSRFLTGRVRRTPYTPYLVEDVPERVERSTSIRGEVYQLGHPRTTSVLTIPFPAMRGLSILTGDVFILVFSLDNRRLLRGECTRSQAADPRHQCLASYNKTKENVDVPLVIWVNKGDRDFYREVDQREIEQLVGDDPQRCALLRDLGQE

SEQ ID NO: 1013546 - protein, 391 aa, Homo sapiens
KWLPGCGRTTRRRSRVLQMPGAGTPVASAWPCIMAPTHGTLPHRLPAGGWPALACARINPPLLVLVLLWLVARCSSCSSQSGAYDSYLCTEPENVTNGTVGGTEEPGHEEVELDERLAQLPGPGRDAKIKAYTVGSITRYRCHTHLTPWDNRHGTKYRAPEEAQCKTGTEPCLRGNMLALIAYGASKTNGYYYDANNLIRPGSELAKGGDEKYRPIQLNKTNATNNVNERNQYGIPRINMPLERIRGSKRRNLQTKGHTNKTRENTKDTNNIECIEEDNRSNRDESHQRQTKGATRDMENPREQMRKKYTHRTRNETIEKHGSTTLEEKQPKETTGKKTEKGEKNRKEKNEEQKRKHDKDNKTENRKKQREKKQTNKQRRRKQREKKREQP

SEQ ID NO: 1013547 - protein, 243 aa, Homo sapiens
NLGMAVPRIAPSMTFRVCGWWGTVPRLGAGVGLRPLWSRRFWRRESIETTNPRNKELDWASINGVLRAAQRGLCSGPPTRTPRECVAPQDRSPHRSGRRSSALTGAGNMHEELRQRFHGRSVASSDILNELIKVVSPKYLGSRTSEKCDRTRSWSSSTAGQWDLPDEVENLQRPYQDAKRRQGIVKVRAQLPDDDKPFPFRPPRTKNVIFEDEEKSKMLARLLKEAPNAEEPPGSRIGSIKEM

SEQ ID NO: 1013548 - protein, 207 aa, Homo sapiens
MTYDTTKYNTMNHEHTHTPRKEQQGTKKEDTREKKRQPARAQTTRKRRQEGNKKTATQTGGKQGKNKKEKKKTKRTTKQKKTTKTKPQRKETNKKATPDNKKRHNQEENQRGKHRRKKKHKEKKERKEKTRKANKRVKKRERTTGEKKTKQKNEKNKTKRPHQREKPRTKQSTHATDNMIDTKQTENKEKTRHKSDEKTQKQREEDQ

SEQ ID NO: 1013549 - protein, 271 aa, Homo sapiens
MAKGDGGQEQAVSCPICGRSLQPLRKKTQPELSALPREGPTLHLAGWPEPVLPVTAPEPREARVPPMLADGDGCRSAPVAPPLPCAMTTLPWVPSSRSPRCGGPWRQHSWLPRDGVGLGADGPVALDAQVPGTSGLGSHAGGGDHWAPREGPPHIPVAGLPDMEPLKSLFLKSPLGVMGMAVAAWEWWGRWRMAGLRGSPSGSGLMPTTGVDNLFDYEPSGQDELGLGTGDRVRGAVPGTAAISGDEGWWAGSGWLATVGPLPVQTMCLGV

SEQ ID NO: 1013550 - protein, 116 aa, Homo sapiens
RDVDSERTTMVLSPADKTNCRGGWGMVVAHAGEYGAEALERMFLSFPITKTYFPQLRPEPRLLPRLRAYGPEWWPDRAVPYACGQHAGLTCPTRCPTLSDLLAHKLRGGPGQSSSS

SEQ ID NO: 1013551 - protein, 232 aa, Homo sapiens
MPYANQGTVRITELTDENVKFIIENTVPGRWPTSIRRVFIAEASHNSHVTGLQIDARFLSPFSERIHMLTVLVIEIPLYSVMSIVDNACSTRRGLRHVTEFLRPELPLVEVHASLCRLQLNDHDAELLSTVRRCTLILAGQVRLGIDIACVLFPVKPQINLMRPIERTCVTLTAWTFLQLGPMSDATGAIGMAGGTFPQAPIVPVNGAYLRPSVRHLSQRIVEWPRNVVKRR

SEQ ID NO: 1013552 - protein, 233 aa, Homo sapiens
MDSPSLRRGPWVLGAVRADHWNLVISNDESCQDRSRRSEEDSSRISLAFSSVRPFLPTLLPGIMRRAPSCPMPCLTFVTLVLCGPCLPGARAELLSGQQSACPGASSYALWVAMCCRAWRLPQPAWLCEEGCANCPVVAWARSEKGPSWMSPAAFGRVLVVLRCISCSLRYHWATISTLGARAGTARNLAPFPIRLLGGRPGAILVGAAGPIWRPTRFGILSFPLPNKRALDP

SEQ ID NO: 1013553 - protein, 284 aa, Homo sapiens
RVTGICPVCRYPPLSLPLRVLPPSDWSVLGGHVQARRGQLRARLCQSPTVARSGACALSVLMCWSATGLSARDPRGGGNCWRPSALCVAGPPPRLPAPSPCPPERRPSHSVQGSATAGGALTRAQDHWVRAAHGDTGLTGEPGAGRAEVIVTDITNYNTSIAPGVQRYKRHKGCRGHCDSTERTDEMDALVEIMRPLQTVTRKKSTQVIDIGCHPGTRQKPREHIPTCIPQWFPLAHHGEQGTSNVLEKEYLAIGKRRRHKATHQKIPLIVQGAQVNDLENWTT

SEQ ID NO: 1013554 - protein, 66 aa, Homo sapiens
KLLQLARCLPKQPPSFELERQALVVRHPRESPGLRVVNDRGKKHSIWAESAPFLDGDEYLMASLLC

SEQ ID NO: 1013555 - protein, 150 aa, Homo sapiens
MFDLLHICVWETELYTYVHGYHSWRASMNYGSTSSDTMLGAPLQNPGDPLHALPIASPPLCQTLSTTELTIFEIPNPFYAQTLWMRAEILGAIREHIGYTEVNANEWVHNLGDAPRPPRWFQRLRKGNRLRGREVLKRCGHRLETGLSTQ

SEQ ID NO: 1013556 - protein, 43 aa, Homo sapiens
MAWLVLVWDLDRAFPEQPCADEREEKYATLRPGPELESPLPPP

SEQ ID NO: 1013557 - protein, 106 aa, Homo sapiens
MKETIMNQEKLAKLQALSVAVVWAMELLAEMQRRWFIGTATADDYKLQFSLTERYVGKRYLCVLKTVQYCLPTKATVIHFDNPKVQASLAANTFTITGHAETMQLT

SEQ ID NO: 1013558 - protein, 90 aa, Homo sapiens
MDSSGAGVYVSALPSLLLRPWRPLRLQPLLLPAGPAEAACALCQLRAPGTGARRLRPPLLSGCAWCCFLVPDGVTGPSLAPDVRLSDLLG

SEQ ID NO: 1013559 - protein, 123 aa, Homo sapiens
KQNTQGFFWMDLKGKRDGEKYCFWENHPLSSYKGQCSRISSTPNSLIILLVEIWLLTWFLTEKKKPPTLKTPCDNPCVSKCENIKVSPFLSLGYNPQGTINYNFLVAREYPCYHLCWEHNSCS

SEQ ID NO: 1013560 - protein, 114 aa, Homo sapiens
MSARSSSAWSQAPSPSPFLPRTLNSVEPTAEARWGSILGPIISPMWHLGEPQAYSPGWTHPPYRAKHHITKGPMDQHHSPTTMGLAIHRSQDRSTKASQTALIVAKTERIRTDR

SEQ ID NO: 1013561 - protein, 236 aa, Homo sapiens
SGSGAVHQHQRPRAGSVSWVPRFWGVPSPGSCAFPFLRPSPSSRTPLGLECQPVLDSGAAPDTAADTILSVTQQCPTSLCTDGTFHHVTPVSWSLWLPRKPRAPIVAIMTTSTSFHVRQHQDQHIQTQTRMPGTVSKHCGFQLTAPLSQMMPSGVQHCEQRPGAQVPGTAGPRSASCAVMYWSRLLLLRLPLLQGSASSITGELNWLGGSSFLTHDYRERVLDDNSKSAWGRDDGK

SEQ ID NO: 1013562 - protein, 103 aa, Homo sapiens
MCLSIVYSTSVTHATIVSRHDMLASGSKSPCTSDYTKIEQLSPRAQAILPVQWTVLRTHVLLCTRGENVIRFREVAQRAYGRDCKINTIACEVSATDRHAKVE

SEQ ID NO: 1013563 - protein, 115 aa, Homo sapiens
MPNVTQELGHDPRTWCPNPSLSLNGPMQVFILSPRRLPSEGDQDLRLEINFYHGYHYPNDEVVQMYLPVIIHSIIAAREDECTSRYPIAASSVQEVLGEALLARKCVWKGERILP

SEQ ID NO: 1013564 - protein, 259 aa, Homo sapiens
RTEPPTRVRRSPPPRSSPAAPRRACFSPALPHWRPLPNLAALTGPDSRIFTTYYGRTCASTTSAGYQVISFGPNTKQRLRSTTQKLPIRSYPQHTKQHIEKYTYQPGQQRPKHRTTENNDTTKQRASPKHTHNRHTPATNNPTPTQTQPNTLRQQTAKDNSHNTTKTGSSYYSTTTQRKSPPHTTHDRHPTCHNTNDTHHTMHSQTTQGSQKYTQQPHRTRSTPRNAYPETKETHRTQTIIPSREKTHESTTRPTTTPD

SEQ ID NO: 1013565 - protein, 193 aa, Homo sapiens
NLLKEAASLLEAGEERPGGAKPGTQSQGSALQDPECFAHLLRFYDGICKWEEGSPTPVLHVGWATFLVQSLGRFEGQVRQKVRIVSREAEAAEALRSRGAEEALEKAGGGAHGWESKPEEPPPPKKPALDKGLGTGQGAVSGPPRKPPGTVAGTARGPEGGSTAQVPAPAASPPPEGPVLTFQSEKMKGIEGA

SEQ ID NO: 1013566 - protein, 265 aa, Homo sapiens
SVAGAAVPRSARRPPSADFKGLPLDPSPVLNPDAGTMHGRREGEDVRKEQAEAKRLEREQKLKLYHVQAPQAVFHESARRGELDDVRAGTDKPDSWEPTLIVATLWKLPTRGAPSSWRLRSLREELAALVKAELGFLEELLRVNPKSYGTWNRPMLAAGRLPEPNWTRRAGASCARFLEVDERNFARAGTIWRWSGHSMAMPVPRCKKEKLSLALSSLITRNFSELTLAVHYRSLSTWPLACTPAGSWNTGCASLKDVLLTGAGA

SEQ ID NO: 1013567 - protein, 104 aa, Homo sapiens
KEKEYSEDKPYQSESCQNQSIVRRCEQKRRKAGRTRESNRKRQRKKKKHKKQQSQKKKKKAASSSPDSTITLRKIRIALINEKSQCRRKLQTVENYRAYVTKNA

SEQ ID NO: 1013568 - protein, 178 aa, Homo sapiens
ESDPDAWCDLINVQAFREARTHSGDEEVSLSEALDLIESDPDAWCDLSEIDSLRTICGVDSIKTAYAMHSVTISSKSCHPRQDFRACVPSVTEYRLDGTTKLQTVSRSSRGELDPHTPPSTEVGGSGHWHTAPLCSSGRVKRREALDPLSLRMHQYESFPWDSCKHDYTPQEHSCLRT

SEQ ID NO: 1013569 - protein, 199 aa, Homo sapiens
GLRSPTETGPHGAHQDGASESRPLRRQPRGSPDYGSCSGQSSATRAPPPAHFAGSQGDYGDLQASEAYLVVPYPWLAATTALIPGSARLRSTSARSAAPYAPSTPLTFKTGPPLVPPLCPAPRPGEAPNFPRFQPWGTRSAGLKPYNALDARPLGEARMRCGRVGDSAGRFSGGEPLDTTGAEWVSSTRGWEGAPQSCA

SEQ ID NO: 1013570 - protein, 314 aa, Homo sapiens
MDVGSVVQMEYQDSVVTALSERSLISKMEKKGERNEKPLFRLNHKQAMGLNFYCMSGKTCYDGVISYMLQLLAETTNSPVLTPQTDTAVCILQYMQMFTESYSRCDLMKLVNHLACFCLAGSFSVRKANHLGATELCTHKAQSFVATRGPHGPCVRVVPTLALFRNGWDTSSIQTSLGATLSHIIIRWRFPPWRIPFTSAKSLSKQFHFSLLNVGPMDTEQAGKGTNATNIRRRHMRLTPVPKHANVATSPRDWTLHPPEAGKSTRDGRGTPHGNYDNSSNDQPTQQSRERPASTPPRTQTIQCPTSEFRPNGG

SEQ ID NO: 1013571 - protein, 147 aa, Homo sapiens
PSQEPLWSGRDNGGGGDRRALLMQRAYGASLRGRGRSGSLTRSGFLGDCFLLLVLLHLAGARSGFCRPRSCASFFADPLFFLVQLRVCLDSVLRMIRMRTIVVVGAEECSMDPDYVKASSGLTGYTRGQRSIIVHTIVNTRLRASNR

SEQ ID NO: 1013572 - protein, 270 aa, Homo sapiens
GSVLRCAGACEARSLGAEPRPCRAGAMKGKEEKEGWRTVLWRWRAEAPENEPELLQELQGCMGKSVCSVGLKCTRSAAGLATAALITLETRWVAVYYTNRALCYLKMQQQLSSALADLPARPGAWTGASSVERAALLPWAGGQVGKLEKRILAVKAPSRPNLVARENAYHSSWRQGRTQAGREICGETEYSHEALFDIRDKRERSLETSISERAGSIPIREEGGCLNLYLLSSEASVWPGGSGSGRDAREIGAITENPRGVMKDGQATFR

SEQ ID NO: 1013573 - protein, 330 aa, Homo sapiens
MDNKKRLAYAIIQFLHDHAPARGPLRPMLRKTWKSPSSCLETAFEGDVEKTVTLQLPHTLSGRYLEGWTATGKEMLQDLKEAPRGTPSSEEDSAEAEAASKAEGRRADETCETLWNAAVAILYGTIADRRSSHYCKRRANCLLDRKGARAYSGDIGPTYRTARSWPVTCGAEGPNLGHLDPGTRTSQRPYGPAARGPGGPSQPAKQPRREARGLPRNKRKGHLGSLVKTRNRGKEHYEGSPTLQGLGGSLEDLPREGPPRPHGGGPLGHAIRTSAGACFESNPLGVPLNAVDIDPKLNVGPAEFRTGLGSAHEFPVGNQPPLGNPRDRTM

SEQ ID NO: 1013574 - protein, 75 aa, Homo sapiens
ARSLAESGNRIKGERIRQGRSFGAGGWSAHLRARTRDVDRELVTMCGAAGPWVLQPGTVVEPETNARRTLKSDPE

SEQ ID NO: 1013575 - protein, 255 aa, Homo sapiens
PFGPPDGVAGSARWGRPLPSGARLHLLGDYTPTSPPYWSLSPLNSWNHLWGAREPGAAQRGSWVGYRVGSSGHLMGFGGLLWEMLLGAQLGYVKVLREGEGQARRGGGSELDIQLKSFGFDTNGSLEVESSVLRLGLREADREDLMLVGFISGRVRAGRVRSYSSPGFRRTALSQKSEEQCPRSVYLINIKDLQVQVRKYGEQKTCVSYPGSSRECTVQDRAPEATGQQSPGKGDGGGSSAGMQAQVNTAVIQGS

SEQ ID NO: 1013576 - protein, 120 aa, Homo sapiens
MGPIERELLVEHVCAKKQVVTDRKPEIISDSLSRDHLSIQRKTWERSKQAPRGKHLERPPLYEKQKKVIVKRRHIVTQIVIKNKITTEKNTHTKTPTEENKNRTKTKKKKKEAKQSETGD

SEQ ID NO: 1013577 - protein, 320 aa, Homo sapiens
CLEIALCTMLRVRREPRWTQRSFSEQSACAHVLRSQSSTAQPETCYGQLSILGEEPLLRNDPCWPMLAVRPCNEDRPTLSPLTRCQEIERLRPKAGFHPWKRSSSSCNLGSSLSGFAVATGGRGSGGWRAARAPPTAPSALASTSPTSSAFSSDYVRPLLQLGGLPLAAGGLVVSPAGGAVGQSAFISKVHTTAADGLYPRLCGIVHPYESWLQVGVPFDAWRRARLTKGRGVAWWDVHRQPGLVAWKCRNPRIEGGPKKLGCNFAAPPTKAIDEHSARLGTLTKPELSGSAHDNTGTYRIQRCPQDYLHAPARLPNWFH

SEQ ID NO: 1013578 - protein, 171 aa, Homo sapiens
MQLFVTFSPPGKILSMMEDNKQLALRIDGAVQSAQPGGDQPASQKLNGTNLETGGTELASGGPGPGAQGSLMDSALGRQGGLGGDRDIGETPQALEAAKVGFGPRKTQGEMERPKQDDTDHEPREEWPEWNTGGTPTKPPGRQKNRHYDSTMSFDETTFIQENRRVETQPE

SEQ ID NO: 1013579 - protein, 101 aa, Homo sapiens
VSIPIVPRTVAMKDELLCQLTQSNEEQAAQWQKEEMALTDTCRSELQLDKQAVLAKEVRDLKETLEFADQENQVAHLELGQVECQLKITLEVLLGVAALQV

SEQ ID NO: 1013580 - protein, 252 aa, Homo sapiens
MSDVRDRTPVGGNSIGLGSFLAGRVCPFPRGSTCLGAIAPGSPSAWSSCRNDAVDRWHLGAQVGQHLSKEQATQYPHSRWGGLVHGSDRVRCTRTCDREWHKGTTGKCQLLSEQKGNCPCELSHVWHKQTRKLDTWADGLVVTRSMWGHNGLGELAGLHCAKDSRCGPQPVFSQQRYKPPIRARACRVGPTCELLVTLLSVPRFPARCVALLRIREGAPMIGRFRGPRERVRHGCELRDLMASHGPCARAMR

SEQ ID NO: 1013581 - protein, 90 aa, Homo sapiens
KLGPIDLSKPGGENYPHMVLRERTQLATGALHTILTSGAPLWIPECSHAEGYPARVTRFLYTKWRPNGKISFSPGGVGTDASGEGCAPDH

SEQ ID NO: 1013582 - protein, 317 aa, Homo sapiens
MGAGVGMVLCWLGLLGEGRAARGERGSEAADICVMPSAQGLCLSGVCPAARWVLLGLECDCDWSANLFVCLVSQGTIGTIPYRAGLPRTNVQWRKALGNLRWSQCEPVYVQMWRVRKEVLLRLYLGKRLENPHVVAVLLVNTSSEMRLSRAVVRRQERLLIWEAANDYNRTKVDRAKSELEGSRRLQKRPGVVRGVEMHHQLDVSNPNTRNSREDSKLSQDSIRHREDLASNCRKSQFLDRADKSISYQGLYRWVKNLTHARVEDEVVPANEVTSLSREGKPFIWNILMNGWEPFVSTRKLNFRINSPNSVPRSPYP

SEQ ID NO: 1013583 - protein, 258 aa, Homo sapiens
CLRQPPSLHVQVTWSYRMLLVQANNVITLMRLILVLLVLTGEINSPGPPGWLRCLGRRSSPARERCGKGLERPGPGEAGGCGGLGDRGATLGSAPAGWLRAGFNSILRTCLRGHQSPSSDADLGSCKPLPKSSPNEHLTDSLWIAAPKRRQVKPEDQLLCWKLSIMIVQMTVISTEEMHQDSLILEKSQNWSSQKLAHILISCVCLGDTSELTLTEINSDGDNVALQVHEAVMNVDGDSDSIMSQMLEKSDEHGECSR

SEQ ID NO: 1013584 - protein, 70 aa, Homo sapiens
SSKMAGELCRALPERVFVVDGLKNTIVENSGLDSEKRKSQWWKRRVEENIGTYPSCVLAVDRSPERYTPP

SEQ ID NO: 1013585 - protein, 330 aa, Homo sapiens
PLLQQLKSATLTTRFKIIHTPALNPHPPNHWILQPHILRWIPRFPVPPTGSWTSTVLTHLGYPTTQLQCNWSPEIDLQATGARIPCTSTRQTRVLPSGTSIQMSKVKRLDSYDPPTLRYAHASQHSGMLQRSSMTGIAGIRTNTFTYLESMTNQRNAWDPGYPQSTGVPRYPLTSNSRGFRASDWRITSIININLRHRGLKILTADMHRSHDNSMHYALPHPKAPGSPDSQDLQTTRFVAPNNKCGGHSGTDKWILATAAAGFQILGTQSLCQSLKVETLISGTADPDIPREWNHKDLEIPGSDLNHSRAGSQCSGPKSQIWANKDTEYP

SEQ ID NO: 1013586 - protein, 174 aa, Homo sapiens
MRSEGSPGPPQVQPRWIGVTHREPTYTEGTRTDGNLRITFGRVNTGVQLVHPGYKGGTVPLGRSHREILRGHELLVLNFGKPHFTARKYYTCLRGHRRSSKYGTNIHAHYYPRSEREKGSRTQTQTVASGEPVSGQKVGLAPRGRSGSHTIAWFPLFPPRIALWCGNHSACDQY

SEQ ID NO: 1013587 - protein, 151 aa, Homo sapiens
MAEALKPLLTSASSQEYRLQNYKACFVFIVVVVVVKFQDIEKNHCSDQINEDRKDKIQGWRRVNNILALEGRQIVIVMLALVFLLDESGWRHYDVAAVILSHRFKAQLPRFDSIHGGKYGRTRTWNNIGDIFQRKEAKHHDTLGGRRVPNM

SEQ ID NO: 1013588 - protein, 225 aa, Homo sapiens
GVLSAPFLRTGEWQNSPGLGPGSLSVWRPIETSVALSSVLLLANSRPFAEMAESPNASPSTLHSQETATKFKDASLSGGGGCRSSQEFRRIIAPTKKKKKTNKKKGGEQHEKSMSPKRGAPTNHHPQRPKCIPTSKEWVPTIQGGDQNLKTQIRQYGHDLATHKRDRNPDAPKPAAQHHGEQPSATAESPHKSNPEERCHHHRGANKKPQRKRIITSTSQGTTLS

SEQ ID NO: 1013589 - protein, 298 aa, Homo sapiens
ERGGRTRAVRCQIVLTSYVMNDLCDFILAYAMRTTEQIGKATPKNVASTRSRDEEGDYGISVPSEACKGAPTGIGKGTEDRDGRRLPIGGVNTEDHDERQATRKSTRDGKTWCQHRMQNASFLSDLSDTDLERRLAHNRGCERREGRGALVGSELEGESLDWGDTYQGNVPRRRTSPRETQRGDEIDRATLVSAERDEPNTERRHEERSGPMCCAAIQHCVDWPATEREARGSRVKPGSPTFHKRAGSRQTRQGKFQFINSPEKRRNSSRGRIYWSTGNSQTSLGKRPRSPIRALFGN

SEQ ID NO: 1013590 - protein, 159 aa, Homo sapiens
VRVVVAVALRRHCLRPSPACQPESEGAAVGSDPVAGDSDTEGEDIFTGAAVVSKHQSPKITTSLLPINNGSNRRMGSMKNKTKSHRSLFADATVELSLQRAHKTKSEEGAIQETLISLPPQEDHNTSSYIPHVNLCRMLGWIVTKHGRTQISDLEHVES

SEQ ID NO: 1013591 - protein, 282 aa, Homo sapiens
RQSSHIGETTMEKVKVGIHRDLVVLGAWSPGLLSNSALKMDIVAASSDPISVVASNYMVYTVFHNRWFHRIGKFAMDTVEADRRVNALSVNGKSHLPVLYQGGENSLHKNPRWETIAARCVAIVACSNVSRVFATQPLCMKRAWRASISQRGEASKGYSAFFWHRTFCVLVHTMIACMGCWKLTAERGDGQIMTCTESFSRCPPCIQASWLSQPPFGPQTIVQIGIETFEPSDAVSRDQNRCATFIEWTESGGTEVESKPQGAIGGRRAPPLLKGRSPMGDA

SEQ ID NO: 1013592 - protein, 518 aa, Homo sapiens
SQARVSPFSHTAAEPGLVRGGGGVGIVEVDPPPPLGRSCAPTPHVSAGRTASLPQHRSLSLASSLPCASTSSWSPDAWCCTSPCVVVPCRPRAGRYRRGSGIPAFPGGSAPGPKSARSKAQDPPNKTPRTSPEDKTQRSKRNWAKHGPRKPYRRDRNQDTRPRIEAREHGTYGLDKQDIANGNNRHHRQRERNEGQRWQHKRNDTIEIRCDTTRNRTTLPYSPTSLTYADILPLPDPEITAQNTNCLGLEPGPKQAPHGNSNYRGKDQTHNGTTFMAPHLHDPPNKYRHFQAYYTPGPTQVPTDYNDYTITYYYHIDERKRKFPSELHKSEDSASPQANFAQLAHYDYTNTIRTTYVTITPNSTEEYKHEANYAEKYPHRDEHKHTRTHTTREHDELADRTKQEKPAQRQIPINKNEKGNTNTQSNTRNRTHNKDTKQNNQTKKRTQPHNSRITRSPHPEATQAANNNTVAQAELGQDRTSKPPPKQEKERNRTNHATRATRKPDTIQRPQLEKQTDK

SEQ ID NO: 1013593 - protein, 134 aa, Homo sapiens
LDNLTECNSAYNEADSTLTIEEGNLDIHKTKAGRGRTQRVTFSEDDEIINPEDVDPSVVSDFRRHGAKLLRGPSLTKKRVEGPGSLRPGQESGQQAHCSNFAFSGGLYGGLPPTRRVNAGSQPHWHSMGDARQS

SEQ ID NO: 1013594 - protein, 481 aa, Homo sapiens
MTLPVPGMPRTLPNNDRFVLSKGHAVPILYAALSLKLVFPAPRCAMPVCNAVEKRSDILNLVRRTARSSETNAFTLIDGPHVLPLACLRGPYEWTWRVLAFGARRPRLRYISDLMGQRSDDHSLAYACATNRVRTLVPEACVLIDSAMGPVVHFSGTNSIQLNVLAKRKPLFEPTNILKGTNSIVQSLCVPSINYRITRAPQVFAKRQTAEEFEVTNFIQLKKECSAIRPRWGPLLREFVGAKFRPGFHLPRLGHFEETTPHAEIVERGIGPCVLTYIGVHIYSVPTIGGPQKATNPKRPQKNQMAANFQILPQNGSRVFPNRGGPLEKGGTSTLARGGFREQRAPHNGGTALPFFVAQLCGEKAPRFFFHTTEEVKKEDKLSVPFERRQRQFPISPNGGNAQLPLTNGPPQEMSPEERPQTTKGQQGSSSVVGLKNTPLCLQTNVVERKPGHTRLTQRVRGNHYLAPIDSISPGSNLYAP

SEQ ID NO: 1013595 - protein, 206 aa, Homo sapiens
MSRSRERHTSGGHSWSYVAYPTIIVGGLSSGDNVNTLVRPMDVCIMPAGSSLGGVCYYHHLGGGPFTFPHGPFTLWARDNFTRVLTPLWGSQLPLNNVLRIAPQGLVLWGRQTAVEYTWEDLVNMKLPPGASTSKETSIWVKPQNLIVFKNSKGPKTQLQCQTYAFSTTIPPTENVINTPGNARQTGDGGKRPLHTEQPPHYPTSS

SEQ ID NO: 1013596 - protein, 117 aa, Homo sapiens
MNRYLGHWTIGQSLMEQWVRPYNGAHNTFPKETLSATSVLPYLNARRCFSKPLCGGRGGHNYLWRDVTASVNLGRTRALCRGRSYYPRTENDTMETGHILCVKHNNTLPLYPTSNGV

SEQ ID NO: 1013597 - protein, 101 aa, Homo sapiens
MAPSCMSPSDVQAAAIIGNSWARPHSPHLGMQGQMFHVAAGRARRSALQQLHWWAGEPALSPIPVWLQSGPMARGLELLAEEDAWEGAVVWRALSARGIRD

SEQ ID NO: 1013598 - protein, 67 aa, Homo sapiens
SLPPVVIVMTALHSPAEPQEPSHDSAFQIANLAELPAESFLLLLVLLSGELGGANPANEEEEKVVEV

SEQ ID NO: 1013599 - protein, 193 aa, Homo sapiens
MAGGGESEDGTVHLRVPRETLQQGSPYSAGCMSRWRPPPVNSSRSSVIGSLNGVHDVRAESGRAVELCEDREHDCWCGTSFHDSITLIVLSSEVGISELRLERLLQMVFGTPWSFLVGLEELTNIRNVERLKKDLRASYCLIDRFLGDSELIGDRDQMCGLAVIPPEGVPLAGSPLRGSLRPRARASCSLVVS

SEQ ID NO: 1013600 - protein, 90 aa, Homo sapiens
CRNPTKLLRLGRLDMPVTLTHVAVSVCWAWSSDYEGEVPRDPWRRRAPYDVEELQRTAYEDDEEEEQSVLGGIIRNYLIHALPLNMCDHR

SEQ ID NO: 1013601 - protein, 216 aa, Homo sapiens
PAALSPPRFLPEPPPVPKLPRLRLTRCRCLTGNSPGCVVPLQGLGGRLMAADGGDRPDARAAEGDVTRSASLGFPPALSQTLPRRTAGYRAQGPACLLLRRSCCAPLTKNPWDSQTLVQLPSPIAASARAHYEQGQNAILVKGDRRSDAWAAIYFPISSSQSEGPVVETLHGRIWEGFVAQHLGHAYHVTQVHTNHMRYALGTRTLLPPLPQVGDN

SEQ ID NO: 1013602 - protein, 297 aa, Homo sapiens
MTRDAENRKRSTTGADDGAIAQRTRHIHNTHSPPISLPTCPNLNNRYPKHELIPHFPHYTSSDSRQVPNPPLYKQLNSVFKRPQHNSYQNQQSTTITQNTSTPPQDAPANTNDQEHNTSTLSPPSTNNYTTYTTTPSYPYDIKTPPKNTIVEIIYTHKPHTTLTHISKSQVAHQRENTGIRVHAGAHSSTPNEQRKRSRYIGTALAGESSEQNGSSNARCGTGGARGDGKPQRRGSSSWRNRPGARGAETSAYVPPVRRSPPPGRVCKTGARSGSRSAVETLGCRREYRTGVHSERR

SEQ ID NO: 1013603 - protein, 130 aa, Homo sapiens
MCASVGPPLVPPLLVVPFHKPSSYLTPIYILSPPLLFPPSSFLFPAPDIICRLLWECAPRLYYLDAACHVSPRKNLRAPLGLCDAGALLPRAISKQVLWRPLRTSQPGATPPVGVCPRAHHLCCGEYLPP

SEQ ID NO: 1013604 - protein, 93 aa, Homo sapiens
PKGKLLKAIRDFGSFDKFKKKLPAHLLGSKAQVGVCLVSIRNGDTYKLLLVQIRIHCKEQQALFHCWGLNVWEHAYYLQYKNVRPDYLKLFGM

SEQ ID NO: 1013605 - protein, 216 aa, Homo sapiens
MHAYVHSILGWWSDDPALSNEIKKKKTKQYNDEMEVDYAENEVSSSEDEDTESSSDSPRMADTLTKWMSEDCEEEEEWNVMDEMSILEKPGLPDLKRSTLIEERIKSGGCNNVQEVIAGQSTRDYLLNRWQTLQENYATFATTGRQDILIESSCLEVCKLNKYDCDNSQLLASIGESETEAVCYMITGPRGNYEEEDTKGLKRIGNRIDYYLRAAG

SEQ ID NO: 1013606 - protein, 135 aa, Homo sapiens
MADEPKPISPFKDVLAGGFGGMCLVFVGFPLDTVKVRLQTQPPSLSGQPPMYSGTLDCLRKTLMREGITGLYRGMAAPIIGVTPMFAVCFFGFGLGKKLQQKSSEDELSYPQLFTAGMFSGVFTHRNHDPWRTDQ

SEQ ID NO: 1013607 - protein, 36 aa, Homo sapiens
LGSSTTFIFAAPAGAGPPAESPRSNRSRASPAAIAP

SEQ ID NO: 1013608 - protein, 233 aa, Homo sapiens
MAQQQQLPVWAIEGPMDGPKAPPGGIHGATRVATHLLLSGVQGPDTPLRPSARALLAGKECTADQRTRSAVLCLKSREINLSQPILLELEAPLKICGDIHGQLLRPFCDYFEYGRLSLPRATTSYWGTTVDRGKAVLVDHLLLLAYKIKYPENFLLTPVGTTKCGSIKPGIYGIYDELQDNARTIKLWKNFTDLDFNCLPIGDISGRESIICCTRGMNQELQDNDTRYGASSG

SEQ ID NO: 1013609 - protein, 209 aa, Homo sapiens
MATVAKFIERCPCKTTFRRKFFPSVSDGSRVATVHGFAVWRHERDLLTSFRCMWHLMAEQLVDVVTSSQGVRNIQGTAMGVTCWERPSVWDISGRAQTTSWTSQSYVGIASCKEMDVLMKSILYNSIAPQNEEIAAVGKDTILDRPGKKVAVHEFLRAWTSRRGYAHKLAVGVHYYYTEVVLYDDQQVEVRRPLVSIKELEIVETQGPC

SEQ ID NO: 1013610 - protein, 177 aa, Homo sapiens
GGVVERLKPLYPAEFRRRGGYAESYHQHFCGPPGRRGAVRAVLSATPTCCCSGVENLYPNDIINNPKLVGDAAGYGARGASCPPGMIQTCWSATFLSSEAAMEGVDGPDALELECTGAGLRMCLPRGWTAHATCELAIDIIQITLYQAQAKWPESITAGHMGSQIKRVLLVRAACDT

SEQ ID NO: 1013611 - protein, 64 aa, Homo sapiens
ARLYVPKSYDGKRSGRRLLRRVQCPAPCEIFTSLEYGPVPGEPRMRTERRSQAQWLMLVIPALW

SEQ ID NO: 1013612 - protein, 129 aa, Homo sapiens
RLGLEPELRLGFRADVSVILANPRCERGRECSLAGDGAEFTSRRGSSRSARALACPGCLRVRGSEQRASGCVMGLCSLVRQELVPGLRYPLYCASESTPALELAHRMQMAGGVQHAKDKCINECGCAHY

SEQ ID NO: 1013613 - protein, 318 aa, Homo sapiens
STPMQAIVIWKYKSLLPGPPSADVLLPGQRRTTRLNAQSGRREPRLPTPYFECQDSVRTVRVVATKQGYTRVTLGDYYQCRRITITRKCMTCPFDQTAWGDSGVYYCSVGLSPGPPRGTTECLRMELIVLDWLFVVVVCLAAFLIFLLLGHLLVPVLPVTACCCYDQVPLLATDNVLPAPEALYAAGKSRHLRVFPAFLCATMTYAHHVIPTKTKTKQPYDSHGDPSHTDADTPVTVYTGMTLHSGDNSSLKSTSLIVPRVLTGKVGTKDSQIDPTDYDAGLPVNLNANPTSDRLHDGLMFINSNNDGWTHYEPPVLT

SEQ ID NO: 1013614 - protein, 397 aa, Homo sapiens
RRAASGCERESCKSKRARERATGTRPTPPLSPTRALRLPLHPCLIYPGLALLLVHSPRALGAVQCSLGTHPVLQPTAYPDKGLALVAPGPDAAHQTSPENITQGILSSTPHYTITPDALGNRSCRASSSLGPATTINPGHKCKTEQRNKSPSHIFNDEVGQTETAVKPMARPTDGLGPQDKTTQGGAQPGTLPAPEPEPYPKHRRTTKGLHGTKSKDKAEAPNIGNTSKQTHARIPRRNSATTMADEPQEDNTHTATVAHPEPGKHTPKKNNEQSKDEQHQDALESHLQCTHNENGHTEAKTAPPGQPPRTETNTRLAFRIAATYGKAWRALPHPIHTAHPTSACRLPDSTLVGDTQLTHPNDALLPRCLLHSRRSVHPRSPQLRRRHSYVLSQCSG

SEQ ID NO: 1013615 - protein, 184 aa, Homo sapiens
MDALLLVPPFPGLALMGMPVGWVSGPALGRSVTDGLRCWHCPVLPDGPGLPDLPEPGARPTVLGRRAGVAANGMACCRRDEFLWREQFYRYYQVARDVPLTPSCAMSWYEEFQRLYDTVPCVEVQTLREHTDQVLHLSFSIPGTSSRPAPMDCTVKDLEQRTDHLAACTGADMRALKLELHPVS

SEQ ID NO: 1013616 - protein, 313 aa, Homo sapiens
MGSLAACVAAVLIAPVRLRLLAALGAGVLCALPGSWWRDGATACVAPWAVPVCGRGGVSELLQLCVMRLVPDLTYCGVRACSTAFVMCPVILHGTHGQLEVPGPVLPLTGCWLRFGDRVVLAEHLANTYSYHKVDLPFQEYVEQLLHPQEPSSLGNDTLYFFGDNKLHRVVPLSFGTTPQPHLACWEPLQLTALESQELARGCPSTGIGAGVLRSDLRVVRCCNFPRPVGWHCYGSSFDTSVFISSFLGVAKTAGRTAGHTTRNVRIVLTGFITRDSGGHGLRPATLSWFSSPHRGTDQGQANSDVGGETGQK

SEQ ID NO: 1013617 - protein, 270 aa, Homo sapiens
RRRAQVLADWPLVAVRSAAGPSGVAAVRSFALASCSRREAGVMWLGAICGRHGKEGGQPCAQQVQPIGHSSSWYAASAWIVYLVLPKASSLTLHTLLCRDVSKELYPMTQQPGRVFLSSMRGRLSIHPRESGTSRATCKNERSSSDSLMEGNIAAMCTVIGGPADACEERFRDHSIEMSGTACAAIIVSCRQTCKAIERMEFKLLQRLCMTDTGCSQVTEALVDDIRSTSLGQQIALAAGALVGCGDTSPNESAAPFQAFKPFGTRLFGS

SEQ ID NO: 1013618 - protein, 104 aa, Homo sapiens
MLGENMRVIDSCGPFKCCEVVEMDPTIISDFSTKSIEDSSISPSSGSSLDVGEEQTQVKAQKTEEKKSSVGPIFLLDYCLVSMLAIVLSVLTCSEFINSNRPKT

SEQ ID NO: 1013619 - protein, 148 aa, Homo sapiens
EAWAVVADVDLTDCTGAGLVPGAMERGPGALVVRVAGGGLPTALTWRPVVARLPVGSCLDLLMGCLVPLCLLTVACCLGCWELGGALSPLPATLVSPLHPSPDSWAIAWGGALLCGVPPVLEGRRELGRLLRSNRNVGALVLLRVECV

SEQ ID NO: 1013620 - protein, 181 aa, Homo sapiens
MEDHQHVPSRHPDQQAARLAGGQKALQPEMAGRSWDLTESRGRNNMLLDSKEMHAWSHHIMLICLSRPAPDIGSLKIDGILCIKDNTYLVELSSLLVRIHYNPLTEEQLQCSSCSKNQRKEESAAGLRMREQFTILQQYGIRAENVEETVAGEDLRVMVNWGRSIPGGSLECPGVGGGVKP

SEQ ID NO: 1013621 - protein, 118 aa, Homo sapiens
MGQGFPYVWHTVGARYTAANSHDVHDTVTQVATLLGSQVILNPSLSSPCLSKASALIKQLSPQVAPYFKFPLLLPIFWPHHLLLWTILKPLVFVSSYFLHLSLLQTWATKVVFKTLLC

SEQ ID NO: 1013622 - protein, 272 aa, Homo sapiens
MQAVGSQRMLSGTWHYVFMTAAWLLNQVGTDPYLTRARSNTRNSVTAAHATHRTTSQLLHPLQPLPRPHTPALATRRTRTTPSQPHQSSPPRNHRTYHKRHSHKLTTLLNTLPPTTLTKPAILAASMQHPHNPPHTPSHTNMHPPHPKSQPQYNTTTHNTTTNKKPQTQPINTQDEQSPHNSRLSLTPNKEHTSYRHTNHKTNKTHTHHNTTQQRRTPTPTHTAPHNPKTETQPPQPTHTHGPPNTTTNHTPHENTNKNNSHAPNTNTTKDQ

SEQ ID NO: 1013623 - protein, 47 aa, Homo sapiens
LACLCKASAAALQDALPDHAYVLLRALAHGCIVQEPPGGRSLHSECS

SEQ ID NO: 1013624 - protein, 194 aa, Homo sapiens
MLLLLLLLPLCWAVEVKRPRGVSLSNHHFYDESKPFTCLDGTATIPFDQVNDDYCDCKDGSDEPGTAACPNGSFHCTNTGYKPLYILSSRVNDGVCDCCDGTDEYNSGTVCENTCREKGRKEKESLQQLAEVTREGFRLKKILMRSGRQLGKKSRVSFLSFRLERSLWKTRKKRCGQRKEEAERPEKEAKDQHR

SEQ ID NO: 1013625 - protein, 40 aa, Homo sapiens
STPEEANRTTGSERGRNEDSNARHTQEKPNRRPRQHTSGT

SEQ ID NO: 1013626 - protein, 211 aa, Homo sapiens
MHACVNTPGSYRCTCPGGYRYSLSCEVAVRMWMNCVGLLGRVCPPCGDLSWRSNYLVEASSVSALSAPRAAANVSYVKTSPFQCERNPLPHGTAGPAVICPYTISFAVTSSLPSILKTPIDALPAWPLASVPGRAGPTACGLGLVGGNSRGHFVHASVQDPADLGILIPCAEPGRGLSTLGWWTSHSVRRYLDRSFEADHRVQGSPSFVFP

SEQ ID NO: 1013627 - protein, 147 aa, Homo sapiens
AVVTCVEFSVVCRVTQPRSARNCVAHSVLQVYLRVGASLRRKKWGRLSGAARRGGNSGVLLVPVADILPPDCCACVSAVGLAPCDGRWRGCTWRLPMWCVGVAVLLPCVDDALPSLTCLVFSNPAHVGMQPTENLRRSAGSPARQNS

SEQ ID NO: 1013628 - protein, 48 aa, Homo sapiens
MTPRSAAITPAAGRLLCTVRAALRSLSAKPRNRSEAGGAGDAPADYDS

SEQ ID NO: 1013629 - protein, 95 aa, Homo sapiens
HSHPNSCLLIKTSEGEETLSLSSLPPRHPSATRQELNGLRCRYYCATSLRPVPTLCNPIAYQILTSGCTKTRRNHSTQRNTHKLPHMHSHYIREE

SEQ ID NO: 1013630 - protein, 252 aa, Homo sapiens
LQSRTSPSTTDERWTPCLLYLPQTESLPCCLLIPTRLAETFTIAYLLNSRTFLTSASSCGPYALLPRCTLSRGWTASDPRQHCGSARCLLGCCSMNHTDTNILDHIYQHTSNTQYQVTPEEYEGISILHATSTCTRITAAHTVMIKDHQLWRIVEHQDTKTSRQADTSKSSDIARSKTPRDSSLLRSSVEYVHSKLTKSLIYNIEHIMRRDMEEDPDQKTTMGPNVEEQEQKRVIDTLRGIESTTSDVKKGK

SEQ ID NO: 1013631 - protein, 126 aa, Homo sapiens
MALAECFSSKYLLPAAETPGRGVCRNYLPSSSPPGEYLIRDFISPRQGEYVLEHVAGWRIVRAFGAFDEIKRTDVIGDRVTAEDGSDMRQIQGEHLIHESLEIERLLRRIDEHTGSLRDDRTTYTS

SEQ ID NO: 1013632 - protein, 156 aa, Homo sapiens
ERLVQRKAALPRPERNLRNERLGACEWMQAPPLLSERPRPCSEGVVASPVSGRDVVVACSLPPGVNVDLGVQPLTACDVRLLPGVSVMLFTQQGANAGRWVSQLELKEVLAQGRTRCRHQLEIRRLGIGAGSDTFAVHCLPAHQTCTCRTDTKVVT

SEQ ID NO: 1013633 - protein, 318 aa, Homo sapiens
APEEEEEAGGGMAAVVVAAAGGAGPAVLQVAGLYRGLCCGAQPLPWGLVARVTLLQLRVFPCAAPCSGLALSVGCLMAAGVGGRVPDAPCANRFLRRATCDKIQLAAQVQTQLLLSPAWRNAVNFGSKPVGHSRQGDFIKCVEQEDMMPVGKTGLVNRRIHVRDKTLSFKSFNIADWSTRTKLQKHITQIWQQYFAAKDTVYAVIPCRNSSDWIWNRAQSCPTISIVLCQEGDRVMTLKVGQWTGYLNSTSLHLISIQTRWGSCRTSPADFHIQLFLKLEGRQRAIVLDDFRKLDSHISEVVDEGQRASTEPGPVFYD

SEQ ID NO: 1013634 - protein, 118 aa, Homo sapiens
METEKQKRNHDHNTANQGERNTNKQEQHTKPTTRNQKGKQKTAEQGLQTHNRHNSTWHHATTAATKNHNPTNTLDQHKTETNNTTNQQRKDKTHTVTRTHNQERQTTHKRKQHKNNRP

SEQ ID NO: 1013635 - protein, 136 aa, Homo sapiens
MIPLEKPGSWLAPPHGATSVLVAGACAWGLDAGLCLAACLPAPCALRAVVTENTRLWCAPRPFQGRATCRVPCGPWKLGAGGGHILQVGDEKCIDRTTILREQHICLQEVHGEQHEEKGQDCRDGNNSLEIACTLN

SEQ ID NO: 1013636 - protein, 77 aa, Homo sapiens
HALLHLLLMLPTCLGFPAPGPMYLCAPLWAWTEACKQRRGVWGWTQEMNDNVNPPESHLILVTKGHMSEDKSQRTNE

SEQ ID NO: 1013637 - protein, 182 aa, Homo sapiens
TANKMNGALDQSDQPVPRCQYKMFVGQIPPVMVREKELIEVVEPYGAVYQIKRLSGDRSQEPCREEYTWLWYSSIPVLLATYKSMLPWRHQTCICRQVLKTLAVGMQSCRDSGVRHRLQDYAERRSQGASCVETMDNICSMRHMVIRSKAGNDERLSSGRCSPLIMAQIGRMPVIRPGYLMG

SEQ ID NO: 1013638 - protein, 98 aa, Homo sapiens
WHSWSCDEGRRGRWGPMLDDDFKEMEKKVDVTSNGGDMKCCAMDHRCTCEPNPARVANADHAQHWCPTILVASVREPLATRRSEVASGADVHDPATWK

SEQ ID NO: 1013639 - protein, 228 aa, Homo sapiens
PAPSQPGDCSGPVRTCTAGGAARRGSVSEGTLSAAEPAGSGLVMEPGLVEMALRAPALLPRAAATTACSCACRLPSSLPLLQRHGGVWLPCGCASVPAGNPPGTQTLFLQDNNIALPRCLGALAPLAALRRLYLHNNKPAAPWRPAAFQRAARALLELALTSKRLRGLPQWRPFVGLAQLAALLYLGGQPGWLRLLDFTFLHLPRNNCREASTLQSTNSHWSLLGRTQ

SEQ ID NO: 1013640 - protein, 439 aa, Homo sapiens
TGADAEPRHVHEKSFLVSGDNYPPPQSSGYPGGAPATHATHMVRLPTLGVNGPHRGTKHTKKAEKRRKNTEHTDTHKNGQPNKQNHNKKTTTHKNKHKKPTKKKTSKNKKEKNTTEKRKKTQKEQRKNKKKEEKKQQTKTKEHDKAEKRRKQTNHKRQSSTGRNEKSRTNTGADRKHEGARRKTTEEEERAETKAKEGAQQRRNGHKRDEDGTTRREARREQKRTGDDRKEREREGENERERRKRTRRQEKEKDRKRGPKKKDKKEQQDRRSKTRTQDTEARQDKRRTTTTRRRKQPRARSTKRSERINGDTQATTDRKRRERTQREHARRKPRIGTPRTAPPDQGSQGHKRRRREEKRSGDREKKQSDGDRSTKTGSEQATAREREEGQTEERPTRGEPARRARKTRKEEAGHGRKSTDKDKNNKDKKEDDERGQSTE

SEQ ID NO: 1013641 - protein, 143 aa, Homo sapiens
MAMPVGVLVCLKLVCGCVVMRADCVCCGQWSVMVLWEVWLVLSKIVVAVFLPELEDLSEREGHRGPAWTCKSDQLFCRFSCRLRCRCLLRAIFVRQTMWPTPSITVDLRYQKVRGRILRVKAGRWRMRAESPKSVSTRFLLRF

SEQ ID NO: 1013642 - protein, 236 aa, Homo sapiens
MGGWVLALKMPVRVVALSVEGVENVRIPRGASALGSLQPGPTNSSSANEERINRSSSLSTVGLKFGLLGSNVAIVQKDTAVRFLCCELESVSLTDADFRGHSFRSEHSKNSKWGRDKGDLQVHDMLEKGHGDSVQHEPWNRLVLIKWTQEAIVTNKDANRYRPPKTKYQMTTPDDQGIDVDLDPVRKKEGARDFIILDTPKWGTIDSDGRRRTKPSLALQPPNRYIPDKHGIRTHT

SEQ ID NO: 1013643 - protein, 209 aa, Homo sapiens
MGVQFYLGFPFGKEGRGGREGVKPTKNGGHCQKGVGLEWVLALACSIAPPGEPFAKFVASPKAHSVAPPTRRDALGRPPVLGRLVVLCKGAQLDDGPRETPHPPLALAGGLLEVYGSRTIFGEPPGTHDIIDPGTDMARTSLALESPAHMAYRKGIILVYKAATRQFSYLIENMARDWGKYAHTRYFRGGMLSNARLLFGPTVPLADLI

SEQ ID NO: 1013644 - protein, 78 aa, Homo sapiens
MLALRGYSIGGPRGHLVSGTARAHPQGFPRIGQGPGGFGDAGSRDEYPWGSGLYFHLSPSRSLQAQPPRHPRPAVGAP

SEQ ID NO: 1013645 - protein, 331 aa, Homo sapiens
CEWSVDPRSPVRAPPWPWLSGAAARRRAMSLFKCGDYGGAPWRLHSGPGSGRDDPSDQAVLHRNRAACHLKLEDYDEAETRGIKSYLNFSEAESNEAHIRSPQPFFLGLFLEIFSPTCVLGAWRTGGPPLGVRDTGPVPWVLGRPRAHFDKGVGGGVCKATSYTGGGEAQRPYRKKSWGAERYVNPNGVVALLRTLWRRRLFVVRRFGRRPKRTHKGFFTPGDGALLGAGNHIVAVVVAPHGENFPTGARQTGGAGKLPSGFSLREPRENCPPHRVVCTHPTMVFPQKIIRVVVWRTPPGKVQSTAWRTPCGGENNSKGQKKRGVFFYREK

SEQ ID NO: 1013646 - protein, 82 aa, Homo sapiens
EEEEVKPILQKLQELVDQLYSFRDCYFETHSVEDAGRKQQDVRKEMEKTLQQMEEVVGSVQGKAQVLMLTGKALNVTPDYSP

SEQ ID NO: 1013647 - protein, 33 aa, Homo sapiens
PGVVVSRANKLQLARCREAAVCGVMPDGAGVRN

SEQ ID NO: 1013648 - protein, 118 aa, Homo sapiens
MRQDEEKGVLVKRVCGNYCIHYCDVKWRAELEDERTFKCGPITCRIALSRIIVRVRGTVRARSSRAMRCSSRDLRHAGGRSWLGVAYSREYKGKIDIGIQESCTYRNIFKGRFLEYQH

SEQ ID NO: 1013649 - protein, 118 aa, Homo sapiens
ARPRLAHRPVLIYKNTAAEAGESLQPGRRRLQGAETAPCPPAWAKRAKLRLKKKEKQLAETRKLREVAPGPLLLPAVLFRKVSLRGAPAPAKRRRGRDVPGPELKRPWGRSCSPRHRK

SEQ ID NO: 1013650 - protein, 261 aa, Homo sapiens
MTILPKKKPTPPDADPDNEPTTTGPMPPAPRRGGGVGVVRRRHWCCVCGWQIADRDSVRLWVGPSASFATASRPATRTAGRSSSPGRWPCRLCASGVVPVPQAGFSHRPCGVPRWSLAGWSLAGRRCGAAWLGRGVGEPAGRSVVGVEGWCRKGVSGGMLAPGPWATGNAGRPFKLPGGCAPVGQRWQYHERDGTGQAAGLTNQLTEKYEGRADRHRQSERLWDPCTPVRQQAASNSGPGTQGPNEHNERPSSIKRRCTDG

SEQ ID NO: 1013651 - protein, 301 aa, Homo sapiens
MECLCLSCRPVCPAWAFAPDAMPDAAMMPAGLQGVSAVPRPPGMLPLLHYLPYHGSLADSWAAAYCCILGSSFSSGLLKSPTCYTECTDGYEWDPDSQHCLGNVNECLTIPEACTGEHEVHQPLRGLLVPDPLRLPSYNDLHGEGPHDTRAYPHQNPKALTNRAYEHRRSGTDCVNVDWVCPRTCNEQNDTKQGHANKLAMEYEIQVQPWTMNGIQQRNPRAPKDSEERAKDQEEATRKRENKAQSTTSAAIHHTAIGRPVARRPKKDKPREQRNRIREDKTKTRDPEEYDRDREKVHQKE

SEQ ID NO: 1013652 - protein, 107 aa, Homo sapiens
MSTRAKKLRRIWRILEEEESRAERLVQKPGSQGPRKVACSIWRRDDDAKPPEDPGERNSDQGARAITKVTMEKLETSREPQEAGRSIGGKECQRPETRTVDNQDKCE

SEQ ID NO: 1013653 - protein, 217 aa, Homo sapiens
MCALAVSALSPGCCALSAFLSVRRSCYSAWMPARLETCVSELDCASSQRRVTYPGFLHLTEEDCARLQHGSLRFGAARRRPARGCSPISPGRSEVPGAQDDEQERRRRRWPDAGPLRGAGARRWRRSRRVKANDRELQPRCYNLNVGLDALRSRADLVPRQRPSVTAIIDTLRFAYNYSLGSGRESCAWRIKGCRRRCRGAPLPRECVPCLPGSPRP

SEQ ID NO: 1013654 - protein, 257 aa, Homo sapiens
VEWPRAARPQQRRREMAAASAAADTQELVAVGVSKIGATSSSTSSSRKGGCADCWPFCVMEQLVSNVIPARVVPGAWSELVVYEIAMLEEPPGDSQHTSYECLLWGEEYSARTSLVQVQCMPIRKATCLVHVARMPTCCIVLCDPRGSLAKTATTIAWAMPDSKPWGLITAGALYVTYLSRLDKAQDGLPSGPADGLVSCHPGSYLIRVVARSKGIRSSLESVHSRENAWQSPEERPVRGDIVLVFRGSSSHESSIR

SEQ ID NO: 1013655 - protein, 266 aa, Homo sapiens
MARDGQDRPWAQRSSQLDKQFLVCSICLDGYQCPKVSSLPAGPSVMMMSSKDLYPLLHDALTAILVPCMPVRIGPILREPGTSRHWREQRMRSISRSSWQATARMAPEWGPAYSRRRLELPTAVSRTVPSLSACPRHEGKTMECYWKRPCDDGPMCGECRAVEQSVDSMSNKAELTGSLAGRTSNGRGLTKRQGQRLCVGPIGTSWSSYANGRESGEQSRRAGWREAEGRGPVGPRSGARSSEGPWKQGHLEQAHGTASGSRDLET

SEQ ID NO: 1013656 - protein, 203 aa, Homo sapiens
WRIYRGCWLVVMSLFVGGTLGVLSVRPAPLQALLETVHQRLNRAMEEAEKTTTTYLDNGTPSQPKTQSSGERTPECQDAGDENAFHVPHSSTGQTGHPSMKSGACKKQSRKTAGPGSTVHTDGGGHQHQAEDMPGSRQLKLHEPSKNRSAIPRVVNYRGEAKTQGNRRHPTRDNSHTQETLMGQSFQAPRVKGPKRDDTERST

SEQ ID NO: 1013657 - protein, 273 aa, Homo sapiens
MKVLLCGAHSLETTTFLSRPPRHRGANPPYLAPLAAVLVRLRVCALVRIVIVFFRGDPDLADKLFPLVVIHQRDVLENSHHFRFLTAQQTLHSVIYTAGTTNHFPRCRRKCLSDARGALTSYTCALAHPSLSPEVPTYNAKAALALHAARGFLSHAPSKIPICAQGQALLGSPPSESPIPPVTFSVLDQRFSQPLSHPKSSLLPGLLLRFLSFLKGGEGHRCQHRAEKQPRWESSTSSLAVGATGGEANAVTEFHLGEIKCDQLSTIEDAAVV

SEQ ID NO: 1013658 - protein, 49 aa, Homo sapiens
MGAPYGEGRIIYTRERGPACNNQARDGKTPPRDDLEEDRTWGGHKLGHQ

SEQ ID NO: 1013659 - protein, 96 aa, Homo sapiens
PLRGAGRQCLSALTSRTSRACPPGRALLGGCEHRCGTEARFLADLLGPGACPEVVGTGCGLALLGAARPTGPSPSAPHTAGSPGTWAQLVTDPFVC

SEQ ID NO: 1013660 - protein, 188 aa, Homo sapiens
MEHYSCLLQFPPPPTHSCVDQIIKIIIIIGAHLITPSINSTKPIYHLVCDHPHLSTSHVSHRKDQTTTHSPRDDLATRTTSCGPAFTTAGTPLAPTPGDPTTRHTNVPPGPSHGHHGLRTCHYTVSVIPKKASTQTGYKRERIQATSSNHRHSHSDVKRNVKSTRTREQITNFHVQLTAEDRSAKQKY

SEQ ID NO: 1013661 - protein, 125 aa, Homo sapiens
MGATIYCDTHVPFAHALTSMGYRNKPGRHHKRVNANRSNNNLSSLDELRNKKRETAASIAHLGPEQMWYSPTKPNHPLIDHPVGQFNHISAPAGTRHLIENMYTEHRQLRHDISAIGTYYSDSEV

SEQ ID NO: 1013662 - protein, 436 aa, Homo sapiens
IELLRKIREQVLHHPQLGERLKLCQPSLESARAGWELWTAMTDDLPGLAAATTRWSDRTALSHSSTDPELILSCDAHKQLLLKTERAGYIRSSVATPLAALDFCPERPSSSLLSPASLLHRPEQRLPGKPTPDTATSCAAEPCTQPQHGPKGTNTAARRQYDTHGHSNTHTPALAQTGAHATHAQRHGTLLKPPSNGPKAFLVATQPCTPWTHELDSETGSRGRPKKTDPSRDSPTKSPDSYPTATPHHALSPEKPRRPCAPRNAAHTGTLGGSAHCNRQATELPAARRKGYRNPARAPPATAPHGGTDPDRHSLPPYRPKGGQQGQRDHLRDNLATHRTQSGPHTMPPEDTPTLANAPHPLGAAYGNRQHWATATPPRAASKSGRKHYRDETQNVGATRRAKPPQANRQTFPPYFPTLTDAAACTSSKPNPPEWY

SEQ ID NO: 1013663 - protein, 171 aa, Homo sapiens
MENCQCTPRAVALVLQLMASEGRLGVAGALVDPRPYAHNKLLQIALPSSGQLKGEDEHDEEVDHTVKRNAHKNKPFYVQILNRTPQYSHDGRDVEGRWQRGGERDDMCEGRRTRIETKGVGDTATAERQWHLEATLDAQSGGPAEPRDPVTVTSLGTEKRRLGHNPAFTSR

SEQ ID NO: 1013664 - protein, 207 aa, Homo sapiens
MSDVILESYETLRSGLTHWRWMAARRLATCDDVTKPAWTTDRPVIILRIATAGGPWTRPYWTATVSVLRQLSEACRASRVAWIRESQARLHRKSQSYPFPIVPLVQNPPIFPSRVPEMTVKDIAGTTNPIHLPSDIYACGPNSWARYPACAPGVSRTFTSQGWIGWGAFPCGCEKGGEEVSVRQPADRAENFHWLRGLRGPVGPPLP

SEQ ID NO: 1013665 - protein, 85 aa, Homo sapiens
GVRSNAVVPCERGASVAAVIPAYPRAYGRDERMIEVEYEELKTMITVTEDSCDEREIERSSDDVELNEWNSDAYALVSTNDYDVN

SEQ ID NO: 1013666 - protein, 227 aa, Homo sapiens
ALDLVHPAPEKDGWSLPGCVLQVGRNRSVCARQVALNPEEREQRALYADILDYEAGPVTGRKHWQGPAQEDILGDLSLVTGLVSTPCFSSPRPTLMLQLREAGCDVLRCQRPVVPPDEDRARRAVQGAMRLLGEATERQPGDELRRGERVVDERYQTWYMLGRNRSYGMVEREQTWTCECQDSRKGLIGGHPQLTEPCSFGDYGILYTQSGFSMTVYSSKLAKCNRE

SEQ ID NO: 1013667 - protein, 186 aa, Homo sapiens
HPPVRRGTVGGRRCWRALLTGKLTGCAKRRSPRLSCITMAGHFIHITITAGSILVGHDFRKRFSLQPPRTALQVGHPSGSTYCGLPGTRGPSPDNCGSGIRTLDEVLDYGYVTEHIHGDAEELSSSTEAVVSKPFSLFDLRQALACRGCDSEQSKVAPSQMQASRPVLSSRYWPEPKDMTVLRMLV

SEQ ID NO: 1013668 - protein, 135 aa, Homo sapiens
PLNIWCRHGTTPARCYRYSKNNPYPKSRFCRGVTDAYIRIFDLGRNKAKVDEFPLCGHMVVTMNIMHLSSVEPCRLPEFVPHSRHGTNMLWTKSGLPISSGCRLQPSFHVIRIMPRCCSVLLEHDEVYAWSGPYS

SEQ ID NO: 1013669 - protein, 133 aa, Homo sapiens
MLSRLVSSSWSQAVLPPWPPKVLGLQARVPTPGITWLITMTSDVGAGVHACNPSTHGRLRWGNRLRIREFETKVWATISETPSATYKIQGKSQRGTRGHCCSAQPVPPKVDFGARRLDLLGGRRSAGAMARRT

SEQ ID NO: 1013670 - protein, 49 aa, Homo sapiens
MASGGGGCSAFGETASAQNPAWSRSPRGRQRDQKPRLETGDADGGGHNH

SEQ ID NO: 1013671 - protein, 121 aa, Homo sapiens
GSLLRGALRVHRASFSSSPPVLTWSFPSLSQAFMLESLPQGLPTRQFQAFPPDLLVCFSFSHCKRLLVAAWDDVPSTVPHPVPLVAEAIPVVTFECLTGDHNIRSPASDTVMPAWPDPLPS

SEQ ID NO: 1013672 - protein, 212 aa, Homo sapiens
PTREPQRGPQLLGAVAPCSRAGRVVTFDLLPCRARAVSPARQSQDPAASLFPPPLPAPSAMALVLQLGGGGGGPSGGLCAACAAGAGVRAALLLRALSEPLSAVQLRRLEEHRYSAAGCLAARACAAGSTGPGCSSVFPLWMAPNSITLAWGSPSTWSPSSCSSPTCPTATEEAPYLDIPLCALGLWINQSLDAIDGKQARRTTLVPLRGAL

SEQ ID NO: 1013673 - protein, 148 aa, Homo sapiens
PRARSLSPPLPRTRPAHASQRGEAALGEWLTVAGLRPPAAGCHQEGARVPLQGRVQRLRCEPDLVPVLHSAFRSHDMCGLCRQAPRESPSPVCHVSAHVPMLLEMPLTSSDPRGDHDERRHEGGRRGVTGCANALQRFHGNSSHEGSQ

SEQ ID NO: 1013674 - protein, 241 aa, Homo sapiens
LARLRRSDFQWSAVLVEKTRGLGDSALATLMFDEPAWAKAAPVVAGLGARSLGDLLLLAVLPRQITKETPKRPVESSIGPTVNSYSLTRDLTIIVLPTYRTKLVCIISEMLSEEDEYMKKIVPPYTWVIQFDSDGAACCNLAGKEDADMYMYNCCREASGTTLLARVNSERKRKLCTSDKYTNNATARTTRIHCLAHDGQSSQSKAVESQNAISRGHSDPKKTSSPPVIEIPSGSEGTLEN

SEQ ID NO: 1013675 - protein, 216 aa, Homo sapiens
METDETPLDESDGGLGECGESAWGGGWCRVALEAGAVRVAPLRPEGHGCALKLAACTAGAQAACSSLLRGNSGLVRRLGCDGAVWTHCECCREWRCDWPNASWRCALTEVQREGRTGQVRLFRASGLDFVISTPPDARVFGSFSHSGFLACAEVSPRRCEVDPCQGPRGYRPILQLSWLVGLAEQYFGVRVASSLYPFHSWLAAGNFGKWGQRSTR

SEQ ID NO: 1013676 - protein, 45 aa, Homo sapiens
MVPVRACSYRVTALVGSRSGISSYIAGGRRSSVTNYVGVGLPGSL

SEQ ID NO: 1013677 - protein, 133 aa, Homo sapiens
MSTQVRTSEAASQGVRPANAFVLAYAEDQSVVSSPWHCQCTTKVTLASVCEESNLAGTSSTMCMTYTERTHTRRRPQDDTFLHANLYTDARHSIDASRVRSPHLEEHTDSSYGLTVFRHCRSVAWNGRPGRKS

SEQ ID NO: 1013678 - protein, 134 aa, Homo sapiens
ERWLRRPEPLGRGSTGRSLPGRLRQALAGMQPGSRRLLPVACCLSLAWGWLGTKLPELDALSHLAPWADERLPRTPLSSSCGSVLAPASDEPEHGASIPTPQTTGERWSYVGLNKRKKCLGFGLEVIEQEDEAQ

SEQ ID NO: 1013679 - protein, 74 aa, Homo sapiens
MLLRTSHKYSLYRLHHPANTRTHDFLLTTISYSVSILSYYFIYGNVHVELERKKCFTWFALVRPEHADSTKKST

SEQ ID NO: 1013680 - protein, 73 aa, Homo sapiens
RAQEAGGRAHGPDGRPSGSAETPASLPAGPARHAEGSLDMDKTPKLLPQHTAGTHKPSLPPRPVSSLTSYLTT

SEQ ID NO: 1013681 - protein, 490 aa, Homo sapiens
GGSRSPGVAPLPPPPGAMGAPPELPAPQLGCISSHQVPRSRLPASCPVPMRIHCAPMSRNTSRPCLLGWRPCAGPGLCGLTPSYYHSACPNHQSDFCLHAWPLLSPLRVFHRQSPSPRVVTACALPCVSCHYASAPFLQPGLQPWTNFCGTHWLYPITCGSHPQFARNPTLVHHASTASHQRSLPPVNTLHGQCTIVNTRSQHLQYHTNHTNFNTATTTRKHHNTHRSIGLQAASAPAAYGATRTGDPSPRPANVAPDRHCTRLESPRRIAHCRPQETPYARHQSLTVGLGHVPGYEHCGEAHASGYATQLQALCGTLGPPVTPTQTSRRPLTPARRAALTNRSTVPFPGLLVNVATYPQPSHDNSRLSLVSCSYGMILTHYHCPTPHAAVNALVFYPHLLQVIYNQPIQYHTCTLHLPMGTDRPSCYAYHAQSLRSVLMPGPSKPPSALACDSLTAHRTHARHLALYTLSRLRPYHHMVLHDHHSHDLT

SEQ ID NO: 1013682 - protein, 182 aa, Homo sapiens
MTHSEPRTVNETKMQDEPHQPSGATATTPLNQNDEPLTEETTTRRGPSHKQHKHNHAADTAATHTTTNHHQNRHERQQQSARKAETRRERNTKQKKRRERQHNEGRRRTQDTETDRKKTHNEQERTRNRQDKEPEKETRAEQQTTKNRERESTRKKEQDTQKNDRRKAKVAKQQNTEQQNTN

SEQ ID NO: 1013683 - protein, 107 aa, Homo sapiens
MAEGGRFSETLTAAISQCKLKEITYKLMHSNAIVWNRGRNRFKYVHLSVLNSGFISYNRTGYINIKVHKQILPYIPPSFTNEYLYRSTLTRLSTNQTYKGYQDSLIH

SEQ ID NO: 1013684 - protein, 404 aa, Homo sapiens
MHARLSAWSLWRKERCVASGQIRLWDTPYTQENTIAKKITLKDDTETPYTRNKHNTKQKQQTPTQKTQHNKRKQRPNTQRPQNKKKQQQKKNKKHTLEKTNQKTNPAKHQRTTQTSTTTNQTTQRRKHTNRRDQRPNAADKTTQDKRRTQNHTEEDENKNTDEKKENTTKRQNDKRRKTTPTKAARQHRTAEQKHNQQKSKERAGATKQKGEQTKKEQQKNSKKRHGKQKPANRPPTHTDQSGSNPGHTRNSSNTHDNNNQQGNKAADQEAAAPKTERTKQQQQKRKQRKPKKPKTQHTPQNKQHRTRRGAQPEQHTHSTTNTRRTHRTPTNDTKERTDAGPNRKRKNGQTTQPRTQPKADRTHSNTNTQQSRPTTRNQQDKNHRTPAAAQTQTEQTKDTSTRR

SEQ ID NO: 1013685 - protein, 184 aa, Homo sapiens
MDIENSLTRDGGFPKQIGENYAKRKNHQRTLRKTKGSGITMTIMEPITNCGDVKPITQHINTGENNRPHSGKHTTWWLTPEGHWETAQGHIESQRQKTPATHNTHRQAEPTRGRHKKPQNYGKQGPTIGSQRIERGKRANNRTKRHAHKGNKDEVKQHKTVEAKQPGADKHKTEYTRTKLTTQL

SEQ ID NO: 1013686 - protein, 287 aa, Homo sapiens
MVQECPTVFHVPGASHGVVMNRDSSFNLVQQWFPVASAAAMNLARARTPAIPTAVNLADISNGQLQHAANELVPDPEQRWHLLDVNLAEHSHSHSAPAVNLDRVPEPQTDLADSESHRLWTQHQLLQTYPSSSRTPQAPDLWQTWWVLRYCNIDQRILVNLLDLVSQEPNDKHLGHPLMTIHQMYQDMDITGKYDLGCKSINQERHGDGATYDMTLRKPLDHRKRKQQHQHKHRIQLCNTEDHNEDHKKRATQHETLAPPERPQILSAVNHHSVENPGGASPQFYPQ

SEQ ID NO: 1013687 - protein, 56 aa, Homo sapiens
MNTCGNVGARLGRHELGKTRVSLGDADTRLQRMREGDYSGNREKREGGTPTHRHTT

SEQ ID NO: 1013688 - protein, 147 aa, Homo sapiens
MDLQRNSDVLARRSADPCIHLLPMNYWHPLNAGHDSLSTLHAWTREDHRAPPVWPHAPVRAKPRCTTCPISPGMTERPYATHSTVQGQRYIRVRNMEEHKPTADMTQVDGYTNKIKRYRKSKAQQHPTYPPDTKPRETTTNHITHDN

SEQ ID NO: 1013689 - protein, 70 aa, Homo sapiens
RRALRRHVSSCRVTDFFAAPPPVAYSRIRPIHGCTVEHVSIEVEDELLDINIEINYYSEQHIPTIHKTCH

SEQ ID NO: 1013690 - protein, 183 aa, Homo sapiens
MPSSPSERDTGDPGGTGEEEGAGQLRVRIGRVATDVIASGLQGAKAPYPQNPPANRLDRPVGGEAVSQFGQKDAREGPVLGGRWNPGQHKQCAGAHGSRAIVVHKSPSHGTGTGIFITRALALVCGAFLGVWRTPNFPWGALCLPERLGCVPPGLAGTPLGKVWALRRMATPFGGQILAFPSP

SEQ ID NO: 1013691 - protein, 90 aa, Homo sapiens
LVPSGFRDLPRRCGSGPAPAMARLTGELRRAVLAACSSCSRVPSPCGHAAGPSPPGGSPDGMKDLDAIKLFVGQIPRHLDENGPQAALRA

SEQ ID NO: 1013692 - protein, 125 aa, Homo sapiens
KVQLGPWLQRVQASSLGSFYVEFNLWVHRSQELRLGNLCLDFRGCMETPGYPGSLLQGQGPHGEPLLGQCGKEDVELESPHRVPTGAPPSGAVRRGPLSSRPQNGRSTDSLHMCLENWQTLNTSP

SEQ ID NO: 1013693 - protein, 446 aa, Homo sapiens
MPPQTYNTRRTHTRRTQTRTWRDEPPYHTRNWPNTPPLRQHKHRPLHSRAPIALALPSPHGFPLPRNVVLRDQNVSSQHRKNNNQRQQHENAANAKIDTNKHTQQATTTTPRKRQTQRRHKTNKKLEDIKKRKKKIKPKKPTNTQKDGKKQPTTGRGLSTSEEKESTAQAESEAKRKTERQHDNKTTRDRATGAKSDQQTQARRSNATSVWSVSGIHGGAVDSHSNRGVERERSDEDKRRAFGAGRSISAIDLKEQTNRLQWNKVTTNDEEQGELTCVNTDTWSSREKRTGAGAESARVEWSMRGDGGEASQQQGEHTAEEETRDATRTGGAEHEDNGETGKRDNKRGRTEEKKRKVGDHREDKEQNRESDGRTEQTQRPQLAERGEEREGGRNRTRRERISDRTKAKSNKPRENLEKKKQKRQRQRENGSNSERARNSEQMKNRA

SEQ ID NO: 1013694 - protein, 135 aa, Homo sapiens
MGCDRWSPPLWACAAGLAVARPPNIVLIFADDLGYGDLGCYAAPQLLPLPNLEPAGGWEWLLFTDFYVPVSLCTPSSGPPPDRPAPGSGLGMYPGVLVPSSRGGLPLEEVTVAEVLAAPGYLTGMAGKWHLGGGA

SEQ ID NO: 1013695 - protein, 207 aa, Homo sapiens
SPLAPAEVLYRGPGPGLRCCDPARCCRRWGGAGPRRKPLSRLGWAGQGPGAGLVLAGPCSMASCRGLGLGGTVVWSAGNEGRPPGSRRCGARVGCGLYVSAGTRVRASDRVCSCEARVGRLVTFGMSNVVDLPPGCTKQCPCIMPQGPSPACPSSERNGDFVSVLTPGSYRLAVVLGVSSEECVGERSWVWLLGRRGRQGQQPLGRP

SEQ ID NO: 1013696 - protein, 157 aa, Homo sapiens
MISPFLVLAIGSCLTNSLVPEKEKDPKYWRDQAQETLKYALELQKLNTNVAKNVIMFLGELAMRLSPHVTAARILKRSSSTINPMGRTTSAGPLDNVPHSWTFSNDVQHHMPKSLISAGTCTAYLCGVKANEGTVAGEALPLIVPVCNTYPGELGHL

SEQ ID NO: 1013697 - protein, 48 aa, Homo sapiens
DDFYIITEGTSVRAAAPVPPIEEYVEVGRPGDPLTIVLGRLHCMLNRP

SEQ ID NO: 1013698 - protein, 234 aa, Homo sapiens
GSLRAAGGTLMLHCSVLRRRLWVLVCGCVVLAVGSAERLGRGVQPPAGTMRARLARALGVGPAARYPPYCPERMRCALRAWVASDSGAAYAMMDEPWWEGRVASDVHCTLREKELKLPTFRAHSPLLKSRRFFVDILTLLEQPAASSALHPGTWPSTCVDHFMDPLQLSTPPSSSTPVCPSPCLPCLQSGVSALYRPRLDSCKWALIFSIICNPSTFPRIPSKFLPCYQAPQNP

SEQ ID NO: 1013699 - protein, 274 aa, Homo sapiens
ADLKTCKPVLNPGLGSWWGVCYEEEHPYHSVTAHTRSPVPLSTWYSAQRETPMIEDDTDRDAQEHPLRTHSSAAVSIPCRRPPPSAKAVVSTTLEAGVGRHAYQRLHMIPEIAAAGEHLGGRPSNQGAPTEKVAGKREGLGGLTAAVSNDLEQGALRETQGDFSGGPRGHRITWYAEEGRSPPFSGGRPGRLRCLETRACEAHDRRSCRHPYKEGTDGLRARACGEARHHRRLAFRSTLSGNTRGALPLVARQKRGRLRRGGKGNPHEAARGDF

SEQ ID NO: 1013700 - protein, 69 aa, Homo sapiens
DNGIMIAWKGIERLRAGLGILHDIEGIRYEPRMSSWSRHIKRSWRSFHNEYQQLKMADYDFRACCKKSP

SEQ ID NO: 1013701 - protein, 366 aa, Homo sapiens
RLETRHLISMQTHTHTHTHTHTTHTHTHARGGRPERPRSRKKEGKTTEGIGIKYRHDKREQGVQRKTEKHIKHTTPKQEDTNTQTRRAKKRERRKTKKTNETQTQTQEDTQHSGSERDKHTTDRPGERKPQKKDKRKTRLDEKTSEKKKNAHDTKTTQGTKDEREGKKRSKKQKKKETKEDKKPNEQEQEKNENNTKEKRQKTKTKRKRKKKAEERRSGPEARKREAAKPQSQKEADRTRTPRAGTRQEQRREKDDARQKNREKTGEQKGTRRTEQTIARNREAKEREEREPKRSTTGEKNTQTETRTESKKKKEEHERDAKTQNKNSKRKRQNKRKGKANRTPKPQKHKKKTKKKKEKTNKEKTE

SEQ ID NO: 1013702 - protein, 253 aa, Homo sapiens
MAHCEEMKKGLRKRRGAASQARGRDSEDGEFEIQVRKDCPWPWKSGTWNDPVAPTFPTSECTSDVEPDTREMVRAQNKKNEEVVEAFRVLVGTERTRVFERQIMTGMGYKVPTPIQRKTIPVILDGKDVVAMARTGSGKTACFLLANVQERAQVPQCPDRVPWALILSPSRELALHDPVKFTNGARQVHVASKTGLILGGDRMEDQFGVLDERSRHNYWQARTVEHVAVENEPESAECGIRRCTGEELNGFYE

SEQ ID NO: 1013703 - protein, 333 aa, Homo sapiens
RAGASGPLLVGGSRGVSAPACLRSTVVLVAEPIGVCCLGHVLQYNGAPCCDVQACAMHLLKNAAEMCSVEQMEVLNAAASPSETILKSSVDKRFSGCITDACWMCLMLECPSTVLWPWWTLELTIEVPCAWELPLVKGEAADAVHAGANCCQPRYGRTHAALARHVMAVHAVRPHVSHCCAAGSCAKRVSGSRPVGRWGSRMGPGVMKADAVRQVKPKWPPACACVTERGAKGRARPRREDRIVAADGRRARNPVCRTEPTGLQPDGPKKHRREPGANRDGARGTHKPPGHHPERRVKPMADRERPSIDGTARATARRVRYAEAQTRRHRNAH

SEQ ID NO: 1013704 - protein, 158 aa, Homo sapiens
MYYPTNHQLQIQHRHDIRRNEWHYYMAPTIRTHIVHIATQLNEHNINETRHTRDKEQSASSSQRMSAWSPHDYVHRRRAHDKRNATQTYRADTISATPTRAYNDSSIRLSKLHEERSEAAHRTIRRKARRGVISSADEATENDRRSMRSSSTNPWSHS

SEQ ID NO: 1013705 - protein, 211 aa, Homo sapiens
MACAPLWTLGTMWLALVGVSLLRWVHTKAFCMAVQASSTIYQQSLEGQLQFPAGENCATLVRCTWISAFPAEFDLNPELAEHDQGAEGSAETKKGTDGTAAYLDIDSVPTYKWKRQVTQRNPVGTEKAQDVPVVRPPGAHGAWLEHLTYLEYTLLLQDPVSGTITSYGDSWVHCGQRRSWSGSSSLFNSGSTGVAAHDPPQNQDPQMGLVI

SEQ ID NO: 1013706 - protein, 263 aa, Homo sapiens
AGLVRARSVSLCTDRGHRAVRSQCVWVLSDLDHIVDIPRWRPWWPRMKPYEDLDEGSRMEGDGHFYAMSLEQHRWSALLERTQSTCQAREAARQQLLDRELKKKPPLTGAHAPKPAAAPATEESEAVEAGDPPEELRKNFTTYMGGWTSECLTERIRGKDAHPPGSKNPHSEGAPSTRQAHREVPWGSAAKRGLVPVVITGDNISTGLPNKGKEKEEQRGGPKGAPERKRRPQEEKPGEGQTSIEARRHGTKSGTPGAQGTQG

SEQ ID NO: 1013707 - protein, 382 aa, Homo sapiens
MASHHVHASSSSSSSSNRQQQLQAVTACSSSSMQQLQQQLVTACLQQLLQQSPPQAPLPSGCQPGCSPRQHATAGLLSDSPWATNIKPSLLNWLHCLLRKLLLQSMQFGKELRPRLQCHQARVLTAGAVHHAIAHDAHTWCNLARGYWQLALPGGHQEGPTGTVETTPRNWTHYANFAHDVILLPHTWPRQTHGTIWHGSTRSRRVVCEGTPFGERYFRKEFKARISSEGDNTREVNSRGPWEPFPDTEFSYTRRLGHALRTAGEFSVTFRFNDAYVACVEEQSMSEGAPSAREVCSARLAQATGRKGSRMILRASRPAKSTAEMLRRYQCPRERSNSLPGGYTKGVASRTAIDALEDLLVRGFRRVRPDTEECAWNPYQSC

SEQ ID NO: 1013708 - protein, 121 aa, Homo sapiens
MGEWAIREACHGRYNWCPVRDWYYLDDLNPPVWLADPRGAGKRTKTPGKARPQKAKQSAWDYNCKGVGYEDYPSGQETTADRSTLQKAYKGTPEMEDERRRTGERHRRNNGLQQQSKWAQH

SEQ ID NO: 1013709 - protein, 223 aa, Homo sapiens
CASRRSLCAAAFSSISFPPAPAVRMATPVTGHARSGSELSVRVLCGASATWPECAEELQPALALTQLVKDRNCGHAPATTYYALAHTVAPNTSMGRMKFQHACKHYYRARPPRRIYYHNPGILHGSTRLQKPRWMNLGLQNCQCELKDHTIRDGGKNFGMETYEEMNRKTRLIEPYGRNGKRHRNTARKKRMKSHMNIKRGLNHDGEAHGKVKNGEYVASKWK

SEQ ID NO: 1013710 - protein, 59 aa, Homo sapiens
MPVALRDVCWGLRQPAPALGDQLQGPLPWLGWACNGAWGERVLVCMACGGPYMGHLLAR

SEQ ID NO: 1013711 - protein, 202 aa, Homo sapiens
ICGLCAKLAILSCGPPWPARTSLRRRRAFRDAGCSGGSVNGASVVRWCCCSEALAHRKSLVMLPWSLPWLPWSPICLVTGRCWKCNLPVPRGCLLPPGTPCALCAPWSASPRRRRRPQIAQSPAVACGMLPTDWSPLVQTLHGPHAAHACQVPPTETNDPTGAGPMEAIGPYIRGYLGGPGSSEEHNPYKNTNKNMERIQEH

SEQ ID NO: 1013712 - protein, 267 aa, Homo sapiens
MAILQLKQQLWTMLECSTRRWIAHASWMRCCCALALAVCCGTGQERELVPMLLALRRTLIPCDACRPVTCDCDDTKIHAMALARHMCSETYFDCSPHDRTHLTHVDCDGGLQDIGEQCCMLLRREKLPPGVDLSDLQGRVGKTGIRCDGGTGRGGPVRQYPELCQHYDGCFLCGHAKAFQLQVQRIEQTAQSLAQGTLDAANSTFRGKQHYEGLRTKGFTLPGMRPFPLKEQIPQENTVSHWSKGPTGPHVARAGTPWPGQRLSVNL

SEQ ID NO: 1013713 - protein, 284 aa, Homo sapiens
MRPADTLLPLRLFSPSERSLGLGDRPGGHWLDTIASTPILCAATCRTILSCGHDYMPLACASQRGITWPHSELIPTGLRTPRLFAIMGSKVPTEDQAPIRTNLTVRISGRRLDVCNLGGNTDGNDSQGTRHIVKEMTTGELSIPNHIVSIGDRHGQRQIDILPERTQNSSGWILDLREGLRRCRDARVTPFAKTRRRRTRTEEPQGTKSESHNRGEKTKRRRRTHKQQENRKGHKSHWGKRHYDHIAGQSYEIIRQAKLSIPGDDHQLPRYTQNLYTHTAKRYQ

SEQ ID NO: 1013714 - protein, 201 aa, Homo sapiens
ARARRAQAARASNGRRVHRRSARPAAPIGRGGPHLSAARPRGRSRGGLCDAQTPRGAGDWSVVLSRLLAVGGEVRGDTWSCFGRPCGSRTSLRALPVSLDGKKGWARPVSVPIGTPSRAADPSQGEMSADAAGGVRSLTRGSAAWRRVRTGYGIPAVDGGEGQVGPMYIRLVEPRLAGREGGGCLAGDRWLEVNRENVEKE

SEQ ID NO: 1013715 - protein, 32 aa, Homo sapiens
TFTVSTLPSFVPGVLSPSPVSRAAGGGSRHRG

SEQ ID NO: 1013716 - protein, 189 aa, Homo sapiens
RGGRITSVSGQLCSAVVCLQRADWSGGDEAGGVWQYVGDAVCWHKSSGLGEPGSSSNSSSSRRSRLPVNCGPYPRGLPSLAGPGKPQLRVPPQSAVGDGQAVAGPAVPRVNPRTVPGPELDHEPSSRNHLRSPLGQVVTQPESEYDKQKNNTEKKKREENNNERREQTAKKQETRRKKKQETEKRKKTR

SEQ ID NO: 1013717 - protein, 174 aa, Homo sapiens
VAALPLLLLLRLLAEAGGSMRRAGGLRLMRAGVMVSGAGRGNGRKRARSAQSALFRPPEEPNAAPGPAACRLALPDKSLRCLAPTAHVRRHAGMRATSLSHEPAAIPHHDTCGPSADFPRELTFNRAIATDAPGVDCSIYQRYTLVTASSEVDLLHSKRFLVRHPYAKFLPMCS

SEQ ID NO: 1013718 - protein, 270 aa, Homo sapiens
ATLGWSETLSQNEKKNKKRKEREMGERERERERDSETDTEREKDKENGRAQCPLLQPCRMLLACALEGADHSPFCPCYILGASLYLCAILPAVCVPACASWICYCAFLAILALIRGAFLFQRTLCGCKTPSSLYLGCTWLVCAAAGRWGPAGCSHLLLHVCAADTSPALPGEDPCVTLQPCAMASCPAPCVYPALLRACASVMVVRWQPAREDALHWSDSVPARALQLTEDPDHVQLWDRQSYHQPLVNPLAAGQRWAPGAYREGGVRRI

SEQ ID NO: 1013719 - protein, 310 aa, Homo sapiens
SLSFPAASGRFPAAYFLPGSLAPHLSGLRRLKPLGNMQQPLPGAHAEPRSPVRPRPTFAAVRTRDPCGIPCIRGPAKWWSPETERCGRALEAEQGPRYVKKPCTWPTPCHGACAAPCLSKQPLFSPEISPHMGYTATSQHEPLPGPLARPAPSLGPGTSSERLNQTLLSTGPCGSPVPDGTCPDTLLWTWRPNERAGAGSHPHKRKNTFLREPHKPQNTHPGEPQTREWQQRSPRNPHMSPQTTQTQRHPGDHPKPPKIQPTEGTHRAPAADHSPRPHTNTHGTNTTRGKSRHNTPIPKSVREKYEQHKK

SEQ ID NO: 1013720 - protein, 114 aa, Homo sapiens
WEDGCDSVASLMRRPVGCEPVPPWPRDLTEWSDCAVAWGVMVSITQLHASMSCSLPQTSPDSGCLACCLIPPVQPCCFWCAQQMGGTWPVVRMAPVQVSCARTCMLCILGTCAE

SEQ ID NO: 1013721 - protein, 210 aa, Homo sapiens
AGSGQRRPWWRAMLAGDDGAGPSSFVRPALPLVLAGVCRGCVTPGCGGREHLLAQCCVESGALCQLVVGALVLAGGALNCMPNALWLLYGVPNVTWALEVAAAVVMATYPLARHTRGTRGGSTPGKGLGLCGVRLGLVAMGPRKWETPVRVVWLARNMRPGGSITLWGHMGKGWKGHWVPNHYTFELLNTGAPEGDIYFKDLIGCTRGAL

SEQ ID NO: 1013722 - protein, 33 aa, Homo sapiens
ASGGLRRSERGSAAEGGGWLSGTVTCRCRVRAE

SEQ ID NO: 1013723 - protein, 275 aa, Homo sapiens
SGNQSCPLLCFVPVPPVCCCSWELSACWLLGGSTAWHNNVWVCVCTAAPGCHVGLPGWRGGVGCGSYLPEEAAWLCVLLELRLDFPAWPVAPQAAGSTPQIHLDSRFGSQQCQLHCHPKVLLWKRTWWCHCCTSDDTKSQIYLTGLRGVEDCEAIAYRDWLASSRASEPGLLALAWVEPGRAPDDPQWNPGQSCQGPGHPNRLPSHGPSSGEAWERLAGLEIKPKLLKVTHRRVLPGVHPGYLKAAWTGNWLTWAAWESAWAWSGWHLSGNAHTN

SEQ ID NO: 1013724 - protein, 249 aa, Homo sapiens
ALPRWGSLCGAREPGLPPVNAGAARYCRMQPRVVGDPCCSSPVHTGELLLRCCVAVVAICAGVMAPRSSAGGAALSHGLLPPASRVANEMLGLVMSCPDLDPGDESPNVTRSGNQHRPTRWGFQNVSTAAAGVLASAQAALQLCYHAVLPFSADSLPALQPGGPPTDVCCTQPSLGLPQYLHSYTPTWLLGVEEMGTDRDLETACKSMLDDQGGKLQGPDMVGAITALEGTHPGRPHDILAYPGANPPI

SEQ ID NO: 1013725 - protein, 109 aa, Homo sapiens
PQCDACAGADVNAAGRSFTDLCTADPAEAESSRGSWIRLLCLSPFCVPAMDNSGQGSWRRCALFVPRAERKVKNSTVLLTLCLFWRLIQNRGSMRNLRQSSKQCSQMCQ

SEQ ID NO: 1013726 - protein, 225 aa, Homo sapiens
RGAWQEFKAAAFGEKELDAQLDAYNGEWTPVKQTSKSCVRNMDPVRLLLLPGKAGRGGCGCAANDGFVSLMLLKYGFKKLMEQVLLYLFASNIFFIASRNPHLCWLTPSVPYCRAIQHLYTWVVRVMVAVSTNWARARIARRINRPHQYYNYLGTYGRVIDTFVGNNYNHIGSRRHNQGGRARQELDRNEISPDSSGDDQAPVHDESTPKVLVIGEKYIQVMGRQ

SEQ ID NO: 1013727 - protein, 279 aa, Homo sapiens
MDLFVLVRLEDARESYCVQNQSVPWTVPCWELDLRATETRDPVRMKIIADIQEDGQAMAMMDAVFCISGKDDLCAAPWRYVRKFVYDCGPTSIAVSLKIQTTQCPTTRWPQAMKGVTKAMGTMNRQLKLPQIQKNHDGDLIGHGRDHGYEGGDDVTDAIDDAHGVLRKDEEGDVMAAVCSPGFLAWRLGTLSLTQHAAVRNLTLKLWGARLQWVDLAMVGDNTQHDGGQASKRLSWIARVTERLEGTRLKEAVRDGELGCHIAKIRVNNPCGSPEDRVP

SEQ ID NO: 1013728 - protein, 96 aa, Homo sapiens
IGARSGALMTRKGRGHACDVWSELSETVQGSETAPMCGECLKGLWSLSCAGGLLVRRLRPWFCCRLVATTVWRCLLCGNCLALLRFLAQCRIGVHL

SEQ ID NO: 1013729 - protein, 143 aa, Homo sapiens
MKEWLLLLGTHDGTIRSGLEHRAIRLKARQWSALIFLCENSRVMSRPNESVSSVSMNDHIGHYLYYITEVSMIHTTEVNLGMSPTISGEMVIADKHAGENKDGVNFDEPQDGDEKKAGKMAENVCVQYSSTIKRWAQTKYYVT

SEQ ID NO: 1013730 - protein, 129 aa, Homo sapiens
MALQRNDHLAWRVLTDLFPSLGLLHVGSTVSPWEQSLVNPPACLSGFASIRVRHSGRHQGGLGNGPRPPFRRRIGMAAKRIRRHGGALRESTMATNTARGTRGPDTYKGARQSEAQEGTTTWHAGRSTA

SEQ ID NO: 1013731 - protein, 334 aa, Homo sapiens
MALPSPLMENHGCRCSVLVPLCMMDLLQVDPDSAHYQRMQPKMYEGHANILVPLSYPSHVGKCGRSILTRPVHGPIGRADLVHEDPGEGQLDKGRLSRVITKERGTGKGLTKDKGRAGDAARGPAHRSGRDGPEKHERARGNNRTGYTGEQRSASPALARSYRNSTNKDTRGNQFDRTRALRYIAPRGAKSQSEGRTTEEQRIEMPRVRKSTYEKWIADKTKTVDRIATHKMQPPENKNAELDIGKRPPENKGQGNEDVTPRENVFKRNLKQTQRYTERRINTQPGIEDDYTSPNEVQHVTTHTQQAKASTTPSKVQKQENVHRQLTGGCKESA

SEQ ID NO: 1013732 - protein, 119 aa, Homo sapiens
MAAVRAKRPRKQALCSIITRKKIFLDPSRCFLYSSQNTKILNSGLGKCLYVCLHRCGVVLAYPFSPVTFPVISETVGIIERSSTKELTLRVICGHGKRHTLCLEVLRAFSKFNAQRETH

SEQ ID NO: 1013733 - protein, 168 aa, Homo sapiens
QTQWRCEGCCGCSPLPCCPLCRGVMRADHALLICPWAAVVPAPGRWRVCARPSLDRSPWRLGPGFRRRCVGPPLHGAEGLAENRVLLLPVRVLGGALPCLIRSPSSVINNPYSSFGATLVRDDEKNLWSMPHDVSHTEADDDRTLYNLIVIRNQQAKDSEELAGRLNY

SEQ ID NO: 1013734 - protein, 65 aa, Homo sapiens
MPLDKYAEDPMGGGLALSWWGYPQCKLSAMDLGQLLRQAGLMKSTEPGEQPEIIPLASDHRMKKH

SEQ ID NO: 1013735 - protein, 178 aa, Homo sapiens
VRGSLKRKEKKVCAELPGKQGPPDSLPGWSSHRPAAPGGRRGTDVLLVGARGGVAMQLVDSARRPGSGGSRGLRLRLSLLEGRRVVRCASPDLFLFQKRARSGRHLIHVLSAWLCDRGRGREPQWSINHRTVRTLRDVPDHLRKCVKGRPFNNKPPCVTQRGPWPRKSPIYPDQNLYR

SEQ ID NO: 1013736 - protein, 282 aa, Homo sapiens
AWRPARALGPAGPRGASCGRRRRARLPAAWAHDDEVAVPAAGRRPEREKLKQELCAFEARLWSMASRISPGPLAFDPELRIMAIATRSGAEKIYGAPGGGVHRPCTVDAGHCHSEMHLLELARAASCSPALMTACSCILWGDGPTSKWLCPSWKNARRSSSLPSRPGLDWCQCIRSGFSRVTVVLLVAAGDFSSAWPLRGSHVPPSWSVTRAESLLEGADGLPQGEVLARLCPRRTYGCWEGHLGAHSESTIQGTPCRGPHKRFLMRYMPGACCSSGTRPRV

SEQ ID NO: 1013737 - protein, 190 aa, Homo sapiens
RGQRKGAVVCDSARTCKHRTGAAAHAALEGFLLSGSATSMGICQGLHPLTRVTCGAAPLPRWSSGIRIGIRKRDGAVHSRSEGIHDGATFCCIAGNEWPSSTSWQCAPVWSNHCHVGYNQKLLALERQKPGSPVVKLAPGHQGTMHNAVIVTYIIPVDSREMTAVWNACAIAGFAMRGLISHRGHSRACR

SEQ ID NO: 1013738 - protein, 245 aa, Homo sapiens
SWYGLEFKDASPRVARVLTLMACSFRERSRTSDPDSVTPARRRPGGRLEAETDRSVNSSSWRRLLRASSPRELGSAPWTHRVLISISHAADPQGPRTQRGGITLHKNLLDVLSWLRNGAAQPLPERALSPELIPVRLEKQTSQYSQPSRPLYSIRGILVTLRRTCIGCRGPMPCHVQRGAELYRAACIPTLWDVGDIVATAENDDRQDRAQHKVPNKSCITRHHTDASYPRFDIFERSHAASSSQ

SEQ ID NO: 1013739 - protein, 195 aa, Homo sapiens
PRAVRSGVYGVRRRRCCPVGLPVRGSALAARPALSPGGGSGSMALWRRLAAAAGVSATVGLRVPADRGWRGGGWVPWPWGDCEPVRMPPGSWEPCPSRMRCPLLSPERRQPDALGPLGGPVAACGMSRLLGGTLERVCKAVLLLCLLHFLVAVILYFDVYAQHLAFFSRFSARGPAHALHPAASSSSSSSNCSRT

SEQ ID NO: 1013740 - protein, 72 aa, Homo sapiens
RLAERRGAADGSGTRLASSDAGRGLDLGSTQTQEQMSTDVCIHTWVHLLPGAQEAMGYWHTLSLNIAVASGA

SEQ ID NO: 1013741 - protein, 183 aa, Homo sapiens
MSARSRHERRQQPLVGAAHRLWDPDDRDINRSPQLLSFSVRLSGYCGSPWRVIGYHVVVWMMAGIPLLLFRWKAPVGGVPAAAPALQTWPKPKTLVHRNRRHKRIVPGSSSLSRCRLRPIGEGTLADVPTSPRQRMAGARRGRWGGYQRVPGRIRPSHQAARTAKRVLRKYLFQGQRYTLDRD

SEQ ID NO: 1013742 - protein, 249 aa, Homo sapiens
MALALQSPAVGCCSRLLLLLRLLLPPRRLLGLTAACILDRAVVPAPRRPGPAHGCPVIISSPGGAHLWHPGTQCYSSYKAVKTKNVKEYVKWMMYWIVFAFFTTDETLTDIVLSWFPFSFELKIAFVIWLLSPLHQGAPGVLYRKFVASNDCPTRQNGDRTEYITQCPRQELCRPMMRVGKMGPEPAANANRHKLDAKGQGGCCQKNAPQTFSDARNLSPNHGDEERQWTLTAGPYRVRDPERDPRQHI

SEQ ID NO: 1013743 - protein, 263 aa, Homo sapiens
MDRELLRGLLLLAGAGACGLRAGRRQAYTEYGGGMAESEAETPRTPGEFESKYFEFHGVLCMPALLPREDGVRSPTSRCLPSDVWIVTYPKSWHQLAVQEVVYLVSQALTPDEIGLSEASERCSSRSMEYPMRGLDIIKGTDLSPAHQGATLALTALLPSDLHNGDSKVIYMARNPKDLVDVLSSVPPVSADHELPRHLSQNSSRRVDWLISLGYGILVLSTLQGVLGAPAWTRHVHFSQGIEDSAYGDLVTDWWRQAGQIPG

SEQ ID NO: 1013744 - protein, 149 aa, Homo sapiens
MNTSPVSRVMFSPRRSGGAVSGGVWGPETGSVLRRCSAQAQLVQIVWRSSGSCTVVVAPRRGHQRMPCGDEDLSGWRRLSVDQKTSMVVISVCEQGRCGLFAVLPYPTRGMPIRSSSLRTNNGILSPRTRIGRAGTHLMKALVRSSKTA

SEQ ID NO: 1013745 - protein, 266 aa, Homo sapiens
MFRRPGTGGGERAELALPLPGRRLQSVRAVPVAANCPELLAEAEGDVRGLHLEGACRAGPEEGALPWLTASPAADWGAGCGPGKEGWSPGPAPLPFTLPWYLVWARSWVATTSGHWGISSVSLEPFSYPPDARSWSSSERKDEFYECFVECSDAKHPLLDLDAGSNFTSVYTFRRASKMCLGSHVIFSRVVFQEFLIRYPPRQAWRPTGFGAIHGWQVVSFRSPEVSRQLIVLDFEATCDKPQIHPQEIIEFPILKLNGRTMEIES

SEQ ID NO: 1013746 - protein, 333 aa, Homo sapiens
PGWYWSGMYGIEKLVVCRVLVRSRTHVWTCRGAGALRVAGIEEPRCGGDMLAVACVWSAEPGLPPMSRRALAGGSLAYAARWPKSHSFFSLLKKNGRSENGKGEPVDASKAGGKQKLVGLRVCCSAGMLLATVKDNAVANCVSACGLGRCALWVRLESYPCARSTCQPCECVKDGDAQSRARSRRSHSQDAPGRPRQAVGEYYCETKEGRRQGSQTVDKALFPVDHANAWASVLKTSNPGPWLAYPSVVPVSRDVTRSRDRKCWDRTKHLFLTREGSVGRTIAFFPPINREGSQWEPQSDPKVEVASGYKRVWTSHWYTLEKDPIWFGIPRRN

SEQ ID NO: 1013747 - protein, 136 aa, Homo sapiens
KRLYGLGFRMRRGALGGSLAAGASDPGSLRAAALPGASRRGPPAAVRGGSELAAGCAQPGSCCGAATAGNATRTGTRWRSWEAARDRSGIPGADARGWLRTACLKESEQDVEDSQNHTGEPVGDDYKKNGNTFLVN

SEQ ID NO: 1013748 - protein, 194 aa, Homo sapiens
AGRYALPCGEAPVCPSCFENRVSDAGSSLWPGHWKGRHSLGRLDSTELNGRDQTSDELCNPLPNTPSRCCRRFQPANSRGGCLDPVPSRRTDLGTKRRHPKGRSNAAWRLFVIPRTPLSPPAPPPLTRNLKAFFLGERLPQSWKTPGSLQAEDSNASKHALHHDPSWRSLRRRGMSKLAHGHRGSVKAAQQPRA

SEQ ID NO: 1013749 - protein, 146 aa, Homo sapiens
MRPPPQTPDGVRLTGNCAGPGPGKDRVQSPSSDEEGVTNEAIHEQWSHFLHQRDMDKHDAIEKKSSANGMRVPRPDLRELMETMHRMSHLPPDFEGRQTVILCWLQTLSGMSASDELDDSQVRQYCCIDLLSQALSERLSSRFLHA

SEQ ID NO: 1013750 - protein, 302 aa, Homo sapiens
RWYGQDLGCMDPTSRSNGTRKLKGVAELGVTKRVSARGPAGFRSSSPLDLFSGPLALILRTRRPPHDLFSQEEDTAARTIDKAETPGKQWERQHKMKRRRQNAGGLDEVGPLAQAVLLTKMHGVSGYNGQRILKDSAITKPNQAEQSVMDSQPMTYLRHTSRAPFTTILQSQPGTKLAACPHVSEHATRRVSQQRPRLGLVLCCPFGDTAGNTWLLTPLHLAATRLLYRTCVPSFWNLIRRPIVLVLSLGCLAPTIHEPLPPCPLRACDTSVRFFPEAAPHCGACVVVTRFTRRRLSSLRPP

SEQ ID NO: 1013751 - protein, 210 aa, Homo sapiens
RLYGSLGSSLLFSSFIALLLLQCDESESSSHPARPFFLCLRCFYFSFGRAPLLHMLVSVPLFETPKSFPHAMAQAAWVFLLNVNTVPLEKFRRKRGDALPDSYGADYLTDELSVAKYTTIPGGPRKQCCYREQFDFNAEPPCEPELMIGGFHLPICPFVAYSKDPDIGLMARILSLPGLMTYGLWNYGAMKGWIDDANYSVGLLDEGTNL

SEQ ID NO: 1013752 - protein, 309 aa, Homo sapiens
LVLVLGGLGSQNVAKATPAVAGAFGKVTLRLSFIFFYAMMCVTIEKWSLPQKCPYKGDHRNGLRCIMVFIHKSAIFFHRTVHFETFKQVKVHPCIGMGANYTRFISLRGSQSIINSAITLMPCKAVLYKQPVALQIQWVYERLSCHQHKNQQVEGTTYHTRTRIKTRSRIPDNETSPLREYHTVGPQSEHPRDKHTMRDKSITSTSTHRETDKTSSGREGKKNTTDKRPHKEGAHHGKTRETRRHQKKKQHKEGNPTSSATTRQATDTITPRITPVQTKDHNQHPNNKWSRRHTERKQHSEREQRREEP

SEQ ID NO: 1013753 - protein, 274 aa, Homo sapiens
MGVFPLPPLAPISSLPPSLSDSDSVPVRDELAPLADFAKRAPPARSALTLRGTQPRRCHSRGEETRAESELARSRSVLDALEEQGGHPDPIFCLIPHLEDPPETPASEGNMADKLKDPRQPRGFHEETAVKIRKHVPQISQTESADDSVKEQKSMTIHTRNDQRNTYKRHSVQSTRQQRPFKTTNLDKEQNAMSPVYDYWQNELNTKTDQTPAQPKQEGQKVNSPEASTTARKSGDTERKRQQQIPERPHNKLQRKDIQTKHQTRNNQPKTENT

SEQ ID NO: 1013754 - protein, 167 aa, Homo sapiens
MTTRHTLDMLLMALGLLAWGSGAPGVTCCAGTLHGVARASCGGQALVLLTVCPGCWLGAGLGAALRGLSLSRTQVTYLAFPRRDAAPDAAHDQSCRWWSCSLGVRAPALARCPACLGRLGGIDCLTYYGLNHNLSAIGCSPWTLAFIIQARIRCADPLSPSDLGAGG

SEQ ID NO: 1013755 - protein, 81 aa, Homo sapiens
GLILVYNENHAGGFEQVSPIPDVDIEAARTISRRDVIRPCKTYYAYSDRYVGGQLIKKYVNESVKLQQREERQVFLMNRYL

SEQ ID NO: 1013756 - protein, 387 aa, Homo sapiens
MCWLLVLGIYGHRGRACCLVSLACADSASWGRAWASASTWVSIFGCLRCPRHGCARFPPLSPSGVPVGVEPSSLRHVLPMPALVPPCAFCLLDLPLCESVLSCVMPLMCVLGCVTLCVPLGPLLCMPAPLLLSCGTQSPCGPQCSGMAWQCLCRFLCSLGLPARVLTHLEPCAALEPPRQACPLSVTSVSPEFALAPPWDSMIPGPNWPRFSNCALRVENFLAQRVHFSMNASGAPPCEYTGLAVMSYMSICLSLEWDPRGLHSGAVVSLALVTHLCTDTAGEGFRNQGPQDNLSVHLVWALPRCMSKGDYSRSGRLCPLRRMSDSSFQLVHHIRGAAAKEVPGDQRISRRRRVEYHKVNRSGKGILGSSAHKVQRDTQHGVVGVTN

SEQ ID NO: 1013757 - protein, 90 aa, Homo sapiens
HKQAVLPGNYGIPRDRARGSKYKKELDYMNAHPCQDERPLQVRRARSQDSRAAASLSEAWLRCGEGVSEHFWESVITQLKRRRFTETMLP

SEQ ID NO: 1013758 - protein, 249 aa, Homo sapiens
AAVRPGILGMGSCWLCGGQEAGQGLRDRRTHGRAAWEPLSAALGPGGAGRGGLPTARHGDLCVAMCSLGLGLDRDGAVALASYRWLLSGGGSWWVAALPPARDSDHPHPSPAGPVPGGVVGGGPGGGPAWCGARHEWAVADVSSAASSAARPAPSRIAAKLGFRACGVPIYSLGALSPSLGPWLGPGAGPLGEPESLLGRNPGGAWNADPLTGAVDELTRYRPCREGLEDHQRVFTPKQGGARGQPEFS

SEQ ID NO: 1013759 - protein, 70 aa, Homo sapiens
MDVLGARTGKNPTHATLACGNSSLEGTQSLKGREGRGVKFPGNPQGEGHKNPGRSILGLNRRQAGQSHRV

SEQ ID NO: 1013760 - protein, 141 aa, Homo sapiens
MPSIFVGQKQMCVTVEKLVCPDWCAEVSDASDPLTVTCLSVLGCLDELAGKLSEPAAVLCCADMLVQCVLAVWCAVPETPVVPPRETLQCALCLWCIPFAMQHLCEPKGLHKYYFFRLDGTNRTWPAREKLERGEALCDVS

SEQ ID NO: 1013761 - protein, 191 aa, Homo sapiens
YARRPLDGQLHQNNLVCDARFLIFSFVYCYTRLDPLSHPDPLHHILRVISNRCPFFGYYFFNGLLMWLQLLHVYWSLPHSALLYSFMKKGQMEKDIRSDVEESAPEEEAGGADQEPLTDKERDSLEGPRQHPTDGPRKPGGPGSLTNRHTTSHTSRAGLAARGCPTATDREHPWVPKALQPLGHLLPTKPP

SEQ ID NO: 1013762 - protein, 225 aa, Homo sapiens
MARITGSLLRGRRSPVPRASPQSAVSPPTPSPDPLAEGSAERQTARSGEPRVRSCSWGLRPELARARKERPGQWGGAGGPETANWASAAEEESEALGPGGARLTGAERAARWRRKRTEAGPAGRRVAASKGSEGRTSRVPRTEGNPAGAGGRLAGVPGPRGRRSRRRRRAGKGLIQALVLRLGRPGGKQGRGGNSAAGPWQPTGTATQGRAFGGAQLGGIPGKGI

SEQ ID NO: 1013763 - protein, 154 aa, Homo sapiens
LVLARKFWEWRAAGRRGEGVADGNQVRPVSVCAALLVRSRPRVGAAARVVRNEGAAAPCSPPGPEPDLASVSSLESECIMMHACPESEGARMHQVGETRQAGACLQRSTPSRPDTSKPLTATSGKSFVHQQDKPMQTQESGHDSTEVANNIYRQ

SEQ ID NO: 1013764 - protein, 236 aa, Homo sapiens
MLYCSEFGIWAAGLASTCRLRKSASPARCARFHPSPLSVVPSGSNLPRDSAPAACSPNALPADALGTGVWEPRGAGWDSVSRACGSCPALRTSPCIGMPHAGVSAPRCAGDPGPGTRDPSRCLRLCAEACPGRDLSMPSKAENLACTPEPGTTQLRRGRGSDGSKGQFPVSLRSQDHAPRVCPQTDCSGLREALALAKLANTGTRPKRLGDTAQPEQAPNKTQMDHQKETSDLEPN

SEQ ID NO: 1013765 - protein, 227 aa, Homo sapiens
WYGPGIMGSVRIACGAGSSVGRELDESYRTIRLDIWTAGSGGGDPGLTRTLNPSPALVWRRRAALFPPESCGAACLRHADLHVEPTMPISTVAFGIHCQCWEMTRCQDSGGRVTAEFYGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEAL

SEQ ID NO: 1013766 - protein, 214 aa, Homo sapiens
MGCYRLRVYGRLPSWVMRAVVGLGPRVYLGFTGGPGSDRKCAFLTSLLGARGWGCEYHPLRVSSWATSGASFVASLREKGSRIRKKEVPLSTIQASSTCGARLVCTSSVRKVTALYTEEKLGLRKIPWSSLKQEQNLLKAGAEALKVNMEDTKTESPSSGSLGCPVKSQGHGSASYHVLRAILHQKPGQTWKNKEHHLSDTRVRVQKKPQQDST

SEQ ID NO: 1013767 - protein, 282 aa, Homo sapiens
ACPGSGILGSQRERDAVICCARAELGLLLVPGERDQCVEPWTARARPIPAMPPAEWPQRPRAAVAAAVVLLLWRRLPGAPWLSRRPVSPPSPQGASVIQWCDGCIVEAGELVPRVPVGLSGIVVLGTGLLLAGLAPHDSGGCGHACPSVIAWAPWVAGHVLPALASSPSSVPWVFDECLPLYAVCQALYLLPERRQLILYEDLVHDSPRRLPGALSRALVQFQRRGLPAWLSAPTYMPALGLSLTPCQNPSRNLQGLSLPSWAHEAIQAQGNGILDWSLIAH

SEQ ID NO: 1013768 - protein, 163 aa, Homo sapiens
QLQAGPALGFMGWLEAAPCDLVTHSLADPGPPECVHRETAWLLHCSGLRSPALAMAVPPARLPRSPFRVSCSGFITPLQKKFWPCGGPKCPNVNPFLARWTAEPPPVHPVWPMLLHRWAGWAEIPPVRSTPGTRKINTTMTHHQTITPYTMTKMATQKAHKVS

SEQ ID NO: 1013769 - protein, 204 aa, Homo sapiens
MQAVLPLEFWDGVAAPLGVGGELRGWPGAPPPGLACCDNSAPLRVAGLSCGSRAAECGRWSSRRLGCWLGDWLKEQLGENGPRCALRPGKACLGTLGEPVPYGPLTACNHRLNSALSGSDSEANGFAERRIDKFGFICGLAGRRRALLEEVPLEVLRQRGVQRGWDIAQTTGTNWMAKKHKKIRLRVPKTVHTCLLLRGTCIGR

SEQ ID NO: 1013770 - protein, 270 aa, Homo sapiens
AGWYRPELGIRARRSHSDKVGCPVGLCERSECRCVNVTRQAELAGLGPQTHQTLKDCVVGALHLFLAPVAPWIRLGRLHPAVSMMSYLKQPHTCMNVAVAWTGPAMDLLHPSVGFRVSTRTSRHLASDSQTVGGPTRHVGFECKLIVAETSPGSRTENTGPNVMFTNYMGPHNASDAIGGKRYVRRCEVGQMGLRKNDGKYEAHSTGTGINRENTKTHGICWYAQDRKQCDQEAIKYYSFACDFRITHKGGGNRYFGAYKYRPSQWESVE

SEQ ID NO: 1013771 - protein, 120 aa, Homo sapiens
MHDVLQCSAGPPEWVLALIPGWMPAVPAALPELVPRRPRPLDVVVVHVACCTAICQGWCRRGFKDTTPLTSFSRQIMTVVLNVTVNLNAGTAGGHLCRKCCLQPWWPVGNHWHRNLAQVS

SEQ ID NO: 1013772 - protein, 54 aa, Homo sapiens
MNEKHSKNITQRGIRRQDLEKCPRREGVCRPWLLALFTFVVCGSAIFQIIQSIR

SEQ ID NO: 1013773 - protein, 61 aa, Homo sapiens
SLAMTENPSLKQQLFSYAILGFACLRPGAFFDGRLPNPRHVRHGGSPLLILQLHTIGAGVC

SEQ ID NO: 1013774 - protein, 35 aa, Homo sapiens
IDYETAKEAYLLMELAKSQDKSLKIYDGAYHVLHK

SEQ ID NO: 1013775 - protein, 40 aa, Homo sapiens
SPAGWGQLPGYTALQLFLKPILLNMAIPEVKALGSQGLTK

SEQ ID NO: 1013776 - protein, 45 aa, Homo sapiens
DLPTLASKVLDYKCEPPHQARFIPSACMPSSLGARPQVSPFEVAW

SEQ ID NO: 1013777 - protein, 56 aa, Homo sapiens
ILQKNNLNLLRDLAVHIAHSLRNSPDWGGVVILHEGDSEFMNIIANIGSEETLLFL

SEQ ID NO: 1013778 - protein, 38 aa, Homo sapiens
IQRREATLLLLSIIQVKSTLSFQGQSPDLLLSQITPTL

SEQ ID NO: 1013779 - protein, 72 aa, Homo sapiens
ILKSAEGRVLRRAPARQTHETDANGCRPPLSTAPATSSLCGLQMLLKTQKSVDELMSSHNIYVQAIYPTVPR

SEQ ID NO: 1013780 - protein, 38 aa, Homo sapiens
SNVGPFLAAAALPRPGHHLICRASCCCNCFTFPIKFLV

SEQ ID NO: 1013781 - protein, 37 aa, Homo sapiens
DHDRNMWVSTQLQATCNVHKAFNWFSGHLNFQIEHHL

SEQ ID NO: 1013782 - protein, 32 aa, Homo sapiens
SSGVRTLGPAAKARSSHQEATYFKIKTAFLSW

SEQ ID NO: 1013783 - protein, 30 aa, Homo sapiens
SIRQTDGVYAPPFDFTHTHNFPNEAPQYSA

SEQ ID NO: 1013784 - protein, 42 aa, Homo sapiens
ISTSKNTKTNIHVEQNLSCLGSSDQVPQQGVKPLLALPAGFH

SEQ ID NO: 1013785 - protein, 32 aa, Homo sapiens
DPLALCPDPNQNTGPLEDGIDSGRGTLGLGRA

SEQ ID NO: 1013786 - protein, 35 aa, Homo sapiens
WEHDFLRIRAWEYNPSSRFLLWASLLPPNQGSSML

SEQ ID NO: 1013787 - protein, 57 aa, Homo sapiens
MLAAVSLVLSGASKKPASRVLVASRNFPNNATFIKKCDLHRLEEGPPTTVLTREDGL

SEQ ID NO: 1013788 - protein, 33 aa, Homo sapiens
GFALRPLTRGLASPAKGGHGGAGARTLLTFVLA

SEQ ID NO: 1013789 - protein, 52 aa, Homo sapiens
QEQLPCAAKQEMMEYRHQIQSYTCKIDALKGTNDSLMRQMRDLEDRFSKASG

SEQ ID NO: 1013790 - protein, 38 aa, Homo sapiens
MRCILTYCTLYIYLTFTYVRFFFVFVLALRLVLLSVSV

SEQ ID NO: 1013791 - protein, 51 aa, Homo sapiens
RHERERRKRSENEDLQEQQRAEAFRAFLKRNAPHEPAARDQLQRKAVVLEY

SEQ ID NO: 1013792 - protein, 36 aa, Homo sapiens
MGDRFKDEEVDEMYRGAPIVKKGNFNYVEFHPSLNM

SEQ ID NO: 1013793 - protein, 65 aa, Homo sapiens
EDTAKEDAANKLGQVCQGLQVAGTIVRFPRWRTPSPRGPEVRGCFILAHGKDGKFWKGKQANTEE

SEQ ID NO: 1013794 - protein, 63 aa, Homo sapiens
TRYPVVVIRNAFACFDEEASGFIQRTTFREHAYHWVPHYRRKWTDVREAPIDKKGNFNYVEFT

SEQ ID NO: 1013795 - protein, 44 aa, Homo sapiens
ERAARRKTASVTIEDGEAAKDRRNPCTVAAPSVPTFLHQRQQAQ

SEQ ID NO: 1013796 - protein, 36 aa, Homo sapiens
MPYYDLRMKQPIVVFKDTYKAVSYDKFVSGEENCLC

SEQ ID NO: 1013797 - protein, 45 aa, Homo sapiens
LKGLTLQASGYQELPGKKSPQARLPIHQFIYQLRERLHPAASMSA

SEQ ID NO: 1013798 - protein, 56 aa, Homo sapiens
QTRRPAQFHEPSEPKRLLRTREAPPTRKPSMSKRAKAKTTKKRPQRASVFEMFDQS

SEQ ID NO: 1013799 - protein, 56 aa, Homo sapiens
KLSVEALNSLTGEFKGKYYPLKSMTEKEQQQLINDHFLKPVSPLLLASGMARNWPD

SEQ ID NO: 1013800 - protein, 44 aa, Homo sapiens
GILGTGGKFEGNGDGESVPRLWLLQPVVFILGDIFEGKWSTPWA

SEQ ID NO: 1013801 - protein, 39 aa, Homo sapiens
MAQPGVTQALILLLWFHVLWKTKVYQDRFFLFIVDGVNP

SEQ ID NO: 1013802 - protein, 56 aa, Homo sapiens
HIPLCTYSPQWSPKKTRAQERMMPRQPPRQLQLPLPLSLSALKEVEFDASMFEFTP

SEQ ID NO: 1013803 - protein, 29 aa, Homo sapiens
GFVHMMFQYAIQKKPLYMSTKNTILKAYD

SEQ ID NO: 1013804 - protein, 47 aa, Homo sapiens
MIDLPTACTVQLEKPQAVNASPVKAVTVAYPKQGLSCPRPWSPPLHQ

SEQ ID NO: 1013805 - protein, 126 aa, Homo sapiens
EVCLHQKREVLFVCLFCLLAESGSGSVAQAEMQWQDHASLRPQLPRLKQYSPTSASQVAGTTDLRHHTCLIFFFLGEKRSWYVAQAVLKFLSSTDPPTWASQSAGITGMSQPAQPEKRFNAYVLYV

SEQ ID NO: 1013806 - protein, 31 aa, Homo sapiens
MGKDEGLEINGFGRIGRLATRAANSGKVDIV

SEQ ID NO: 1013807 - protein, 54 aa, Homo sapiens
SVVKHSDDTITKKGFHLRYTSTKFQDTAPQQEVTTCQSRGGDVEPACPLPPDEC

SEQ ID NO: 1013808 - protein, 53 aa, Homo sapiens
MGPWKLVDIKFDDNMKSLGVGFTRQVASMTKPTTIIEKNGDILTLKTHSTKTT

SEQ ID NO: 1013809 - protein, 65 aa, Homo sapiens
FDVHVHEVVDASLSVIAQTFMDACTRTEHKLSRDSPNKLLYAKISTYKKMVEYYKGRQMVQVSDQ

SEQ ID NO: 1013810 - protein, 49 aa, Homo sapiens
MGEVKNKDLRNSLALNKKPVKKSIESEAFLPQSIPEERKMKSPLGICLI

SEQ ID NO: 1013811 - protein, 103 aa, Homo sapiens
FFPETESCSVAQAGVQWHNLNSLQPPPPEFEQFSCLGSRVAGTTGARHHARPISVFLVKTEFQHFGQADFELLTSGDPPASASQNAGITGMSHCAQPRVLKKG

SEQ ID NO: 1013812 - protein, 29 aa, Homo sapiens
NQPKEGKCTQPPSHVMGGVPLIGGGHYHP

SEQ ID NO: 1013813 - protein, 51 aa, Homo sapiens
GRVGQAADLYLRGVALVVKKLQEIMIDVSGRLHSSYQLVGICVLDRVERVE

SEQ ID NO: 1013814 - protein, 185 aa, Homo sapiens
LFGDVNISEWRGWAGLGLGKGGEAWLRRGKTRGGGGGWDGVIGGAAAAAAPARGGRQRGQGKGGGARRLEKGRAQQTATREAKLGKKRDRDRGGDGGGGAPRGGGRRAGPPGGKKYGNPGEKEEKKKWNLEERQKEEKKGQQEHPEEERRTAQEEETYRRSKEMTERGHNSPKPEPKKDEAKFPG

SEQ ID NO: 1013815 - protein, 49 aa, Homo sapiens
MYRPSQQVQVRFNVLKVTEAFRHRRSSSRSSEAEHRPAPSYEIKLFLIL

SEQ ID NO: 1013816 - protein, 99 aa, Homo sapiens
MAGGPDVAATSASALVVAAGASSVSIHSSVQCKFRYGNLGISYFLDKASKGLAERSRVITVDSNICTPEQQTWKRNSRRTRFKDFSAAGLHYPDSTTGV

SEQ ID NO: 1013817 - protein, 73 aa, Homo sapiens
GTWGNVGALFLALCPMWVGGPRGPAGRPVPFCMSEATGNRRPTPDLPPACFERPLFITFILCGGKGGFLPHPG

SEQ ID NO: 1013818 - protein, 89 aa, Homo sapiens
EKDGPKQAEDAAKSITNGSDDGAQPSTSTAQEQDDVLIVDSDEEDSSNNADVSKEERSRKRKLDEKENLSAKRSRIEQKEELDDVIALG

SEQ ID NO: 1013819 - protein, 103 aa, Homo sapiens
GVIKDKYGKDATNVGDEDGFAPIILENSEALELVEEAMDKACYTDKIVIGMDVAVSEFYRDGKYDLDFKPTESCPEYITWGPDWGHFVPGTCVSARSPWWVVH

SEQ ID NO: 1013820 - protein, 85 aa, Homo sapiens
MNGKEGVEECSFVKSQETECTYFSTPLLLGKTGIEKNPGIGKVSSCAEKMISDAIPELKAPSGLGEISEDPEVSRCDGWPLFLIY

SEQ ID NO: 1013821 - protein, 89 aa, Homo sapiens
MADEGIAAGGVMDDNTAVQRGSEDSPSLHDGPSTWDFAKSPKGSETERQAMLCGAVHPAVDEPDCISSSVGGPFFLNNKQPELRLDGKQ

SEQ ID NO: 1013822 - protein, 104 aa, Homo sapiens
MLPVIRQNDEHNGKAERHPIYVLSAFLKTLELFLPATYMRIYKNGDIVDITGKGTVQNGMPHTRYQGKTGRVYNVTQHAVGIVVTNKFTGKILAKRINERTGTL

SEQ ID NO: 1013823 - protein, 61 aa, Homo sapiens
DLDRNKMKDIPKRPSLSVYLHYFSSVCRVEGEEPGVRRELGVIEELRGTTSESVPAFDTCA

SEQ ID NO: 1013824 - protein, 102 aa, Homo sapiens
EERKEIDVEVRKEIVDAAQFAAAGPEPPLEELGYRGLLLATRCLKFVVQIQWIQFKSVCYRGGEGEVIPSGGYQTVFFTWLRRKTRSMKFYEIPGNTDKCVD

SEQ ID NO: 1013825 - protein, 90 aa, Homo sapiens
FTLLETTKYFDSPFSISDGIYGSTFFLTKGFLGLPVIVGSTFLTICFFLQQRIVFKSKEHFFLEIPPPDGWQFLDVWFEELCMSPSAQEG

SEQ ID NO: 1013826 - protein, 66 aa, Homo sapiens
VATGFHGLDDIVGWIFLNMLLHPRSKEGNITSKHHFGFEADRLIKSILEMWAFLILFMSPSIDEGL

SEQ ID NO: 1013827 - protein, 92 aa, Homo sapiens
MCTRTYTHARIYVYTHMHTCIYARLHIYTPALTQAETKHACGHVHTHAAYVYMYVRECTHTRVHAHTRICARMYAYTHVYARMDTRARTHAR

SEQ ID NO: 1013828 - protein, 115 aa, Homo sapiens
MIKAAPEKSTVNIILNGEKLEAFSTKAGKKGRRITSGHKFETSLDNKVRPLSLLKIRNQKQKYQPDGTFLCLKKSTGWAWWLKPVIPALWEAEAGGSQGQEIETILANMVKPCLY

SEQ ID NO: 1013829 - protein, 73 aa, Homo sapiens
IALAVRLTANITAGTLLMHLIGSATPAISTFNLPTTLIIFTILILLTIQEIVSLYITAYVFTLLVSLYLHHAA

SEQ ID NO: 1013830 - protein, 74 aa, Homo sapiens
KADAAIRENPVYEEKPEKEVKKKRWNCPEMSLSQKKDRVAPKKATFRRAQKRAAENYTLRFSMIFSDIDNKPMN

SEQ ID NO: 1013831 - protein, 68 aa, Homo sapiens
MVRLKNRCNSRTSKPNQATPLHNLGYTTVNALKSVEPNQSFMPSVPELIPPKTIEKDPNLPYSTPTTR

SEQ ID NO: 1013832 - protein, 130 aa, Homo sapiens
WIQAAGIRHEAARPSGLHMGHGAFLQHVVLGLTPSSAFSALCCCRRPSASSCPGGASWDGELLLAEPSLLREPPPTRCDHGPLLPTPNPGPVERALSTLGGGWPTEKGGKKIGKTSVGEAGAAQKSQRHL

SEQ ID NO: 1013833 - protein, 36 aa, Homo sapiens
MARKIEEIKAFLLTARRRMPNLSRSRKIRTTWKFKV

SEQ ID NO: 1013834 - protein, 84 aa, Homo sapiens
LAVLEEPPPMTLPGAGLSSQELSGGPGDEPLRLEPPWPAPGPVLSPLTPSPPPWWPDTHTLVAPSPSSSRYGFYCCGFNKNFSS

SEQ ID NO: 1013835 - protein, 99 aa, Homo sapiens
KLQNQRGGRTFLDNKKPDSYDLESWQNAMKCARQFEKNVNQPPLELHKLATDKNDPHLCYPSETQDLNEEVKAIKDFGDHVTNLRNFGAARILLGGKPL

SEQ ID NO: 1013836 - protein, 110 aa, Homo sapiens
RWRKPSSDFIRSSRGRGLQEAFGGGGCRSPPFTIHRLSGLAQDGRSALADGLAMAQVRGGYFFLRIMCLMLLSVGADISSDGWVPKEEVEGFLWPELRLIDHHDIFGRGV

SEQ ID NO: 1013837 - protein, 114 aa, Homo sapiens
MALNISDLPLPTHRARPILRIISLLRNLKTSAFFSCLTAIATAFIGYVLPCSPKYHSEGDTVITDLTIRHPIHWDRPSSMNLRRILSRQSHPHTFLYLSLHLALHYCRPSWPAA

SEQ ID NO: 1013838 - protein, 79 aa, Homo sapiens
MLCCAGDDRVQTGMRCAFGEPQGTVGKAHIGQVIMYIRTKLQHTLHVIDALRRDKLKFPGDRDHIIKEWGFTKFNADEF

SEQ ID NO: 1013839 - protein, 86 aa, Homo sapiens
WPCAKSPQDLKEPPPMPGLLPGNWVGLEDPPRIHGSPQSSDKRPMPQACPLSAPLRPAFLKDVKPSLPLNNSHYLSPTNLIDHRRR

SEQ ID NO: 1013840 - protein, 69 aa, Homo sapiens
LKWRDRLSPGGQGYSEPWLHHCTPPWAEVEETLKRLQSQKGVQGIIVVNKEGIPIKGTMDNPTTTQYAI

SEQ ID NO: 1013841 - protein, 106 aa, Homo sapiens
MGGKKGPGSGARAQGGLVAMPRKNVEEIKAFLLTARRKPAKSVKIKKNEGQRGDLKFGGEDTSTPGVITDKEKAEKLKQSLPPWFGIEGNSDEPYTLIGTAIILKL

SEQ ID NO: 1013842 - protein, 99 aa, Homo sapiens
MTGGVLRYQPRTHSGNDRGSPGQQLELKEGEAQRGRRAEWGGIVLVLWPPGVEQADTVKRCATGPRPSHPVPPERLSLLAGMEIQWENQSGPLIKELGF

SEQ ID NO: 1013843 - protein, 84 aa, Homo sapiens
SFQERSLFFLFETVSLYPPGWSAAARSRLTATTISQERREIFEQHLKSLKLTQSSSFYFQGLAELTPGFSGADIANICNEAALH

SEQ ID NO: 1013844 - protein, 67 aa, Homo sapiens
EKAEKPDTKEKKPEAKKIDAGGKVKKGTLKGKKPKKGKPHWQPEPSSFDRGIGEVIPGLPWNSSKAM

SEQ ID NO: 1013845 - protein, 104 aa, Homo sapiens
LDRPLVGQDEFFLRADQEERSGSATARLAHQAVPGARRGGGACRELPTIQPLKTTRPCSQRPKEEELQRQKEAEKLERQLALPATEQAIIQVSTFQELCEGLLE

SEQ ID NO: 1013846 - protein, 112 aa, Homo sapiens
LVPFRQKKPPWVVLGDSERRHVFGESDELIGQKVAHAVAEGLGVMAFIWEKLDEREAGIILEGSFRADKGHLQIYVKDWSKAFLAFVAFVGHLYFQDCEHPNEAQEYTRGQR

SEQ ID NO: 1013847 - protein, 118 aa, Homo sapiens
RNTILRQAGNHKRRVDKAVLQQRHCKPESDEKAAVLGKKLVVGKKGKKAAVGVKKQKKPPVGTKAAATEKPAREKKPAEKKPTTEEKKLLHKLLNLIIPERSNLFGQRRLNKEGIIQA

SEQ ID NO: 1013848 - protein, 85 aa, Homo sapiens
DENIAKKKKAKTPETKTSSLRTAKRGHPSMSKIVGRFIGGGEKPTEPGDNWLSKIKSSFNFKFPPKPSKSPCKLTVSQRGTALEL

SEQ ID NO: 1013849 - protein, 132 aa, Homo sapiens
VLIYSLQSWSLDADHLGTLSCSDRIVDLPATIIPPPGCRAPSRRNLHLPWVFVGGVLIAVVLPLVLVTLFWGDHWINLKDPVADGAILPPPQHHRADDDDRGNGRCDDLQADEITATQTEVLLLWAFGFLLF

SEQ ID NO: 1013850 - protein, 67 aa, Homo sapiens
GLRSTSKLAEEQLRIVDAQRKDSEGKDETRTRTGNVNKKRTKKLSWARGSQAKLSFSIKNPGLNCKL

SEQ ID NO: 1013851 - protein, 67 aa, Homo sapiens
DIQTERAYQKEPPIFQNKKRVLLGETGKEKLPRYYKLQPTWAFKTPKEAIVGTYIDKKYPFTGNVSI

SEQ ID NO: 1013852 - protein, 69 aa, Homo sapiens
LRLSSFFYLGLRRNFTVLLAQLSSLSASSADKYFTLHQNITLASKPPLDTGVLEMWFDYFCMSRQLMRV

SEQ ID NO: 1013853 - protein, 48 aa, Homo sapiens
MYSSVIYVRFFFYANSRFFVRERNFGFLLLCENIAQQHVICKEDKISP

SEQ ID NO: 1013854 - protein, 84 aa, Homo sapiens
FSPASKVYNGILEKSCSMNQLSSGIPGPKPRHTSCSSDGNISKPGSGGPKLLPDYEDIPHELCHNGEKSKKPSKIKSLFKKKSK

SEQ ID NO: 1013855 - protein, 65 aa, Homo sapiens
MGHFTEEDKATITCLSGKVYVGDAGGETLGRLLACLPMGPRGFFVQSLGNLFLWALGIMGEPQSQ

SEQ ID NO: 1013856 - protein, 68 aa, Homo sapiens
SPGLQEFRTKVAQNMPSDLILSDDGFICSNMYIIYENSLNAKLKRTKFETTSTEVLLILDIVFDDHKA

SEQ ID NO: 1013857 - protein, 92 aa, Homo sapiens
DICAKGEHIMEDRTQVHRDLSVNHGHNLKAITPIYLKHLSPRVPIYVAHDTARSQVAQPLHSYTMEDEMLAWHTWRKLLSTEQPVEDLSDMW

SEQ ID NO: 1013858 - protein, 147 aa, Homo sapiens
LAPNRHPPVKSPKSPPPKHTRITRTRSINPLSPPKFKKNHPNPNNPTPAYSNFLGFLFYPPQSLRVLRVSLHHFRRHLRLNIFCSHRLPRTSRHYWLNFPHNLLHPPNNISLYIQTSLWLQNPRLKLAFCKCGLTISVCPHPLMRVF

SEQ ID NO: 1013859 - protein, 126 aa, Homo sapiens
MLNCSHQNGALNPHKGSPVNFAHSTKGRLSHSTVNVPPQIVPQGNTPLWRQTYTAQNPHCHLYQKCHFRRVKSKTVFSPHKQHVVSGANSGNAPATLYSETIPEGNNTHHWKHSYSICKGHMSMFF

SEQ ID NO: 1013860 - protein, 153 aa, Homo sapiens
RPILRIFAPPSVSLFTRALCSLLGPFLPSLCTSPPYTGGVPSTFLYRLFILVLLTPHDRYHKYPRGGACLTRSEHKFPTWPHTAPHLVPKVLLNTGDISSCFYPQRGFFFPHGRFFEPLLPPSTPLCRPSSPHFLEGPCRPQQGRISPPLYSP

SEQ ID NO: 1013861 - protein, 494 aa, Homo sapiens
MICRSSTAAVRCAAERPLSCLLAPASLCASLLGARPADASLLFAPPACGPPPSLTTLTLLFFLLRAAPAFVFSLVALTARGSAIFALPPGCGVARCVCPPRGYMLPPSCVEIHHQRAVLRCHFIDVCPSVGGFLTRAVFYYLGVGGPHRRPNVCVSPRLWGQFLLPVVCLHTRARYDFVVLPTVAGGVRAKHVFLCRRRMVPLPHSPGAGFLICVYFFYALWIAAAPTAPLSPSRVKPPNYVGRSWGVSLPLTTVWPFFVEGPPLWGRSARWLCLPLCVPPARLLVVGSPEDLGGPFWCNVLRRAMNLGTSTRVGRHTSGCTYYSPETTAADHYYRSGVLPHTTGFPPRMLVARFFPTLWEVSCVFFGRTSHFIVREPLHDVHTVEVSSAPLCVVYSRGVIHPLIERALVDALFWPPTRSPHLCPTLYADRCFTPAAAIISNTLCVFPHAQHTLFLSRPIFPRVNVPPDTLISPRDYTPRDCTIPPTHVNHSAI

SEQ ID NO: 1013862 - protein, 126 aa, Homo sapiens
RAGKSDNALSFPLGFYDADVKDLLCTVYYPMHVCSLPRYIEHHTVVKPFNGMPHTPERHLPRCIRKGIFRCCACLSSFIVCTCELCEIDVKSSNECIFLPWVYRLSSVPGTVCMKANVRIYKWLTR

SEQ ID NO: 1013863 - protein, 68 aa, Homo sapiens
VRWGGMEEGEFQSPEDMAAGEKDYEEVGVDSVEGEGEEEGEEYKSYNVVEVLLLRGSVFRFKRCKVVV

SEQ ID NO: 1013864 - protein, 76 aa, Homo sapiens
MSAVQAAACRSFRSLLPPFLCAVAAPAMTGTQGLLVVDVPCMGVATLNGSSLALSRPSGPYLCYFVAGGSGFLAST

SEQ ID NO: 1013865 - protein, 81 aa, Homo sapiens
MTKGTSSFGKRRNKTHTLCRTLYGSKDLPPFRSRPVENVVNLEEGEEKVYLGVPRLKGEIPPELGRMRHLKIVYRDSGMAS

SEQ ID NO: 1013866 - protein, 85 aa, Homo sapiens
LQATEYFESPFTISGGIYGSTFFLQEASEDFTAVIGSTFLTICLIRSLIFHFTSKHHFGFEAAAGYWRFVMVVFDYYCMSRAIDE

SEQ ID NO: 1013867 - protein, 94 aa, Homo sapiens
SRAACTFSPPIQQQSESTRRTGPEDERRLDILPTVSQPGQGGTMARRYTGPRCAQLPPGGGSQGDGQSGGPSSVSADTGGDKSRPSRVLPAPRV

SEQ ID NO: 1013868 - protein, 139 aa, Homo sapiens
RGHERNGVHRGRENMNDLVSEYQQYQDPTAEEEAEMYEDGEEESEALALEWKLLAAGVRGRCRRGRSQQCLNLGSHLAADTLLSPRPRAPLPPAGSIYGLVLPAQPACELLQSLSYCSSWLDALGFCFLRVCVYIFGDT

SEQ ID NO: 1013869 - protein, 66 aa, Homo sapiens
EFSGASAMAWEHEEATTPIQQTFVTAFYIPCGQDAAAECWYVQTCITIMERNVGPQIDKTSYYHAR

SEQ ID NO: 1013870 - protein, 82 aa, Homo sapiens
EYFESPFTISGGIYGSTFFVAGASADFTEILALLSSLSSSSAGKYFTFHPNITLASKPPPDAGGLYIWFDYYCMSRAINEGL

SEQ ID NO: 1013871 - protein, 70 aa, Homo sapiens
IRKAMSQPIQNINKEIEIVEKNQIEILELKSIITKTENSLEVFSSSLEKAEERINRLQDRTIKIIQAEQK

SEQ ID NO: 1013872 - protein, 70 aa, Homo sapiens
HGLYEKKKTSGKQRTERKNRMTNVPGTPTANVGAGKKELEIGSQPKSKGAAMMLAAATADFSKNINKLKT

SEQ ID NO: 1013873 - protein, 81 aa, Homo sapiens
LRVDLVNFNLLTNCLLVTLAAHLPAEFNPVHASLDKFLASVSTVLTTKYLKLEPRWPCFLPPGPPPSPSSLSFTRTPVVFE

SEQ ID NO: 1013874 - protein, 124 aa, Homo sapiens
RPSFLSGSSTRCLPVLTDTSHVQAEQIEVGGNHSGLAKARGSQGWSPPLEGEAEEEEKDKEEAEEEEAVEEEEVAKEEFEEAKEEEEGGEGEEGEETKEVEEEEKKVEGFGEEKKKKKVEPHFL

SEQ ID NO: 1013875 - protein, 68 aa, Homo sapiens
RYQWMNLMESFYGQKRLLCGNYKAMWKFGTYCQELAALEKERSQLSCSLATFLTTCSDLLILHLLNKI

SEQ ID NO: 1013876 - protein, 105 aa, Homo sapiens
VRFVRLCPSGRLLMYPCCLAFGNDDVDVSPPTHNHVPGRGSRAAAYQRDVLQDSGGGLGGGAIGQLTLVLKESGVTSSESMNDAGMKDSRKIMETWLVAVTEMVE

SEQ ID NO: 1013877 - protein, 85 aa, Homo sapiens
PLQDETLGVASVPLAVEGLQGILRETKSCQTASIATTSTSTQARNHVDAQVQTRGPHNYSLCSPRPSTTYPGSQPFIRRVEAMVI

SEQ ID NO: 1013878 - protein, 120 aa, Homo sapiens
MYKTPPDVNHCIWIQNSFGGGVKTGFGMIYDSSGVVPKKKWSRNSSLARHWLEYEKKKTTREQRKDRKKQNEESQGDSKGTMLVLAKSELEIGSQQKEERCCYDVSCAPSGFSPDINTKL

SEQ ID NO: 1013879 - protein, 51 aa, Homo sapiens
MRIYSSTDHKNNNTLCVDELSTPLQQEEATVYRQQQNSNIFFLADRTEMLS

SEQ ID NO: 1013880 - protein, 74 aa, Homo sapiens
RTGASSAGTQYGYDGKDYIALKEDLRSWTAADMAAQITKRKSEAAHVRGAAERLTWTARALDGLRRYLENGKET

SEQ ID NO: 1013881 - protein, 81 aa, Homo sapiens
KRPKVEYSVEALKTHISKCTLGKFTVPMLKEACRAYGLMICLKKQELLVALTKHFQDLSEAARPAALSQFCQAAWSFSQPV

SEQ ID NO: 1013882 - protein, 87 aa, Homo sapiens
NEFGYSKKGGGSSWPKWPPRSKTPGPPAPERAQEEVERPPLLGSPCHTQAPTTLNLPTSQLPCRPEEGRGLGSRTLSCTINKVPGAQ

SEQ ID NO: 1013883 - protein, 70 aa, Homo sapiens
GFGMIYDSLDYAKKNEPKHRLARHALYEKKKTSRKQRKERKNRMKKVRGTAKAMLVLAKSELVIGSQPKE

SEQ ID NO: 1013884 - protein, 88 aa, Homo sapiens
NARCLGASARRKMAEQATKSVLFVGPGNICRSPIGEAVFGGLDNRSTTMSVDLRVDSAATSGYEIGNPLAYPGPELSLQRHGIPIEAR

SEQ ID NO: 1013885 - protein, 87 aa, Homo sapiens
RLVLSVVATYYSTIAPTTVLSNKCNSMSVTAKITVQIPPSQSTPVKPVPATTAVQNVLINPSLIGPKIFLLPPTWFRHRTQPLRQTH

SEQ ID NO: 1013886 - protein, 78 aa, Homo sapiens
KWMDLMEFSCLTLIAGVLIFTLPALETQATLKKFSVCRVHVKVPTASPDNCVPVRYCCARFPNLGAHKMQLISLSVHS

SEQ ID NO: 1013887 - protein, 102 aa, Homo sapiens
RRSPPLCRGSLPGSQMLCGRDFADFPTARLGKNIYPPAAVENASVPVKHSCSSVLQTRRPLGQAEALKHEQSAQLSTGPLWCDPQMVKHSPQCMSCIRYLTH

SEQ ID NO: 1013888 - protein, 42 aa, Homo sapiens
MPPPAAKDIQEDLLDIGVIEADGRSALKKVYQCSLMEKTLED

SEQ ID NO: 1013889 - protein, 72 aa, Homo sapiens
RVEGVKWITSWAEDRGFLRETAADKVFKLGFAKSIHHGRLLIRQHHIKVRKQVVNIPSFIVRLGSQKHIDFS

SEQ ID NO: 1013890 - protein, 104 aa, Homo sapiens
QRPRGRTERTNGSLGYGLDITAKLGIGEMAETDPKTVQDLTSVVQTLLQQIQDKFQTMSDQIIWRIYDISSRIDDLEKNIAALITQAGVEELESETRYLATQKS

SEQ ID NO: 1013891 - protein, 116 aa, Homo sapiens
ETESRSVAQAGVQWGSLSSLQPRLPGSGDSPASASLVAGIAGARHHARLIFVFLAETGFHCVGQAGLELLTSGDLPTSASQSAGITGVSHHTQPHRNFNRHCIESVSHVQWHLNNI

SEQ ID NO: 1013892 - protein, 71 aa, Homo sapiens
AQAATCTRCCLATGALASGFTGPMSLGGRHEGLVGGSHPEDGLEGSTSLMHNHGALPSQPGTLPDLSWPPD

SEQ ID NO: 1013893 - protein, 69 aa, Homo sapiens
DSIYFSLVLLPVKLKNRIGQELGYSYSWYYYWMERTVGINRGQRLMLEWTVEVVEQSRHLLVGLYQAGF

SEQ ID NO: 1013894 - protein, 77 aa, Homo sapiens
MECLYYFPGFLLLAARLPLDAAKRFHDVLGNERPSAYTGEHNQLNGWSSDENDWNEKLYPEWKRGDMRWKISWKGGR

SEQ ID NO: 1013895 - protein, 138 aa, Homo sapiens
ISRAWWRAPVTPATWEAEAENCLNPGGGGCSEPRSRHWTPAWVTDRDTVTNEKQQKTGKTKNSLLVSDLEHGSLCTIVGHLYFHLCEFAFKFWLWVSPDEIFKHIYLFLCDRFFSVPFPVKHTDPSPIWTLNEYSFSF

SEQ ID NO: 1013896 - protein, 177 aa, Homo sapiens
MPATVTERVQALGVPGGQALPTESQEQPWPPSALLDAPPEGTANHFAHTHVTTALSNATDNYIVQLPSRGGTDETTAHRQPAVARGSGGLRGSGTRPHTGAPWVGWPCFYAILFQLHVSQIPLMSLFIGKPSLYLETLIIHCGGHSFPHPIDPGFGNSGRVGPLDITVSLLLQGTHR

SEQ ID NO: 1013897 - protein, 39 aa, Homo sapiens
MAAGSRPSLLLAFALLCLPWLLAAGAVLTVPLPSFLRLA

SEQ ID NO: 1013898 - protein, 106 aa, Homo sapiens
WCGGKRRTSLGIQNAAGEFVDLYDDAENAALSNRIIGAKAHGSIQMNVAEVLQGHRKVYGQFKTYAICGAIRGMGESDDSILRFARRRHRLKALLTGENHRCGIFV

SEQ ID NO: 1013899 - protein, 69 aa, Homo sapiens
IRHEVHQTSCTCPPMRKIDGLLNEHKKKVLKRLSLKPALQVPGGLDRGFLGAKGPHVEDIYVSPPFARG

SEQ ID NO: 1013900 - protein, 69 aa, Homo sapiens
MVLGKTATPQQAQEVHEKLRGWLKSNVSDAVAQSTRIIYGGSVTGALARSWPTSLMWMAPCGWCFPKAR

SEQ ID NO: 1013901 - protein, 68 aa, Homo sapiens
IRHEERLRGKRGEKEKESWNSKEKGRQPPEKAPETSLYREGDAPRLTCKAGERVPLNSRFPCFYASEY

SEQ ID NO: 1013902 - protein, 69 aa, Homo sapiens
IRHELTTITKQITAYVRSIAKVKERLEPSEAKGGVPGALRLFRMCMGLGAVAHGCNPSTSASKMLGLQG

SEQ ID NO: 1013903 - protein, 65 aa, Homo sapiens
NSWHEPGVRDVLSGILPCSACPGLKRLVPFKPFAYPGFLTTLCFKAIEVDQLAIDTYHEFYETYI

SEQ ID NO: 1013904 - protein, 33 aa, Homo sapiens
RVVRYNETKLAGWKQIILPFFQVFECTSNLGLI

SEQ ID NO: 1013905 - protein, 59 aa, Homo sapiens
ASIPAGHTLLGTTSILLTAAVVQVPRVLVVAELHFLVGWWCQASFLCPTVYAVSLLVPV

SEQ ID NO: 1013906 - protein, 66 aa, Homo sapiens
MATGAVGAAIYPCPAPNWKKMLIKVKTLTGKEIDFGIEPTDKVERIKERVEEKEGIPPQQQRLIYS

SEQ ID NO: 1013907 - protein, 71 aa, Homo sapiens
SCKFGRGSNPLEVPLPKHILITRIRSINHLSSPESNRKQPPNISSTSYYKLDLGTLFYPSYQSLMSNFEVL

SEQ ID NO: 1013908 - protein, 82 aa, Homo sapiens
PGPSSNFSSAARRSHILHEKFGLPPSSNAGLNFEDIGGLEKLAFIPMIGYFGSKYHPQSFALSDKLAGPWHFIEGFQFSGPP

SEQ ID NO: 1013909 - protein, 266 aa, Homo sapiens
MNSFIGAIAIGELVKRKLGKKGMEKIVVRSGRDESIMVKNDGGNIIKKIGVENEEAKVLVDMLRVEDDEVGDGNNFVIVLAAELLREAESLIAKKIDEKKIIEGWREEKKDEREELLSYEVDDGFDEVKFRQDLMNIAGKKLFLKIVNNKKEKFTKLAVEAVLRLKGSGKLEAIHIIKKLGGSLADSYLDEGFLLDKKIGVNESKGIENAKILIANTGMDTDKIKIFGSRVRVDSTAKVAEIEDAEKEKMKEKVERILKHGINWFI

SEQ ID NO: 1013910 - protein, 81 aa, Homo sapiens
FVYHKVTPYTSLSPYVGYYSKPSAYISSTNSPGADALSSVTLRAGHLLMHLIGGATLAISAINLPTTLIIYTILILLTILE

SEQ ID NO: 1013911 - protein, 139 aa, Homo sapiens
YGPVHKHLTAGITYPKKVKPSRGSNSANLSSGHSGRRVRTSVSQACGSRLRFPEGSLSVPRGSRPPVNQRTTRPFSHNDRTDSTLADIVVCALKCTIFPSVKVRPGYLSLRLEGQEAVQEVTKGLNLSLKRLLQEVNGL

SEQ ID NO: 1013912 - protein, 124 aa, Homo sapiens
GSQFGRNGKTGCNQVIDRIIFIFKRWTEITVRQLSQVAEILCHDRIIKMIFRFDIAITSGGKVRSPVKGLPGARRIIKNEIVIRINSVGIASRQRRRINFDIALPSGLSFCNAIKLRHRGAGHF

SEQ ID NO: 1013913 - protein, 137 aa, Homo sapiens
AFEITDLHPTSSNGDLDVTIDERDGNQQNYTIPYSTVPILQREGRFKFDLTAGDFRSGNSQQSSPFFFQGTALGGLPQEFTAYGGTNYLQLHRLFIRAGAQSRELGRSVAGCNAWAQSVSRRQLMRGILFVSSMRNR

SEQ ID NO: 1013914 - protein, 90 aa, Homo sapiens
MHSDRLGYETLGRIWQWLKGCQASHGKSDFARSKLRRLNRPVLTSCATSSHNTYNQRRQMNDSATGRVAGNSRANLPPENYPLVGTVRIL

SEQ ID NO: 1013915 - protein, 51 aa, Homo sapiens
GSHCHNWYMVGLVAQEAVKNSGGLRAVKHYMQRTAVQGSPTLLAAISKQWV

SEQ ID NO: 1013916 - protein, 58 aa, Homo sapiens
FAYFVNDTTFFTHATFAIRQYRQHVERQLTPEEIFFVNRNAVEQFRTLPRYRIDRFFA

SEQ ID NO: 1013917 - protein, 94 aa, Homo sapiens
VAGQLDLKKVAKALGAKKVEMADPMVAQFDGIPGWGDEPTGAEKTSANDYRQPPTQEFATIYVSGGKRGLDIELAAGDLAKILDAKFSDIARRD

SEQ ID NO: 1013918 - protein, 101 aa, Homo sapiens
EFVLHPRCVTTPFHFHSAALFSSRSLLNPPTKKKPTSSLQKTRFSHIMVIRTLLTLSTKNPLSPLSPSLSHSDTRGQVPPLTPHTLSLALSLSQTRSLPLT

SEQ ID NO: 1013919 - protein, 118 aa, Homo sapiens
PGLTVIEAPTGSGKTETALAYAWKLIDQQIADSVIFALPTQATANAMLTRMEASASHLFSSPNLILAHGNSRFNHLFQSIKSRAITEQGQEEAWVQCCQSLSQSNKEVFLGQIGVCTI

SEQ ID NO: 1013920 - protein, 45 aa, Homo sapiens
MSVRLCRFENGASFNESHKNTKEMKMYRQSNGCTNSLALPAHAVK

SEQ ID NO: 1013921 - protein, 106 aa, Homo sapiens
MKELLTIAALAPGTNNMLRRVRVLRCCSEAIIGNPPMAEPGYRWRVPAGLPVVHVKCSQCAFVIDIQLYAAHVVAGENVQNGGANCIAKLFLNAAIDLQVDILRIL

SEQ ID NO: 1013922 - protein, 88 aa, Homo sapiens
MAGIDKDIEGEARPQPDIKIGYLPQNLQLNPEHTVRESIEEAVSEVVNALKRLDEVYALYADPDADFDKLAAEQGRLEEIIQVHDGHN

SEQ ID NO: 1013923 - protein, 125 aa, Homo sapiens
SGGEKSLPAGDYAAQPGDCCRSGPENLLVTVANPDIETAQRLFKFPGIGLLVVTGGEGVVEAARKHTNKRLIAAGYGNPPVVVDETADLARAAQSIVKGASFDNNIICADEKVLIVVDSVAMTYA

SEQ ID NO: 1013924 - protein, 92 aa, Homo sapiens
MPKCGGVRVWIKDWNVASLCPWWKGPQTVVLITPTAVNVERILAWFHHNRVKPAAPEILGGKTKSGQPLQSDPEEDDKPFSITPEVDGQDSR

SEQ ID NO: 1013925 - protein, 108 aa, Homo sapiens
MDPGSRTSLAPAAFALLCLAPASSALVPSKSFRYSRTVAPPLLLPGHSRRTCDIATPTQAALKKPYIPKHQKDSFLHDSQTSSLLLRLYSATLQHGGTQQKYNLELLR

SEQ ID NO: 1013926 - protein, 67 aa, Homo sapiens
SRVGALKVCAPWNGRLEEPRVANHGSGPSGVSHEPAEPECEDGEKADHSHDINPHNLGTTQENHTGG

SEQ ID NO: 1013927 - protein, 121 aa, Homo sapiens
VGDAGRLPPAEAFLPRPLSGLYVLSSLSTPASSPLEEPPRRGDTCPRQEAANGNPLCGLIVHPPGRKSRKLVSRRPGVGAGVPGTHPHARAPPGSGSVRSPSVGPGAINSGPVSLRLPEPS

SEQ ID NO: 1013928 - protein, 48 aa, Homo sapiens
FVAGLAVDAPTMGAGRLPPPTFLQTSGLSSSLVLLSFVASSINLQMLQ

SEQ ID NO: 1013929 - protein, 74 aa, Homo sapiens
TEHHDGRREQSQRRKTGKRRQTERTETQEHQQEAEAQQATTKKARRKQARDTKRGSRRQSEALSIPIFEAVEQA

SEQ ID NO: 1013930 - protein, 44 aa, Homo sapiens
MAMPRPTAGGGCTVATLTAAGKVYTKSSHVKAHQRTHTGQPGPR

SEQ ID NO: 1013931 - protein, 48 aa, Homo sapiens
FSVPLLAPTYALRGLVTTRVASWSPPCTTRCSFPNCSCLRYYRAWVSL

SEQ ID NO: 1013932 - protein, 86 aa, Homo sapiens
KEGSKGAHQPGRELRSSTGDREEGHSTRKGRQKGRTRNNGKGDRGTQTAGKEAQGDEKKKQKRGSWLAPFSVEKTECQEKKSTRAK

SEQ ID NO: 1013933 - protein, 47 aa, Homo sapiens
MRTFFVPGAHPAPGLPAAFYIRLYCLGSQMAPAEGTPCFPIYIIKGS

SEQ ID NO: 1013934 - protein, 60 aa, Homo sapiens
GYNEKDGSSFWIKSVDESEAISLNLVVNKTIFAKGETELAGIYQLPETQGIQIILLNDWS

SEQ ID NO: 1013935 - protein, 109 aa, Homo sapiens
RREGGPRERKKRQNEDIEEKLGGREERGAGAGGEEKPSRDKRISRETGRDESKGARFGFLQDLGDYRPPTPSRRERVAGTGASRRSPMKGRGIVWTIVFKDWNKNNLFW

SEQ ID NO: 1013936 - protein, 33 aa, Homo sapiens
MATNPLFRRVWKTGQELFTGKFPDSRLGTARLT

SEQ ID NO: 1013937 - protein, 83 aa, Homo sapiens
MNRNTSLFMFAIDLRIILKFDFGFVRDNKIEELHHFSDFASNSLESGYLLIDMSLSSILPVKVALPSSLAKPLYLVPQKSFYS

SEQ ID NO: 1013938 - protein, 90 aa, Homo sapiens
LASRINAISASASQVLTPGGSHEPEFKTNPAIMLKHHLYLYLKLAGLVTHACDPSYSGGRVLRHENCLNLGVGSCSELRMCHYTPAWATE

SEQ ID NO: 1013939 - protein, 77 aa, Homo sapiens
YIFTPALSDYYRESWYPPAGNRSDFPGPTQRPKISGAWWQIPVVPNTSGGTRGEDHLNPEVEAAGALGSHPLYSSLC

SEQ ID NO: 1013940 - protein, 33 aa, Homo sapiens
EAGQPHLMIACIPKKGKACGREPAGCHADDGVI

SEQ ID NO: 1013941 - protein, 31 aa, Homo sapiens
SPSSRAIAATSGEAGPPRNSSATVTITRMMQ

SEQ ID NO: 1013942 - protein, 68 aa, Homo sapiens
PRVITLAKWKPSFPKAYGGSLRQVVLPSVRPQQLWLSWCQPAEPCSRERWVDALIEHPKQFLEMNKVL

SEQ ID NO: 1013943 - protein, 39 aa, Homo sapiens
IEVTNELTKHYHAGGGDSKRYRCHRLEEDMRLLSKLHHS

SEQ ID NO: 1013944 - protein, 48 aa, Homo sapiens
LGAGGSTFCHRLAELENWRQSFYHLIYSLAWFETQITRESGSVVVCRC

SEQ ID NO: 1013945 - protein, 33 aa, Homo sapiens
QESESLSLLPPHAIHLLKPSDQLNRTERLKIQE

SEQ ID NO: 1013946 - protein, 43 aa, Homo sapiens
MQASLTHRKQVFAKPRGVFPSAYKCYLSNCLENNPPPNPEGTR

SEQ ID NO: 1013947 - protein, 33 aa, Homo sapiens
MSLLKTRALTVQPDSLVQYHVLTERCPRKKWQK

SEQ ID NO: 1013948 - protein, 72 aa, Homo sapiens
SPSCYLIQTRALNPREQPTLDVVPTSAPKTHLPGGEWLQDNGWAPSVLTDATVDACIPWPDLGQQQRAIGKQ

SEQ ID NO: 1013949 - protein, 81 aa, Homo sapiens
ETNDLYMLKGCVVGTNDSGLLTLRKSLLVHEKRRVSGVRLTLSFIDTTSIVLAMARFPDHGGEESHSWDSLKKDRMCKGRR

SEQ ID NO: 1013950 - protein, 75 aa, Homo sapiens
GGPKKPPLLHAKRPCWLDLADPFSRPNSGPAPGAVARPVGRKGGGAFYPVSCPPLRNTGACLKGPGPPGPPPLVA

SEQ ID NO: 1013951 - protein, 58 aa, Homo sapiens
VTVGESYRSRSTLGHSRSHWQGSSSHASRPQEPRNRRISVIQPLRQNAEVVDLTVDED

SEQ ID NO: 1013952 - protein, 47 aa, Homo sapiens
ERAGTGCADRGVKDSRIGGMMKTLLLFVWGLLLTLGELASSWVDQTV

SEQ ID NO: 1013953 - protein, 32 aa, Homo sapiens
KEVTNGQKVSRAQPAAPPVGDAWSASSGGPKE

SEQ ID NO: 1013954 - protein, 99 aa, Homo sapiens
TAYYNFTGLYFTLLQASEYFESPFTISEGIYGSTFFVATGFQGLPVIIGSTFLTICFILQLIFLFTAKHHFGFEATPDTGILYMWFDYFCMSPSIDEGL

SEQ ID NO: 1013955 - protein, 94 aa, Homo sapiens
KKLRALRSSKGPSGKEDGPELGKGGMEDQLAFSCGKASAFAPVSCLYYNPNYLWEQQLKKGKRKLGQTEVTAPPSPALPPSACVLAAPPLSSCT

SEQ ID NO: 1013956 - protein, 91 aa, Homo sapiens
LVKWFKAPRGPGSKMLIVHVVGYGKYELEEDGTPSSEVSNSSCEVMQLTYLPTSPLLADCIIPIADIRAFTKKLNLLPYIKIVKEIKSSHV

SEQ ID NO: 1013957 - protein, 116 aa, Homo sapiens
MELEGFYRENSYKCSGVLAVKCLLLKDEQDQGGIGRALAEKPAGLCQFAFPALVVWHYFQNCTFLLVMTFDTPAMTCVSVNMKFCGSASGGRGKEEVLLRFVRNKYGHMFNKTVLL

SEQ ID NO: 1013958 - protein, 70 aa, Homo sapiens
NTFSQMEALIPQRATGLLPTGLGPDPSPLGRVNSSGGGDVCTYVNEKRDVSTDAFISPGMCIVFTLRNQG

SEQ ID NO: 1013959 - protein, 123 aa, Homo sapiens
KLHHPDPTTNSHPKQANMTNTLIPSTLLSPGGLPPLTGILPKWAIIEEFTENNSLIIPTIIATITLLNRYFYLRLIYSTFITLLPISNNIKIKGQFKHTKPTLFLPTLIALTTLLLPIPILIL

SEQ ID NO: 1013960 - protein, 67 aa, Homo sapiens
NQLSLQELQTSPLFAGDVCVWDYGHSVEQYGALGGTARSSVDWQIRLVRALLQAQQAKVHPHLPDKV

SEQ ID NO: 1013961 - protein, 119 aa, Homo sapiens
DIQTERAYQKQPTIFENKKRVLLGETSKEKLPPYYKNIGLGFTTPTVAIDRHLHCQEMPFTGNVSIRRRILFSVVTKMKMQRTIVIRETICTTSEYNRFEKRHKTCLYTCPLASGRQIR

SEQ ID NO: 1013962 - protein, 107 aa, Homo sapiens
EVGAGGAGSCWDGQAAEGKYLEDPELLLQSNPPNQFLDSLEGQAPTTQNPGFPGGRLVPPALSSQAGPASKHPGCHGNRMPPSYCMPPPPEEAECTHRELIVMFIML

SEQ ID NO: 1013963 - protein, 116 aa, Homo sapiens
QIRKTTYAQPQQVPQIRKKMMEIMTREVQTNDLKEVVNKLIPDSIGKGIERACQSIYPLHDVSVRKVKELKKPKFELGKLMDLHGEGSSSGKATGDEEGAKDERADGYEPPVPEAV

SEQ ID NO: 1013964 - protein, 40 aa, Homo sapiens
MKLCCHGPFWKFLVPFLNCYNLYFQTWFIFILCNPYKDNL

SEQ ID NO: 1013965 - protein, 70 aa, Homo sapiens
EIRIARARKAGNILCASQNPNWRFTSESEVSMESAKSLERCCSFFAFDKIINGTLLKLNKASFNMLRFVE

SEQ ID NO: 1013966 - protein, 32 aa, Homo sapiens
MPGGEMRISIIAANVFLRNVGFSFMSLIILPS

SEQ ID NO: 1013967 - protein, 93 aa, Homo sapiens
MHAMLAAPFPSWAPRVSPDPGSQVMFPPPPAPLTTYVSSRHLHAHLVLSHRPQKGGARGARLAESGREQGEGGRPKIPPPFPNKDEGTKVRLR

SEQ ID NO: 1013968 - protein, 104 aa, Homo sapiens
FGRFVKDMKIKSPEEIYLFSLPITESEIIDFFPGASLKDVVLKIMPEQKQTRASQRTKFMAFVAIGDYNSHVGLGVKCSKVVATGIRGAIIAGQALHRPRARGY

SEQ ID NO: 1013969 - protein, 86 aa, Homo sapiens
GIVGYEETPRGLRTFKTVFAEHISDEWKQRFYKKLHKSKTTAFTKYCKKLQDADGKKQLEKDFSSMTKYCQVIRVIAHTQMRLFLC

SEQ ID NO: 1013970 - protein, 101 aa, Homo sapiens
ENEAITSAELRLFLEQVDQGPDWERGFHRINIYDVMMPPAEDVPGHLITRLLDTRLVHHNVTRWETFDVSLDPSLDPGEEAKLWVAIAVVTSIKTRTNQGR

SEQ ID NO: 1013971 - protein, 68 aa, Homo sapiens
LSSSEVANRSKKSRALFLSAAVFCIFIICFGPTNGLQIPDYSFPSDTFTTEGDYFVLPPLCSVSADIS

SEQ ID NO: 1013972 - protein, 61 aa, Homo sapiens
MGGSLSNERGDVIDYSSSGVSTNDASSPDPITEEDEKSDQQAVSFSRQGIFRTVKLFQTDL

SEQ ID NO: 1013973 - protein, 123 aa, Homo sapiens
FLFVRTCASGETSTRFQARATIFVCGGLGGRSRAPCPSHGHCSHPVCAAVLLSAERAQSLPILITRHNVPNSQPHHPFSVMTLVGCRRYLLHTVGEIKGRQSPGTRDGPSLSLSVPLIQLGPS

SEQ ID NO: 1013974 - protein, 122 aa, Homo sapiens
EVEPMFKWTRVGSRLLGRSAYEFRAGRSGRRSGFPPSSICSMYRCTAQNPLGSTDTHTRLIIFENPNIPGRNGGLYMVPLAHWCPAHLGARPDSDSGADVKAPAPATPSGTDISTAGFHFFT

SEQ ID NO: 1013975 - protein, 312 aa, Homo sapiens
QGYGVLAWSAFLVYFRPFFTWIFLGRVRLPSMWGGDSPRVPYGGVSPRAPGGVAPSLMILFMLLVLIRTTLGLRWLVFLVRRLPPRPDWGSNVFFLSRGGEKYTSFSQNVVGPSIAGAQLAWASPLSYVGGVRSRFHPPLPLLSMGGVAAPRVVFSPAPGSPMNSPRLCSSFVWWWEHPLCDLLVVWRIKHAPPPPACFLLGCRGAPPTHSRAGFLYVMRCAPPPRGGRPPLPFVFFMLDPSSLRGDLLCREFLLVAPSGRGGPPLLRLCSPPPPPHACLMDVVAPPFFRGGPPATPPFFFFPKKTPLPPPT

SEQ ID NO: 1013976 - protein, 120 aa, Homo sapiens
IVHPLFARPVPHAYIVVSIPCVSYSLPQHLPHILCALSYHPEIAADSYPVQRKRSGMAHRYEHLHICVYTPYTLNEASKVHSTIPYSIFISIRTSNTPIAYAQSNYKIQTFVSLLFPNKH

SEQ ID NO: 1013977 - protein, 31 aa, Homo sapiens
TGRPRVREQINKDLHNTLEDLRLRRESPESE

SEQ ID NO: 1013978 - protein, 78 aa, Homo sapiens
SLFFFTSPPPDSPLIHHPKTVTSSEPPEIHDEKIMIATMRKFPPNSILPPSNIRLPPHIRHQEAPFNTIPLEIPSLRL

SEQ ID NO: 1013979 - protein, 71 aa, Homo sapiens
QSACHVIAVTLGSSLQESGLREIYNAKAVETGEKLLKSCNSNTAWLALALRVCRQPSCSTPRVNVEEMMSE

SEQ ID NO: 1013980 - protein, 77 aa, Homo sapiens
DLGLSRAPGLRLGEKGERGPPRPYGIPGCAAKGLLDVLEPKGPEGPPGPNWCLAKGEKGEPGRPGDPCKWWDLLLLD

SEQ ID NO: 1013981 - protein, 70 aa, Homo sapiens
IQPGPAKWSGQNKAPVKTWRRRERRSSGHIEGCVTSVLGPSWSEGQHHPRPHLAAVAAPWVCPTKVIKVV

SEQ ID NO: 1013982 - protein, 100 aa, Homo sapiens
APPLLPPGCALLLFPGGRPVVPLGGGSARLAAGASVVFGCLAAGWDSAAGPPFFGEERVGPLAVGEGAPEEFCYLCVTRMDDNDSSDINLTPLIEIPFMK

SEQ ID NO: 1013983 - protein, 99 aa, Homo sapiens
VRQRVPTSRHCPSYQFDIGVLRVRVSLGGWSRRVPSTLVFHVTVGTDPKKTNKTRNKKNQKEKTLLYPRVVTLTDPTPPSRSEHGPPSSNVTRLYQRVT

SEQ ID NO: 1013984 - protein, 85 aa, Homo sapiens
HRLQARENRTEGRSDGASMGKVGGHRDVAEVRLRIEDSEADPCLAALGLRRAPRSGHRCPLEDLLVTYPKHLHRWTLASPLNPRT

SEQ ID NO: 1013985 - protein, 70 aa, Homo sapiens
MEGGVHRTSRSVRTKKCEACPARGRAQEAPVVVDSGFPPRRVALVLPPKHVHTWTRAFTLTPVLNSNTAF

SEQ ID NO: 1013986 - protein, 29 aa, Homo sapiens
GQPSSQPNSNVSSGPPSPSSFLPSPSPQP

SEQ ID NO: 1013987 - protein, 59 aa, Homo sapiens
QPALLVVGDSSPAVDVVECTKNLDPTKTTLLKMADCGGLPQISQPAKLAEAFKYFVQGY

SEQ ID NO: 1013988 - protein, 113 aa, Homo sapiens
PDSKSFGRHHVRLAVFILDVKGKPLISRNYRADVAMSKIEHSCLWYREEEAPGPLLSHGQVHSLQTQHLYLVATHRDAMLLVYSFRIDIEVDIQEGIGHLYRFCGAWFETRTV

SEQ ID NO: 1013989 - protein, 132 aa, Homo sapiens
GEIWRSTDHRGRRVIVNNTESIYMSYDHVDSAFNDMKNVPEAFKGPEGILPYPYRSFSVQGKDAMQSFMMHFIIMKTVRSAAFGATTSGTVSGGEVAGSSVPQVASRRAHEFVSGVQCAQVSPVGLYFTATG

SEQ ID NO: 1013990 - protein, 30 aa, Homo sapiens
MKKAVPPSHWVRPPFDSTQKGFHHQESSPG

SEQ ID NO: 1013991 - protein, 30 aa, Homo sapiens
NDCTNIIRKPVVCGVSSLGIDHTLGDTLEK

SEQ ID NO: 1013992 - protein, 30 aa, Homo sapiens
GGLCVRTGYTPNDECFIFLDVSRDFVASAE

SEQ ID NO: 1013993 - protein, 86 aa, Homo sapiens
MTRTGAGALPGPSSGLPTPIVSPEGELTITTDVEDLSTALFYDTVPDTWVARYPSMMGLAAWYADLLLRIRELEAWTTDFALPTTV

SEQ ID NO: 1013994 - protein, 269 aa, Homo sapiens
MRAPSLWDFQKKGLSPSCWLDYTTPNPCSPNPEEGARPGRAVDKEPGGFGERMAGSMVSRGGGSHLGGHFLAAMTTESATPPKATAVTPNIHFHAINQAPFPGHLAAILLAFPIIFLYNSFSFLLFSSFFFTIFESSAFDRLFGRFQLQGCPQDGDGLTVLPLLGQHLALAEESLDVVWLVLQHKAAGAQGCAVVVELQLRGRQVVQTLHLQLQELCLLLERHVHFGAGGDSLDGEVVGVGGQDEYALLVVGVAHSRFRLAGHALLPVS

SEQ ID NO: 1013995 - protein, 103 aa, Homo sapiens
QWRTGLKLLSVGWDLHLKSAGGLPLAEGSWLWHVAGLWLSPGQAAILVSVALVIRAAPCPGAQGNEVAMDCQDMARVDRPGAEVKEVEMFLSVVLGQGPREPG

SEQ ID NO: 1013996 - protein, 41 aa, Homo sapiens
RLVSATPWIILAKDFAIYFPAFGRISLLPEVLDERSSSGRF

SEQ ID NO: 1013997 - protein, 38 aa, Homo sapiens
AKLGPGRPHHDETGSCCSDGRSPGSGGCVVLSMGFIGA

SEQ ID NO: 1013998 - protein, 238 aa, Homo sapiens
FLRAAATLPESTGHRSTITYPKFGPPPAATSPESIGPCLLLAPGDFGPQLTRVWLVLLLLTLQVGVTAGAPWQFAPCSAEKLALCPPVSASFSEVTRSAGCGSSPMFALPLGAACGVATARCARGLIFRALPGDQQPVHALTRGQGAFFHDYYASAPHSSEAGSPESPESTEITEEELLDNFHLMAPSEEDHSILWDAISTYDGSKDLHATNIKKWKEPCRIELYRVVESLAKAQETS

SEQ ID NO: 1013999 - protein, 64 aa, Homo sapiens
IVDVNQIYKIHYSPVINGIRSKTPSGCLKLANAEPYIYYVFVHIYDKDLNDKGTVTTITVKQQL

SEQ ID NO: 1014000 - protein, 35 aa, Homo sapiens
IKDILIQYLDLLVADPRLLRAKKFGGPSALLVTIN

SEQ ID NO: 1014001 - protein, 117 aa, Homo sapiens
TTHARSAVNETYNATHTRNTMRFFAQRSFSFYFRSSHEKKEDKRGKHTHREENPSVAQRAPQFPILSHENCENAHGVLYKSPPVSLSHTTTVKFCVVGCSTLCLSATPTHRRGKAKG

SEQ ID NO: 1014002 - protein, 106 aa, Homo sapiens
RNAWAVSEPIAHEDTASRQGVSFTPSPRRRRRGNTQKERLVQSPHSYFTGMCNAPGVLLNHHRSLATCTNGKFCVLAAPLSFASLQEETQAYRRIFLQEEAALKAL

SEQ ID NO: 1014003 - protein, 112 aa, Homo sapiens
MLHCEDPGIHIGAFPPVFLTCMFLVETEFTLAGTISDEAFWRLDGKSCASPLCPVPPPSTVAKPGKPLTCRCCCCHFFLLSLPFLLLDGGLFLTSVSELLGGNKHINEILFR

SEQ ID NO: 1014004 - protein, 103 aa, Homo sapiens
RQTEPPRPSEGESELVSGLNIEYVQAPRPFFIAEYTYIIINTLTTTIFLGTTYDALSPELYTTYFVTKTLPLTSLFFEFEQHTPDSATTYSYTSYEKTSYDSP

SEQ ID NO: 1014005 - protein, 205 aa, Homo sapiens
MPWTRRGTPDLGEPFGVIAAAVLCCLRWRLKCGSACTMGALARVMLQEHQTRVPNPWPVWHACASCRDTAARPAPRMRSSSERHAELACPSSIRGTLEHRSYELTCGDAMAAEDAAPVVTGHTDFVAAADRAEVAGWWHDARVSLLRSSLRFSISYSGGVTALPVILFSDSNWHVSCLSTLQPPPKMAWSVGCGWAVASVVSAAP

SEQ ID NO: 1014006 - protein, 227 aa, Homo sapiens
MCGALGRCGRGGCCIPDVVCPHPPPVVCPLGLVVVSAPIVGPASDYFLSVATPPRCLWRHPRSVVVATPEQRSPHRRRVVWFVAPAWFSPRGDFFSPPGRGSLFLLFVAQHPTTRRSRPRRFERWCISLWWGKNRGCFLAACDILAHCVGPSLVWCPPPPPPRCDSLIAARISHRERCPARNYYSLVCSPHCLYERDTPSPLWESSVSLPRALSQQCIQRNNIAREI

SEQ ID NO: 1014007 - protein, 104 aa, Homo sapiens
MLLNLEAMRQSPLYSRLLEPAEVQQLADKYHFRGHLRDQDFFTMICMEHPKLFHVLDCTPNRQLWTWWRDHGYSDAFEAYLRCEGHVKIYHGTGKTGIPGEEGV

SEQ ID NO: 1014008 - protein, 78 aa, Homo sapiens
GSMLFPIPGLRLISLNMNFCSRENFWLWINSTDPADSSSGWWGSFKAAEDLRAKVHIIGHIPPGHCLRAGAGIYECAS

SEQ ID NO: 1014009 - protein, 70 aa, Homo sapiens
EHLLPLFLAQLKDEPYARLNIISNLDCVNEEIGIRQLSQSLLPAIVELAEDAKWRVRLDHHLSTCPSWLD

SEQ ID NO: 1014010 - protein, 99 aa, Homo sapiens
MMPKRQCELREGDKAAGGWKPRKAPPTSYFSALCPRVLRQAASRALPHSKRTGDVTPGKKPYLCKTFGRCFSVQGNLQKHERIHPGLKESSASITQIHF

SEQ ID NO: 1014011 - protein, 71 aa, Homo sapiens
AIGMAEFLDKDDDLCNRSRTSYCHYDCLGLAEELDLFPSFLSLQSFEDPLVGEDTERANSIGLFLEKTNII

SEQ ID NO: 1014012 - protein, 69 aa, Homo sapiens
LNINPELSEAVTKSSARFVFSVKPDFNLDFFSIKLKTQEESSTVYRNALRILQKATDSLGSESFGLFHV

SEQ ID NO: 1014013 - protein, 63 aa, Homo sapiens
MQLQKLNNQYFNHHPYPHNHYMPDLHPAAGHQKEGDKPALSEIGTPSTAGAEHPGVRGGEQDP

SEQ ID NO: 1014014 - protein, 68 aa, Homo sapiens
GTRQLAEKREHEKEVLQKAIEENNNSQENEQKRKLHPQNRKLIKENREAQMAAKLGTFAERRISTLKK

SEQ ID NO: 1014015 - protein, 69 aa, Homo sapiens
GGVARRQQRRQALREAEADKPERLGRLKYQAPDIAVQLSSELADSLRTLKPEGNILRDLFKSFQRRNMI

SEQ ID NO: 1014016 - protein, 75 aa, Homo sapiens
RWSRALENNLVPGGPYFVREDEETIMNQEKLAKLQAQELISGKETARRKKKVVHENSTEDDKKLQISLKKLGVNN

SEQ ID NO: 1014017 - protein, 108 aa, Homo sapiens
ELQAQCADELLKRVYGSFSVNPESDTMSLCYKTLKIFRHPGIPLCIMLACGGEIVLPQSLKNTSKFQDAGKEGENRAVIHYGDDETMYEKSKKDRVTVVFSTVFTDND

SEQ ID NO: 1014018 - protein, 69 aa, Homo sapiens
MIQLLQSHRIKTPVDLVSADLEEVAQKYGLPYKALVAPAAGAAVLSSLAFPVNSADLYEELKTPTAILA

SEQ ID NO: 1014019 - protein, 89 aa, Homo sapiens
MATTAKKTITISLAAKVCWEPITCGNGVVDFLRRILLDDDELTVIEMVFYIDDDFDPATIIRGKTTDEARKLGLVLERDDHETLTIGRF

SEQ ID NO: 1014020 - protein, 75 aa, Homo sapiens
RPGISHYFVSLANHPDRDSLFASSSALTSSVPVQNDLVCILLIVSVAPRPYIHPGYSEVLKSDGIRLSNLLPSSL

SEQ ID NO: 1014021 - protein, 115 aa, Homo sapiens
MLLISSSLAKYAPKHYGQQLLLSMEHQLPKMKTFHEPTTLFGNSLPKCTALKPEDNTLTADAKLWDDAKNCFARCTAAASKALPFVLQGCCLMLKRALIPMQLVAALMTLWMVYP

SEQ ID NO: 1014022 - protein, 73 aa, Homo sapiens
LGWKNWKVKQETCHAKKLKVAKNLFWKLAFFQAKRRNGLFQLTTMCSQELYYKVSILTTYYIVSFYSDFPPVS

SEQ ID NO: 1014023 - protein, 174 aa, Homo sapiens
IIARLIMSAAVPCHWRVNGCTFSRCTSTIAGFDIRQIQTALDGEMSEGELVDAFRHVSDAFEQTSETIGVRAITQINDMVRQRLLNRFTSEQAEGNAIYRLTPLGIGITDYYIRQREFSTLRLSMQLSIVAGELKRAENAAEEGGDEFHWHRNVYAPLKYSVAEIFDSIDLTER

SEQ ID NO: 1014024 - protein, 84 aa, Homo sapiens
SSFAWPLRITYCVTFRQVPSPTLGPQFLTSGKQGVDQMITMGLPSSGHQEFVNIRAPGLEGRARAADWSLSFREDFIGPERIAE

SEQ ID NO: 1014025 - protein, 80 aa, Homo sapiens
RKLAEAEETHKRPQSQKGGQGINDVNTEGNAIKSTIGNPTTTQYSSLNHSLNPKARSTMSVQGPPERGYPSLKLSSRENK

SEQ ID NO: 1014026 - protein, 66 aa, Homo sapiens
YPDMMMDPPICYITRPISRHYETILHSDIKDTHIPKYACAYDHRAGRCLLTSSRPAPKTAETSENT

SEQ ID NO: 1014027 - protein, 80 aa, Homo sapiens
FPPPPGVVLSPGRRAPVSSDIPIPVRICAPASLLIPAPQIFSLLSPKHTCPCPRGRPGIALGSRPVGQNGCSGEVKQVWA

SEQ ID NO: 1014028 - protein, 91 aa, Homo sapiens
INNPINLGEGPKLGPFEQQDGVTHYYFPMIASNERGFPLPHCDLTYSDLETRIFKRNTSEAVFYYLFSYIKLWFHLNSVFLMLSQVQVIGL

SEQ ID NO: 1014029 - protein, 93 aa, Homo sapiens
KKQISTLLLLLQLLPPIQVNLEVSKLQQKREEYKPVAKETDKYIKEFGSRPPPPVNPSKGKYRRICLVAEFTTSLTNFQKVQRQAAEREKEFV

SEQ ID NO: 1014030 - protein, 82 aa, Homo sapiens
MTDEFQITPLSILKKQYGLIDFTNKILLMDIIVALVYDVLDDLSCVDYESEYGISVCYYHHSCSISRFWLDWGTNIWRHSFI

SEQ ID NO: 1014031 - protein, 100 aa, Homo sapiens
WKEKQQNFDKKRKAKTNKKMAHIKKRNTENAYDAIINWEANVTGSQLSSIFATSDVSQHNILTSHSKTRQEKRTEMEYYTHEKQKGTLNSNADYEDFFNK

SEQ ID NO: 1014032 - protein, 55 aa, Homo sapiens
MGFLLFAPRCLVSWGPSATFLPCPLRNARPVQGPEARQHPKVDFVWVLQRAGGLL

SEQ ID NO: 1014033 - protein, 72 aa, Homo sapiens
AGAGTQVAAGHRAFVYHMKLGWHGKPPVLVRSPFSPRKKGGTQRVLWNTDSPTFQLGTSFMMMASSRIRRKL

SEQ ID NO: 1014034 - protein, 71 aa, Homo sapiens
RTSEQKVLSFLASLFGGKIAVLEINPAALVRAQQSPAWGRSLSVPAQLLCSYQTSPLYLGIAKEKSTKDVS

SEQ ID NO: 1014035 - protein, 67 aa, Homo sapiens
AGPQGCLACDADGRGGCVRGEEASAVEPRRRLRQPHLQENENPPGDQPLPVPPSSRCHTAGMEKGWE

SEQ ID NO: 1014036 - protein, 77 aa, Homo sapiens
TPSFHFLECGHASSASIQPPLTDSFHPLRRETPPASCPPPPEAPGWGGLPSPPTPNIAMPGDAHTTDSPTPSVRCVT

SEQ ID NO: 1014037 - protein, 70 aa, Homo sapiens
EDKIREQQVRERRQTEERRQSNLQEVLERERRELEKLYQERKMIEESLKINKNGLEMENELDMSNQDIKD

SEQ ID NO: 1014038 - protein, 98 aa, Homo sapiens
MVLLLTWQSGLHTVIRPGPLDAGQLGYTNWILGDEGVTTCDPPKTGHRDTTTPTDPFRFSLTDVYFVGPTTPGFALNPRTEIAAVLRNVELLYTTTLH

SEQ ID NO: 1014039 - protein, 63 aa, Homo sapiens
MLSEVEKMTGEQDSHSFVSSFAAYIFGFFHKNDKPSPNSENEQNSVTLGVLLVKVCTKKERMY

SEQ ID NO: 1014040 - protein, 67 aa, Homo sapiens
HKDSYRKYPGGSAERESQTGQKVSGRSGWAQLGSQKLLGPGILGDQSSLVLGTGQRAHSITTVVFEE

SEQ ID NO: 1014041 - protein, 74 aa, Homo sapiens
SCEYGKELSLKYISKFEEERIIKKTVNVDVTSYIIEHQKNFYQMRQQLWVSSSSRSFLMCTQFLYTVCFALIKG

SEQ ID NO: 1014042 - protein, 95 aa, Homo sapiens
MANLFIREIVNPPALSQSSHGEASSPLHISIWFHSRCSPRGCGTRGSSALTSLTRPPAPSCCLLLGFKDKTFLKAPAGTGYLVKRRDSVDTSYCK

SEQ ID NO: 1014043 - protein, 73 aa, Homo sapiens
GEGAHGKWQPLEQGLSPGPGKAQQGMGETIYGPVGGAVHTIISYPVSPHWVKGLGEMSKPPAAAGWPPGEGIL

SEQ ID NO: 1014044 - protein, 77 aa, Homo sapiens
AGEVTFADGGRQRERELFLRPPAAGPNSSRRKAHGGGGGQPMAAPDRKRSLANGPNAGEQPGQVAGATSEEDEGEEF

SEQ ID NO: 1014045 - protein, 63 aa, Homo sapiens
MTTAVNPLRPFPCSSYPSFTHSHIVLTPYYYTRCPDPFATLFRAGLHAISSAGVPFARRYRVY

SEQ ID NO: 1014046 - protein, 117 aa, Homo sapiens
MICLGGARGGDGAGALLRQPTVWLSYQCWELILHRFRDYLLWVHTLSEQTQVELLSSQDTQELSLLKDETFKGPENLQTCNLQELLTRPVYKIVDDTIRSFVHLISPAIPILVMILV

SEQ ID NO: 1014047 - protein, 311 aa, Homo sapiens
FLSSACSCAGVLPGGVGAVSWLMGSGAVWGVLGVFVCVVELVLVRGCAGGGGWGEWMGPSVYGKWSGEWMLPVVCGCSGWCGLVCVGDYKRDTHKPWEQSGAPELENQQGQKRGVTPPVCSASSATPGGNFPKRGCGKGGCVGARGAPRSVHKLKDPQVGGAPVDKPSWTVVGPPQGCRLSGIPPECCGKGVLSKNTGGTVAKVHERGCAKGVHSTHNNGGGPPQRGGAPKKEECSVVLAQQCGVPPRKLWFIIMRCLGMSLWGRWENVRDGTQTAVMMCSAGLTKCRCGGEHKTRGVCRWPHVRSDRVGE

SEQ ID NO: 1014048 - protein, 148 aa, Homo sapiens
MEAVEELLELNPGPQDKFDWKSSCETWSGAIFLEVSLFAWFQGHCIAKQNLWSVGGVAHSYKVLSLKVEVAKMRRKGWAAQKRSRWTVVRLFVGWPFAPGLPQPAGGSGHATTPQVPDVSCLVLATGLNDGQIKIWEVQTGLLLLNLS

SEQ ID NO: 1014049 - protein, 153 aa, Homo sapiens
GQNTISFKKLNLLRLPITSGVGSDQRQKEEAAAPGALVVAAAGAAALYTLREKKHCLAQGNPTLSNGNPGQVSILLKKNRKEGAYPPLPATGSEGHSPTSPKKRTRLLHCDHDRGSNKKCLGPPSKFYYQKKEKEKIFSVTNSGEGDYTWLLP

SEQ ID NO: 1014050 - protein, 67 aa, Homo sapiens
VKTHQQTLLPEKLSHKLLEAFHNQGPVIGKHDLHKMAERQPCACDPLTAGAESSPGGAQGPLPQETV

SEQ ID NO: 1014051 - protein, 44 aa, Homo sapiens
MPWAGVSSDLLECPEHGGEACFRAQLLQQWHDCGGPLQDGKRKV

SEQ ID NO: 1014052 - protein, 65 aa, Homo sapiens
MADAASQVLLGSGLTILSQPFMYVKVLIQVGYEPLPPTIGRNIFGRQVCQFPGLFNYASKHISFP

SEQ ID NO: 1014053 - protein, 83 aa, Homo sapiens
GTGDCPRESREDYWRPDRYTKVKVRYCEEMIRMIGCVIGIWLLPRYIVPFRVWFQWCVVDRFFRKLCPIRINNGVFKKKKRPK

SEQ ID NO: 1014054 - protein, 78 aa, Homo sapiens
EVVEEVEAPVRPQWFVKHHTVHLRGPVVHPRSVKGVPMVKGRYLVDRRYEGSHHVVKPKFITLTVASAAASDTRPVQT

SEQ ID NO: 1014055 - protein, 112 aa, Homo sapiens
ERSPLLVDPVSVSFSPVPSLAEIVERTSPGENQGAGTDLQVVSPDPEQPSLCLIASPGAPPCAVLHLTTCTPFVAGPELAYGIYVIHQAGNGHLQGKLLNVGVREALRYEEW

SEQ ID NO: 1014056 - protein, 67 aa, Homo sapiens
HKLKADKARKKILADQAVARRSKTKAARKPVKSASRPSRGEIIKSLSKGAETKKENLPLCLYILASV

SEQ ID NO: 1014057 - protein, 69 aa, Homo sapiens
VVTYVYQLIGDDVKVERIEYKKPYSQACLDFCNSLFLLKSRIKHLRATKLYHFYNIATVKYNTIFSVNT

SEQ ID NO: 1014058 - protein, 72 aa, Homo sapiens
QKRDDEGNVIVWKRRNKADTLCRRCGSKGYHLQKIDLWQCGYPAKRKKKYNSESPRLKRRNTTGTWSIEAPK

SEQ ID NO: 1014059 - protein, 108 aa, Homo sapiens
EEKIREQQVKERRQTEERRQSNLQEVLERERRELEKLYHGKEMIDESLKIKIKEELEMENELEMSNQEIEDTSAHSENPLERYMSVIQQEQDQESADKSSKKMDKKAP

SEQ ID NO: 1014060 - protein, 126 aa, Homo sapiens
HSTLGLASQRDQLDQLELRMQHNLEQQIQARNTTGVTEEALKEFSMMFKHFDKDKSGRLNHQEFKSCLLFPGPMTSPWVEEGEPDPEFEAILDTVDPNRDGHVSFQEYMAFKSSRETENVKSSEEI

SEQ ID NO: 1014061 - protein, 39 aa, Homo sapiens
MRAIKVQWKFFKRKGAPAPGFRAQEIATGSARFTNKLSD

SEQ ID NO: 1014062 - protein, 108 aa, Homo sapiens
MRVAAPKHWMLDKLTGVFAPRASIGPHKLKRVSAPHHFPEEQTEVCPEQEDEVKKICMERFIKIDGKVRTDINYPGWIHGMSSDIDKTGENLRLIFDTSGVCCKSYYN

SEQ ID NO: 1014063 - protein, 79 aa, Homo sapiens
PVQVDQQQRTWEPDEEEGTFRSSIRRLSTRSGRNTWSDGIRPGLPWHLTCATLHLRGQRPLRGPSPALPRRLPLPQEFQ

SEQ ID NO: 1014064 - protein, 68 aa, Homo sapiens
AKGHDMIYLHTSRDQPKPLRPCRRESELVSGFNIEYGAAPSPILHSRIHKHYYNKPPHHYIFLGTQMP

SEQ ID NO: 1014065 - protein, 94 aa, Homo sapiens
LDGPKGTGYIKTELIFVSEVHPSRLQTTDNLLPMSPEEFDEVSRIVGSVEFDSDDEHSIEHDFFLSSLATFFLLICYSRLLLYSFTSCVSREIK

SEQ ID NO: 1014066 - protein, 75 aa, Homo sapiens
SDGIYGSTFFVATGFTALRHYWFIFPHYLLSSATLLFPLYIQTYTLACEAAALILGIFVDVVFDYFCMSPSIDEG

SEQ ID NO: 1014067 - protein, 70 aa, Homo sapiens
LVKALEKLLHGTVIEHPEYGEVIQLQGDQRKNIWQFLVEIGLAKDDQLKVHGFSVLVAHCSLSAGFPCNE

SEQ ID NO: 1014068 - protein, 96 aa, Homo sapiens
DVVPKDDNAAIATIKTKRTIQFVDSVPYYIQGWHQLPASHLLVPGGDLAKDRELCASLSNTTAIAEAWARLDHKFDLMYEKGAFVHWYVGEGTGGR

SEQ ID NO: 1014069 - protein, 82 aa, Homo sapiens
NHKLRVDKAAAAAAGTTSQISMSKAAVAGKKPVVGKTGRRLLLVFKKQKKPLVGKKAAATKKPAPKKPAEKKPTTEEKKPAA

SEQ ID NO: 1014070 - protein, 66 aa, Homo sapiens
EARYTKGTSSFGKLRNKTHTFFRRCGSKAYHLQMSTSGKYGYPAKRKKKYNWSAKAKRRKTTGSGR

SEQ ID NO: 1014071 - protein, 92 aa, Homo sapiens
GIGMAEFFDKHVTSEQEWDKYFHYVAGLVGIGLSRLFSASEFEDPLVGEDTERATLWDYFSRKQTSSVTIWETSKEEESSGLKRFGAGILRS

SEQ ID NO: 1014072 - protein, 143 aa, Homo sapiens
MLTPSFIKSTTLRKLSSRNCREVKAGAQAAAPGVMALRSPGQVFLLAVMDTSSSTRSARAPSRPLGAGPPAPGGCQYHLIPVSSLALAGHLPWPEHSSEPAGSTPGTWGCRPPLGPQLLQQWHDCGGPLQGWETAKLIRSSNV

SEQ ID NO: 1014073 - protein, 142 aa, Homo sapiens
MEQIRTTPWTLISMLGSRTVLFEVLEPSDMQTVGACCVMWMCHSWLRHSQPQARDSRLGVNARHGCLDMCHVMSLSDSDPEMWELLQSGEGQCKCLWPGAHLPQRYYGGARGVWMKFELLCQRRALEAFGPWIHAQWGVNVQ

SEQ ID NO: 1014074 - protein, 110 aa, Homo sapiens
MLLVYLHSGVFLCGVTVVLFLLVVVLGVSPCCAPLWALVIVMLLCLLLVCSSSVVILSTLLFLSTSLVLLVDLIGCLSLLGRLCRSLGASMPLTSSVQFTCRMYFLEYVV

SEQ ID NO: 1014075 - protein, 290 aa, Homo sapiens
RSRTPSEGVSSAFPCVWWRLLGFPPPPQRWGPLPQDPEGPLSSDDAPACPLGPRLTLPIACGPRGGGPKTRPLWGLLLPGRSYCPTCRPQSHEPAMVLSSPQEPGDNLLPMSGAPRSPLQLGARPRGAPFRPQLVTRRCVFFPPGSPPPSSLEAHRMGHRPPFGGLIYRTATQPFPALEWVCGSHLLLPPPVFCSSIPPFLSFFMTNGPTLPRVLRCFRAKFFFGSTRSRNISPVPPLRGAPPRHPPSVRWSSTAPPLSFAGERPGRTLGRVEPAGPRPPLKFLPSLSHK

SEQ ID NO: 1014076 - protein, 116 aa, Homo sapiens
MVGFLPSPHHEGAHTELCPLFFKRLSCEELVTPLAAPLFWRNFFSHQSGGQNTRTSREVDTYLFVGRPYSTPGKECLAPVRLGWAAVFSLFCWVTSYPWAQRDCVLVSLGILSFGE

SEQ ID NO: 1014077 - protein, 66 aa, Homo sapiens
MGRMQCLPGKGPCPRSALPYRRSVPTWLKLTFDDVKEQIYKLGQEGPYFLHRSGCNPREIHMVLHK

SEQ ID NO: 1014078 - protein, 67 aa, Homo sapiens
MRVSACSICPIFPVSPTPFPSYSHSQRKWMASLGGPTFTLPQVQTSGGESRRAETTWLQTIPYRLWA

SEQ ID NO: 1014079 - protein, 59 aa, Homo sapiens
MGVRQGSVPPPARWTQAECPDLPSSSTRVHSGTYGCTGTSIMGSYKSLLAPSISNDPSS

SEQ ID NO: 1014080 - protein, 73 aa, Homo sapiens
LCSVAESVSAEDLSSHVLKTHSEDGTDFIQNQQLHATWLTHYWSTCNRLDIDSTTITDRNTGIICTLEPAYRS

SEQ ID NO: 1014081 - protein, 84 aa, Homo sapiens
MSTSNTPQPFALFFIAEYTNIIIINTLTTTNFLGTTYDALSSELYKKYFVTKTLLVTTLFLWIRTADPRFRYANSYTSYEKLPT

SEQ ID NO: 1014082 - protein, 87 aa, Homo sapiens
TPTIYNLAMAIPLCAGAVIIGFRSKIKDALAHFLPEGKPTPLIPILVIIEPISLLIQPIALAVRLADNITEATYSCTNWSDPRISPL

SEQ ID NO: 1014083 - protein, 60 aa, Homo sapiens
MATIITYTYYLHTSEVQCYLYIPKPHFKSAIEKCITSPPFSNKKGLRDAEIFDEKKLKHL

SEQ ID NO: 1014084 - protein, 87 aa, Homo sapiens
DAMIQDRAGKYGVKAGIINQSHRDLYCGWMISCYCNCQATAAPFRKSVSGQLKLASAFEFFQYGFLIRLVVTHHYIRAVLVRCNIQR

SEQ ID NO: 1014085 - protein, 163 aa, Homo sapiens
TPNVFDAKVTVDGLRAVKPMREWQLSDNAAYMHYCPNETIDGIAIDETPDFGADVVVAADFSSTILSRPIDVSRYGVIYAGAQKNIGPAGLTIVIVREDLLGKANIACPSILDYSILNDNGSMFNTPPTFAWYLSGLVFKLAEKNGGVAEMEKINQQKQTAIW

SEQ ID NO: 1014086 - protein, 113 aa, Homo sapiens
KELCRAGRTAGVGEDLPYQEYSRGITNASYSDDLTGAEKLREELDFLKSVRRPEIIAAIAEDVHGDLKENAEYHAAREQQGFCEGRIKDIEAKLSNAQVIDVTKMPNNGGGYF

SEQ ID NO: 1014087 - protein, 103 aa, Homo sapiens
AKQYITALNIIHYMPDKYSYEASLMALHDRDVIRTMACGIAGLSVAADSLSAIKYAKVKPIRDEDGLAIDFEIEGEYPQFGTVIRVVDDLAVDLVDVYEEIQK

SEQ ID NO: 1014088 - protein, 119 aa, Homo sapiens
RNFERVFKVPHFILIVVTDVDKKCIGIVKHGVHFRRLQILTNIAGIKVRIVNTVGNNAIGTFMRSTQKDFPSSSNAIFRRKPSNSRVEGIVLPEKCFNIARRYADLRVNALMRQIHSPK

SEQ ID NO: 1014089 - protein, 67 aa, Homo sapiens
LRTLPHQRLIVATERGIFYKMQQEVPDKELLEHHRSEGCNLSAAARICPWMAMNGLQAIAEALEQGG

SEQ ID NO: 1014090 - protein, 106 aa, Homo sapiens
KGLPPITPVPPHAGMMAFLSQSSLVTAAWAVRKMVSGIAGGFPLAGVTGRAEVMDAVVPGGLGGTYAGNPIACVAALEVLKVFEQENLLQKANDLGQKLKDGFLAI

SEQ ID NO: 1014091 - protein, 135 aa, Homo sapiens
AGVVLAGAVQDFMVLFVSTGRDGRSLGELVKEEMGPTAGVIALVACFMIMVIILAVLAMIVVKSLTHRPWGTYTVAFTIPLALFMGIYLRYLRPGRIGEVSVIGLVFLIFAIISGGWVAESPTWAPYFDFTGVQL

SEQ ID NO: 1014092 - protein, 111 aa, Homo sapiens
IRHHLVVGCGAGWKPCMLRFNSRNVDCISVGNCCIDWLSEDLVHAIQRRLQVFHCALTFRKRTGCLFNHRIQWQFVDLIQRFHQSLLDLRQAAANGRDNLITIKFTEYRLL

SEQ ID NO: 1014093 - protein, 83 aa, Homo sapiens
ADWDQQATHASRVRVRDLGRGPGVRPEREENLPQHSVCIGSEGASPDPRCCSISQEQREKGTSRAAGPPGVPTPFLAERTLAE

SEQ ID NO: 1014094 - protein, 76 aa, Homo sapiens
PFSLAVWRAVYKALRMPYRILPRQLPQKGRQVATAVQWTKARRQLWVPLGIIILAILFGLLLLSLLIYILYKLGFF

SEQ ID NO: 1014095 - protein, 91 aa, Homo sapiens
EDEEEDTKKGKPMALASAHSFHGVLARSVRGECIPAPGNRGFRFLLALWGAVALQGPGRVMRSPVSCGSCENPPEEAGISRPPALQRRSSY

SEQ ID NO: 1014096 - protein, 92 aa, Homo sapiens
MSACTSRTRVEDLLQPLSLFVSFLRLKEMREHLAYRVNMEGEKLKYYWKCFQLSRFLAISSLFVLSKFNGYSSVVVDVFVCIFDFIKMVVSR

SEQ ID NO: 1014097 - protein, 114 aa, Homo sapiens
MIGVRNRSNRQLGPDKEIREKNGIVRCLDPRAVGQGETVQPGWEQDPVKADAPVPWELPLNPCPKPAGYGINVTICSHPLGPVPGGASPADQQPPRLLHPPQEGPVSLLLWLRK

SEQ ID NO: 1014098 - protein, 73 aa, Homo sapiens
LAEQNELCPGRPGSCFRICISSGAGQVTPGGGMPEAAWTGREGAPGIYSVNRLEGCWQFFPFVHHLARFNNCT

SEQ ID NO: 1014099 - protein, 118 aa, Homo sapiens
KLAGVSLKEESEKPLIEPGSRKWPGVKPTAVTIQNKILLQPTSSISTTKTTLGHLAALEARDAVYLEYLASFEEELKRFRDDCTSQIKGAQALEGTAGSSPCTLSKACMCDPPPDYEL

SEQ ID NO: 1014100 - protein, 73 aa, Homo sapiens
ESSADVKMNECNSWCEDECKPWRQLRHFSFRLCYNSALAWLTSTGKIVEFYFLYIRCPGRDLKKFTIVWALVL

SEQ ID NO: 1014101 - protein, 68 aa, Homo sapiens
EDALEKTYVPCRKTLLEEVMEAVGIKETRKYEKVYVVLSPGAEELLPNFCPNCEGWGTTFSDGKEPVV

SEQ ID NO: 1014102 - protein, 66 aa, Homo sapiens
MGTSTVEITWDETHHAKITIINRKFKKAELLDMDFQGYLDILYVKMEEEDRRGATRWMNGVHVEED

SEQ ID NO: 1014103 - protein, 148 aa, Homo sapiens
PRSPPAGSPPPLRLFSARPSALPPHAPIVCLPNLLCCPSRGPTPPPRAPRSSPRRFLGPRAGYFEGATTPAAPHRFIQWSCEWEKHLVKNVSCPAGYWPRLVPVYLAWVGLFRPFLAVPQASCQPPAAWFLPPAASQRRRKMRRRRSL

SEQ ID NO: 1014104 - protein, 154 aa, Homo sapiens
VPPPPFMSVCPRFCEVWRVSPHPACVTLSPVSCFTCLGIQPHTPWEPPLGPPRRTTLSVLSWEGRGAHHRGEWPSWEATREEKESGAVSITCERELAHLGPQCHWTFLSSLPQSAHRDLPWSVTGVYTLALKAFFSCVINSCVIMIIDKKVCRD

SEQ ID NO: 1014105 - protein, 216 aa, Homo sapiens
MRKNIEDVIAQGIGKLASVTAGGAVAVSAAPEALSAPCCWFCALLAAEEKKDEKKEESEESDRSTWFRRVWDYSCLLARARVNALILPTQHYQQQMNYLERYWSEEWQAAGISSPVSQVGATNSSIPGTSKLSLVVTECGIRMQVGVHHLFKESVWTEDARMRGPGIALAITKGGGTIPWREKWGMERRKNEPEQGRILDPVPSDQRNSPCEEEFS

SEQ ID NO: 1014106 - protein, 94 aa, Homo sapiens
EDHWYSVGIEADDDQAQNKVISEHEWKKTVEDVIDPRVLGKLASVPDGGAVAVLCCTQALQRLLLVLRKLQAEDEERLRRRRSRRVKRMTWDCL

SEQ ID NO: 1014107 - protein, 84 aa, Homo sapiens
GSEGGGPRGSPVRCGQAVRLTHLLTEQQNLHTNHFPSPMSNNQEVSSFGEDGEGDDLDLWTVAAALDSTEEREAAVRFQHDGHV

SEQ ID NO: 1014108 - protein, 109 aa, Homo sapiens
PASGPAGNRLGSGGARISTVEHAGLLVDLEWEIAQVDPKKTIQMGSFRINPDGSQSVVEVTTVPPNKELTLALDEIRLLKKDLGFIGMKETDSEKRIGVCLILEEAAGL

SEQ ID NO: 1014109 - protein, 91 aa, Homo sapiens
NFLTISHVLLFIRLPGFVPYLRDYGLHSCLAVRAWLRDNGSSKRQAVKRQAAPGAWSRWKHGGRNQPQPCFTRLTSAEFQHAADAGESPAP

SEQ ID NO: 1014110 - protein, 97 aa, Homo sapiens
AVEDISIYVYIYISKPVSPWEAVVNLVEEETDPLSRAQFSSPMAGLALSPTVHRHLEEEPLSELLWDGLQEAREKGSAAPLGTGPKAGTPPQDFMSA

SEQ ID NO: 1014111 - protein, 116 aa, Homo sapiens
RQGWELEQEAEGLVMPALPSSGSTRLPSGKGGPGMPAASQQEESTVHVAHRFLLKSRVSLQDSQKAHPRCLSLELTQDAEQVQVQVQVQVQVQVQTADGRIRGVVLNNAPLEKLRP

SEQ ID NO: 1014112 - protein, 121 aa, Homo sapiens
QPGETIFIENGSSNALLARTLGEQKKNVTIITVSSYIAHLLKDAPCEVILLGGVYQKKKRKYGWPFDTAVIQQVHFSKAFIGIDGWQPETGFTGRDMMRTDVVNAVLEKECENSPELTARN

SEQ ID NO: 1014113 - protein, 122 aa, Homo sapiens
LELESVSLTNFNQTSKEHFNPNNAFDAEVYTKLTQETERRRRERNEVEQDVEVAVREKYRDALSRKLEIEQQEAFITLEQEQQVKTRTAEQNARIAAFEAERRREAEQTRILAERQIQETEI

SEQ ID NO: 1014114 - protein, 68 aa, Homo sapiens
PVLWLDSRFLGYPLLKAFFLGHVITFTIPVFVNELKTRITLFYESYTILSKITNFVCLNCDGFRTLFL

SEQ ID NO: 1014115 - protein, 147 aa, Homo sapiens
HIVINEVAQTVIHRQLLHQCRAHAHSHCANDLAARISRIQDASCSTHSEHTPDPNFSRRAMHADLHKMPGKGRLLVLFAQCSEFNALFLLSVCRLRWLHVAWRFGYLGNLAVGKLRLLRIKPDCRGNHFAGFIQAAYAEVEVFAPIV

SEQ ID NO: 1014116 - protein, 122 aa, Homo sapiens
GNPQHITILNHLIQIHATGTCKASPHQLCIITLSGMFAIRHDDHSLEIEFIANLQSSVDRAKDIHIQVDMNQSIFPGCLQVFDNRDAGHPHDSCNFSLAFAFLIVQPCCMKYGVIIEQAAVC

SEQ ID NO: 1014117 - protein, 72 aa, Homo sapiens
VTIIMTVIGAILTSLGGARMGTWHHGGSALYGDYPHGTAAVEADPIITLLGMLAMFAVYGWGQYLFSACHIA

SEQ ID NO: 1014118 - protein, 70 aa, Homo sapiens
MASSGAVSALVATAKSECAVRSAPRSSDGDPTSAVNINMGTLVGSYASVARMLDEVASVPGAEGNYYTFD

SEQ ID NO: 1014119 - protein, 72 aa, Homo sapiens
MAEVEETLKRLQSQKGVQGIIVVNTEGDSHQEAPWDNPTTTQYATLMDSFILKARSTVGDIGPQERSHLPSN

SEQ ID NO: 1014120 - protein, 124 aa, Homo sapiens
MLRSVLPATFLLAYRSDFLNQFHSSLNRDKQILRKPKCVPLFLPHHPLSVLTIFVCFLFFCPCHIIFWCFKLVPSLYILSFSLGSYYKGDNVRCNYQKDRETRISSLFLGLSEILCKINMGCWI

SEQ ID NO: 1014121 - protein, 140 aa, Homo sapiens
MLGVRNDRAPQGWRCAVSLPQVVQPCTPSAVSAAVGPLLTRDTVGLTVSSTRPFLKCRVQSFVAVAVAVAVAVGILLLTLSLVADMHIGSSLPLLFFKVEVSPDPEQVGGPVGARGPGAASTKRDSCCLYFYSNKAEFDT

SEQ ID NO: 1014122 - protein, 104 aa, Homo sapiens
LLLSSQVAEVPYHPDTQTAVAPEVLGKYGGLPRLVGQCSLCKLSLCLKDNSNELEREGEITWHAAHTAAPVHGLPGVLGMHPEWLSETELEPSQLASSPSHYPA

SEQ ID NO: 1014123 - protein, 101 aa, Homo sapiens
ETDKYAASVATVASIQVNLEVFKLQQKQQYTNQLAKATDKNSKEFGSLANNPSEQRQREIQKARLVAEFTNITDKLQKVQRQAAEREKEFVARGGAQYPIR

SEQ ID NO: 1014124 - protein, 76 aa, Homo sapiens
VGKVEGHCQRLPASAPPGKCPGTLQLPDPGDPQSPYLCLKSGYCCFVILPVLTGNACALQHIPLLVFFFSKPAHSL

SEQ ID NO: 1014125 - protein, 95 aa, Homo sapiens
ETDKYTSASVATVASIQVNLEVFQLQQKQQYTNQLAKETDKYIKEFGSLPTTPSEQCQRKIKKDRLVEEFKHHWTNFQKVQRQAAEREKEFVRGG

SEQ ID NO: 1014126 - protein, 49 aa, Homo sapiens
PLSVEVSVGKATDIYVVNGTEILVPAPSPAALASRTHSRTTHSDAFKIT

SEQ ID NO: 1014127 - protein, 40 aa, Homo sapiens
GCYINCSQANALGTRRNRNPEPNLADSKPDEDFPLKVISN

SEQ ID NO: 1014128 - protein, 33 aa, Homo sapiens
LEHLLCSQVLCKDLEGNITAPCRKLPAVWWGRQ

SEQ ID NO: 1014129 - protein, 99 aa, Homo sapiens
LVRSEDAEIEECGKAFYHSSHLTTHKVIHTGEKPFKCEECGKAFNHPSALTTHKFIHVKEKPYKCEECEKAFNRFSYLTKHKIIHSGEKSYKCEQCARL

SEQ ID NO: 1014130 - protein, 79 aa, Homo sapiens
RHEARTEDSIAEGIPKRPPDEQLAVEDDTFEALSSEPVSSPPELPYVMKPQDPGSSANEEAVQLRTPKRPISPNERDLG

SEQ ID NO: 1014131 - protein, 76 aa, Homo sapiens
MPFVRLPCTEITWRASCRLYLRTLVKYLLSFFAARMQKEAEGPLEGRHNEEVGGGGEKKTDFQNWIRHLGEINFPH

SEQ ID NO: 1014132 - protein, 76 aa, Homo sapiens
LTKHNTAKLDKKKGQGAFQFSSLQWQCFACAFLSDGEGDKKTFLSLSRRMYVTKALSSVKNYKKEGGKDSPLLQKF

SEQ ID NO: 1014133 - protein, 92 aa, Homo sapiens
STKPERDKKDTNVGFCCSFTVLPNVRIIRTIIIRPIFFARYAIIIQEVTTSCIRLYKPVRKKEKPKTEQGVGLGMQGKDQGGRKYKRIKELK

SEQ ID NO: 1014134 - protein, 66 aa, Homo sapiens
RGGGLPRGTGLSPAGLLSHGFYGSAPRLVPSGGDKRFDYEKMETGQELLKTFGTMKRGEGSSANRS

SEQ ID NO: 1014135 - protein, 74 aa, Homo sapiens
GELHRGSLYRNGGQSWGAGPPPPYPTASWSLHSPGPDPKLLLSTSGERAVPSFPSTLILAQPNALVLDFLGPPP

SEQ ID NO: 1014136 - protein, 80 aa, Homo sapiens
FLKGGYETFFQGCMDVKLFHSFQSEKALISQCGKLVVLNINYRPAYDQGGPVEILSSLYLGGAYHASKCKFLIKLYITAS

SEQ ID NO: 1014137 - protein, 68 aa, Homo sapiens
EKEEEEIRASVRDKSLVKKAKATARAKKPGFKHMRSHASGGPRCKDGPSLGCDCRTAVPLSSPLHLCA

SEQ ID NO: 1014138 - protein, 67 aa, Homo sapiens
GKGRVRALCSAGPQMWPAVILLPAWAKSSEFCIGGLGLMCRDITPNITGMCPAHLKLVFQTIEDKTT

SEQ ID NO: 1014139 - protein, 60 aa, Homo sapiens
MWLHSGAAEQGFKAVTRRSSGAEDLKIEKVNGHPGRVSRQGYKGMDKPCGCPQGVCNHGM

SEQ ID NO: 1014140 - protein, 68 aa, Homo sapiens
KLRNKCLIPYSRNENNGGRGAEDSSMQTDYTGGHERLTAGVLREPLTVTGDSRLTPPRSSADTTPSRS

SEQ ID NO: 1014141 - protein, 88 aa, Homo sapiens
KTDSDFITKMDYPKQTQVRSFLKGGETPLFKQFFKNWRDPDQTDGLGFSYLFQPYVNVERVPSDGRTLHTFTAMAAQHGHGMIGGTGQ

SEQ ID NO: 1014142 - protein, 39 aa, Homo sapiens
MSNTAMLININIGSTATRRSPNIFSKLEKNVSGRGGRTR

SEQ ID NO: 1014143 - protein, 66 aa, Homo sapiens
EVMLAVEMRNEQAWAIWVGRVGRKISEEIYNLIEKPRPHVSFLPYAIGKFKKENHSVKEHFFYQQV

SEQ ID NO: 1014144 - protein, 70 aa, Homo sapiens
MTKEMGLTTSAQPGLHQKFVESSTIKKIGRVRWLTPVISALWETEVSRSPEVQEFETSLANIVKPRLYYK

SEQ ID NO: 1014145 - protein, 92 aa, Homo sapiens
DSEPPAPRDSSRAGSRCVPFGWSAEEGRQLDFCRQDRYCKDSKDQTDWQIANVCAKRESDDCPQPAQVRVEDVFCAADLSHAFKQLELDNAA

SEQ ID NO: 1014146 - protein, 117 aa, Homo sapiens
PKPKHNPFLSLVPEQGVKLTPRHYAYLIISEGCNHRCTFCIIPSMRGDLVSRPIGEVLSEAKRLVDAGVKEILVISQDTSAYGLMLNIVLASTTASRYNQHGQPVRTVIETGDLDTS

SEQ ID NO: 1014147 - protein, 69 aa, Homo sapiens
WLWMDASSRESHVTANINDNIQTFGYIMHQLTVLIHTSDYYSSREHTNQPLQHIIYSLISLLQVTCSLT

SEQ ID NO: 1014148 - protein, 142 aa, Homo sapiens
RQKVASAQAEHHLVADIAWAVIQYWQTTGDESFIAHEGMALLLETAKFWISRAVRVNDRLEIHDVIGPDEYTEHVNNNAYTSYMARYNVQQALNIARQFGCSDDAFIHRAEMFLKELWMPEIQPTVFYADDSFMAKRRLIWR

SEQ ID NO: 1014149 - protein, 118 aa, Homo sapiens
HRSFELADNGIIFTPQSDLVILNYIANYIIQNNAINQDFFSKHVNLRKGATDIGYGLRPTHPLEKAAKNPGSDASEPMSFEDYKAFVAEYTLEKTAGMTGVPKDQLEQLAECMPIRQE

SEQ ID NO: 1014150 - protein, 113 aa, Homo sapiens
CRRHPMSFDPTGYTLAHEHLHIDLSGFKNNVDCRLDQYAFICQEMNDLMTRGVRNVSEMTNRYMGRNAQFMLDVMAETGINVVACTGYYQDAFFPEHVATRSVQELAQEMVDE

SEQ ID NO: 1014151 - protein, 58 aa, Homo sapiens
MDEKDRCAIFRLLVMVIFAIGLIKLVITAYAPCPGVNSGGTVGIQVSAAAAVLWAVAA

SEQ ID NO: 1014152 - protein, 194 aa, Homo sapiens
MRVLYKGPQGWLTRPPPGEKTVGLQPPRLTDVGTSPNTGGNACPHMGPPDKCSLGALATHKQVNPWLPATMEERNVCQAAIECKAPPPFAWPAKLLREQGEEADFLKKKVNPLVGPHKSEIGGHDAQKNRARHPEDGPEKTYNGEHHPIRHNGWSRYGWAPPGLRNCPPRRRVHTAKTTHQFRSAPETNIPRPT

SEQ ID NO: 1014153 - protein, 64 aa, Homo sapiens
MVVIIEVDGGGRDMNKVTHTPGDSHSPRRRVARTLARSKACCVPQGEVKLEQCHSVSLPAGITL

SEQ ID NO: 1014154 - protein, 96 aa, Homo sapiens
YTAVNLYLPLSWAASTNWRVIQFVPITAKRIITRGYSIKGFCRQCSSAFFIFDVRKYALFLRRTAMLTKRANHDRRPRYFGWRWRIFASITALTRA

SEQ ID NO: 1014155 - protein, 125 aa, Homo sapiens
TYRTPEGTITAFMHMVEYRRNQKQLRETPALPSNLTFNTGEAHLLLQQAIAEGLRRSIPMKFSPSCKRMAMNTLPTWIADSTKAVHIAEQIGPVALKLRSPDIPHKSEVQGVMLYLRTANEVQQA

SEQ ID NO: 1014156 - protein, 109 aa, Homo sapiens
KRQYADGVASRYGGENVSMRRFSGLVAAALLLAGCAGEKGIVEKEGYQLDTRRQAQAAYPRIKVLVIHYTADDFDSSLATLTDKQVSSHYLVPAVPPRYNGKPRIWQLV

SEQ ID NO: 1014157 - protein, 118 aa, Homo sapiens
FKNQRVEAAYRKELVYGEDDATRATPPTVRELFSAVRKNYFRLYFHYMYFNIARILYLQVDNVFGLFLLFPSIVAGTITLGLMTQITNVFGQVRGAFQYLINSWPHWLSWMSIYKRLR

SEQ ID NO: 1014158 - protein, 124 aa, Homo sapiens
FSSNGDRSAVCCSYRVYCRAASVLDDAAHNCFPVRAGCGNWFCKPVWCSGRVYCPILRVKAETLFASDAAGLLTLAAVAVIGSLIIFTLRVNRTVAQTDVATSLNRLRNTMYRLLSNPLKNVYA

SEQ ID NO: 1014159 - protein, 117 aa, Homo sapiens
HFAYLPTGLYVFAYKKDVYLRVCTLIIFFAALVAVISGASCLYLVRRVINRGIVEKDAIINNHFERVLDGGLFFSAADVKKLYSMYNSAFLDDLTKAMGRKSFDEIYKRCRKKAVIC

SEQ ID NO: 1014160 - protein, 83 aa, Homo sapiens
NKPPPQQYRSASDTGNWVNADGAIFYPYIGRLKVAGKTLTQVRNEITARLDSVIESPQVDVSVAAFRLAKSVRQPPKSANPVS

SEQ ID NO: 1014161 - protein, 59 aa, Homo sapiens
MHKGSDGAVENASVYRSYWVADAKLGYRVNRNLDFQLNVYNLFGTDYVASINTSGYRYH

SEQ ID NO: 1014162 - protein, 93 aa, Homo sapiens
HEAEIAQLIQHIHDKGPVRSADFEHPRKGASGWWEWKPHKRHLEGLFTAGKVMVIERRNFQRVYDLTHRVMPHWDDERDLVSKQKQKSSCWIT

SEQ ID NO: 1014163 - protein, 73 aa, Homo sapiens
ISETGACHRRKFPDDGAVAACNTTFCIAENCPAAWLISRQTSVASSSILSVISCFTSPAVILFLTASISIDES

SEQ ID NO: 1014164 - protein, 112 aa, Homo sapiens
PINPAFRFKVDGFFCYLKLIYYPATLSTILKISSRDKPYGSVTKCSVIPSDKRIKRAGGSGFKPLFERCCLRCIQFCITVFNSGFRLASAESWYNQLHVIRRLQPCDPVGQL

SEQ ID NO: 1014165 - protein, 107 aa, Homo sapiens
MVSRHRDHSGTSFICEGETTPLPRVDFSPRLMFLCPCRLFSDHRGGDPTKVGRLSSLFLTPAQQPGLLAVGGAFFFLAQRLFFGGGGGAPFSCRVGGCSCRTPTAVG

SEQ ID NO: 1014166 - protein, 86 aa, Homo sapiens
GKGSPEVTLRPGTSTQGLVVNVKGSVPTGQLSFTNISVATWDLPPRPFQEEPRVRPNPSQAQCKNRLTRGFLASASFARAPRQDTE

SEQ ID NO: 1014167 - protein, 45 aa, Homo sapiens
MPESQMCSKFSRDCEDQKQIKKPESFTKQIVLRGKSIKGPLGKKP

SEQ ID NO: 1014168 - protein, 99 aa, Homo sapiens
IKAVLHRCLDEFEKDPVPDRFLKDLDEKVDLDSAWSLWLWDKASLRDRSFRHLRKDFHRPYVMDVPQDPGKYLFPQKSPSSCSPTGGRFTINSNIPTRP

SEQ ID NO: 1014169 - protein, 55 aa, Homo sapiens
HEGRLSGQRKLDDSIVVKANKHQINRVLTLANINVIQLDSALMERRRHIRLAPDY

SEQ ID NO: 1014170 - protein, 32 aa, Homo sapiens
QRLQRPVITTCGHTFCRRCALKSEKCPVDNVK

SEQ ID NO: 1014171 - protein, 34 aa, Homo sapiens
SNIELLAVQEGIKVLETLVALGEEQNRVQLLALL

SEQ ID NO: 1014172 - protein, 40 aa, Homo sapiens
KQQITWKIGLSNDVNSSPGEAEGRPVQVILKGTYILHCCL

SEQ ID NO: 1014173 - protein, 35 aa, Homo sapiens
LHLGTVTDFKQTNKGVLVFSSAIGKHFPGNSSRPN

SEQ ID NO: 1014174 - protein, 47 aa, Homo sapiens
EVGDDWCIMNWEPPSVTVGATGEAHASIKVKVVDFPDPPVAPTTEVG

SEQ ID NO: 1014175 - protein, 89 aa, Homo sapiens
EASARVGGGMMGLSLGCSQLAVNVGISAPPACSPPHREMEEERELRWHAGVGSEGGDVIECVVSSRYMACTHLLGIALLGIVVSPLCTS

SEQ ID NO: 1014176 - protein, 49 aa, Homo sapiens
RLEIEKKEERKLRMPYDVPEPRKFEADYHEKKDQRIKQFVPMDMKWYKK

SEQ ID NO: 1014177 - protein, 51 aa, Homo sapiens
MGKDLTPITPSSGFTIDLSAFTVVISNIGLPVSTTKVGSVVAVGWISRKAV

SEQ ID NO: 1014178 - protein, 84 aa, Homo sapiens
MLAKLNRINYSDKLYKLALEESKKEGYDLRLDAIPIQAAKASRDIASDYKYKEGYRKQLGHHIGARNIKDDPKMMWSIHVAKIQ

SEQ ID NO: 1014179 - protein, 43 aa, Homo sapiens
MLARMVSSPDLVIRPPGLPKSWDYRREHLLYIHYFINSLHRPE

SEQ ID NO: 1014180 - protein, 55 aa, Homo sapiens
MRVKNTFLGKWTRYPRGPVRFRTHLEAVDQSPDADVLDPVPQRRSTHPPQDEVDP

SEQ ID NO: 1014181 - protein, 64 aa, Homo sapiens
QPDLFKDINMLMHHDRFKVFADYDYIKCQEKVSALYKPREWTRMVIRNIATGKSSSDRTIAQYA

SEQ ID NO: 1014182 - protein, 41 aa, Homo sapiens
PAWCLEKEVESMGAHNAYSTRKHTAYYIKALSKVLPKAVEL

SEQ ID NO: 1014183 - protein, 75 aa, Homo sapiens
SPEQRGSEVHTKKVMIKTIETRDGEVVSATQQQHEVLYKTETLCHQRPSSPLSSLLPEASLSIPGQHNQFFPLGF

SEQ ID NO: 1014184 - protein, 98 aa, Homo sapiens
MSFLVAQAGVQRCNLGSPQPPPLGFKQSCLSLLSSWDYRHVPPRLNFSVFSVETGFLHVGQAGLKLPTSGDPPTSASQSAGITGVSNHRPGSHFSWEG

SEQ ID NO: 1014185 - protein, 71 aa, Homo sapiens
RRARSADVQGQEKMDVTAEARTNLPFYLFVLFRSSMNWMMSMHIREGCLFITRSTSNANLFRKHPHRHTQK

SEQ ID NO: 1014186 - protein, 69 aa, Homo sapiens
FLETVSFLSPRLECNGAILAHCNLRLAGSSDSPASASQVAVITDRVSVSCRLSVVRNHSLLQPRPPGFK

SEQ ID NO: 1014187 - protein, 82 aa, Homo sapiens
KACDQRPWHVVTSDAYRDIKGNPGIAGQVECEYTRAHARTTVRVCTKHNSGTTKPLDTLMPANDVSIVDTVVVSLDRVHSCR

SEQ ID NO: 1014188 - protein, 92 aa, Homo sapiens
NWNAPQEPAPPLEKMFSMRNVCLLPNVVGKARTAENGEGDFLAEGGGVRGPKVVEKYQSACKKSKRPFCSEENRKKKSSSGCRKKRLNEEVK

SEQ ID NO: 1014189 - protein, 105 aa, Homo sapiens
MKNKVIEKVQHIQLLEKNVRAQLVDMKRLEVDIDIKIRSCRGSCSRALAREVDLKDYEDQQKQLEQVIAKDLLPSRDMQHFSLIKMKPVPDLVPGNFKSQLEKVP

SEQ ID NO: 1014190 - protein, 123 aa, Homo sapiens
THVVAPKLPPRKKNVVGKKKHRLRLVGPPREVSASRCDSILSPLVGRSPFLPRGGRPLCKTLRKRRFIRAKSHIIPLVHEQNLHNPGAKLPHVFSPPKQKPTPLWFCNSQTHTPYYNPNGHYH

SEQ ID NO: 1014191 - protein, 152 aa, Homo sapiens
EEEESREETKRKRPTGVSQSRLQGVCCTPRCTRCVRQMSGRLNSGAKMSSVWCPCRGCPCPLKCSWAKAETCHQGAPISNSGTGWYLSLKHALSEKILNRARQSSPVFGSPGKKFTRCRGAKGLQCAFQGQGLYNDKWSAKRSHWVGPSEPP

SEQ ID NO: 1014192 - protein, 41 aa, Homo sapiens
MRYHYIATKIAKIKNNDNTNADRMQITGSVIPSGGIEMDSH

SEQ ID NO: 1014193 - protein, 70 aa, Homo sapiens
DLPAHQLVMEGYKWHFNETVLTVWSAPTTATVWECGSILELDEHLQKDFIIFELLPRARGIPPRAVPLFL

SEQ ID NO: 1014194 - protein, 56 aa, Homo sapiens
DQDILIQYDRTWLVADPTSLRVQKVGGQCRARTRNPTDKPSWLKLTIINSFEGFKV

SEQ ID NO: 1014195 - protein, 103 aa, Homo sapiens
SEERLGHWASLRSSAMGLTSPGSQRTLKLSKAVHKAVLTIDEKGTEAAGACFERHTMSIPRGKSQPFVFLMLTNTVSSSWESGESTKYCFVYPPHPGLVHKRW

SEQ ID NO: 1014196 - protein, 344 aa, Homo sapiens
MCLLPICAWQAPSPDVHISARQHGRVLIPALTTGRFVLLKPLETTRRTSAQRVMFLAIGPETQAPYQKPRGDTPNDPHSCGRDNPMPLSAPNAPQRTSGAPPENRSGVRRRGPLQFGQNESQEGPARKTNGDGAAPLLPKHRGVESQNTPGAAVERGMHALATRTLPRRGSPFVRSNTPTDRRWASSFSSTQQAGPNNRTRASGVRNSPRSKRRISCFTLWCGRHHAEAPPIGRWGNLSYTQDPTMGALLKTPESRETREYGKDRRVSHSQRGMEQCQCSPSRAGSPRSVLPAGHSGDLVLPRCRRKSRVSYNTSVHGPAMIKIFMVYQNLPQNINPHLSRAVT

SEQ ID NO: 1014197 - protein, 54 aa, Homo sapiens
EEVTRAEIQIRIEANEALVKDLEEGSQSPSLTSASEPPLDELPSAPAPLKTRKP

SEQ ID NO: 1014198 - protein, 76 aa, Homo sapiens
MSAKPCQEAREGVQGRLISMCDADTAAGVVERRGAYKILEKPWTSTWLALALSGCAYCDSRSVPTHGLMNKWLLRL

SEQ ID NO: 1014199 - protein, 81 aa, Homo sapiens
LVGWEIIETGIPLSPREPKVGSSSTRSIDSLRERRRSRAASGLGIRPLGPPLVSRVGRNRRLAHLAWVGPILVIVKINAHS

SEQ ID NO: 1014200 - protein, 304 aa, Homo sapiens
TIMRTAVTVVFVLPLWPSTGPVCGPLCCAPAGAAGVVCDPGLVVSAPAMWVVGPTIPLLIWDNIGPITILVAEAKVSLSSRCPPADKMSSVGGYKRGVDPCFYKFLMQQLRLAHERVFRDLPTQIPLWFQWGWDTPRLTRTKHSEVAEISNAPLGPAARGNFRLQPIVFQPPKGFSGGRYISTCATDKTAPKRRVARWWRLPSPHWRGPPKHTGGATGREIIPHPLGVDSNISILRFAYATIRGRPRGGPCCEESLYLHRGDLATEFCLAWDATCEKSWKTEMHDHENNVFKLNEENGESTRMP

SEQ ID NO: 1014201 - protein, 126 aa, Homo sapiens
MSRHEYVRNLLPECALPHNRLSSKIVCGTLVRRLFFEGSSGESQVVVIKMSRRCVNLVGEHHVGSRRARFRLMAEVWVLRPRPGVARNIWPNSGYLPTIGRVTNNATYALFKSRGRASPFGGPLDK

SEQ ID NO: 1014202 - protein, 51 aa, Homo sapiens
QHLRIRTKRLTPGEDGNHTLFYNSHVNPLSTGYDTPEVPDDPGHNKGVRLR

SEQ ID NO: 1014203 - protein, 223 aa, Homo sapiens
ISKDRIPYKAVIKLGKEFRLEKELEEQHGIHCNMTLLFSFAQAVACAETGVTLIFPICWAHPLIGMWQTPTKKSYEPLEDPGVKSVTKIYNYYKKFSYKTIVMGASFRNTGEIKALAGCDFLTISPKLLGELLQDNAKLVPVLSAKAAQASDLEKIHLDEKSFRWLHNEDQMAVEKLSDGIRKFAADAVKLERMLTERMFNAENGKKRILRWTPDLHRRPDGI

SEQ ID NO: 1014204 - protein, 115 aa, Homo sapiens
MFGDPERIVVFDTRGVEPLHKRCAGGGKQLNDYPVETGKNFVGGKALPDEGIMGGLMRPHRQEGGGPLKPPNTKTKTPWASPCGAGGPPPNKNTRREKMCGPPQKKKYLVTPPRG

SEQ ID NO: 1014205 - protein, 76 aa, Homo sapiens
VDTDGRGIADVAWGRLGSVVPTHNSLTRVPSLYLPGVVAMWLPHLSTSIFFAAWVAMGTSWAHILQLEIHPEVMFQ

SEQ ID NO: 1014206 - protein, 68 aa, Homo sapiens
YQEEVVDRDSKLKNEGRVRWLTPVIPVLWEAEAGGSQNQEIETILANTVKPCLYKKYEKLAGRGGGRL

SEQ ID NO: 1014207 - protein, 55 aa, Homo sapiens
ALPSTAFYSSDQGPQALPSPRGLLQNRGLNNSLSGGAGWWQLTNISRDKKIDSPT

SEQ ID NO: 1014208 - protein, 59 aa, Homo sapiens
HNPDVDDRFEASESSFITGDINSSASLNREGLLNARDTSMDDSTTWYHGNSYSIATRIP

SEQ ID NO: 1014209 - protein, 68 aa, Homo sapiens
LGYRIQHKNLPCVKAVIFLTEEGEKCSHWRENWVFQKVHELEKAQKETAEDLFTIRVAQAAGIAELVR

SEQ ID NO: 1014210 - protein, 45 aa, Homo sapiens
RSPKTGIKNLALLISKAGTIKNLQTPSLLQPHANPGYAALQVSLT

SEQ ID NO: 1014211 - protein, 58 aa, Homo sapiens
WLEGPNDSGRNPAACASPVDACPSASLPSPSLCCSRVPKNGYPELMRAQPFFCMIQEH

SEQ ID NO: 1014212 - protein, 63 aa, Homo sapiens
YQQTVCWATSGVAQPLWSRRHHEGPKNLPFSVENKWSLLAKMCLYGSAFATPFLVVRHQLAKT

SEQ ID NO: 1014213 - protein, 54 aa, Homo sapiens
MNIDIASIDMVSEVNMDYTLTMYFQQYWRVKARYSGSLSLTDNRVADHYGARHI

SEQ ID NO: 1014214 - protein, 90 aa, Homo sapiens
RDMYRWPPFTKAKLTYPYVKVYMYQLFRWPTSLPGRVSPRHQAPDLLVELTLLSSSLDFGSERVGGANVSYIVLATTGPRAHFGAMITLI

SEQ ID NO: 1014215 - protein, 44 aa, Homo sapiens
MITRALNYYYTLCFVWMLLMTLARLSLSLAAITGSSEAFPNKRL

SEQ ID NO: 1014216 - protein, 71 aa, Homo sapiens
QEAQGRLCRDVLHLPMCDADTSGPGSSWKGGEPYQDSCKNPWDLLHVVAVYWPLLQAVLTCDSSSSPPHGS

SEQ ID NO: 1014217 - protein, 106 aa, Homo sapiens
DVLEDEVYDPEDEVTRIRRNWNALNDITYPAEPHANVTTSALFSPLLSILCYGEGSRQEEQKLANIAQPGWGAAGEPPCMPTTHSGTGLHTFNLCPPPSFGCFNKF

SEQ ID NO: 1014218 - protein, 31 aa, Homo sapiens
RSSSARPAHGVTHLQFEETFPRDSTCSDTSP

SEQ ID NO: 1014219 - protein, 66 aa, Homo sapiens
MSGSRRISGNFADGYPLGTKHAGFDFGAAPGYAEGKDYAHPTYMRDESVMPLPSRSEITKQNDLLG

SEQ ID NO: 1014220 - protein, 138 aa, Homo sapiens
VDNNTKNDMRSNLNVVYLFACWWVNDIALYDWMIMIKIESIIIIKGIMPSCLSRKGAWAVALWLMDREECVSRRLICEIRDEVLDRALGYPDVSGPLLPARGGFMAARGLLERVFLFFQGPGSPPTGSFSRGNHQNHI

SEQ ID NO: 1014221 - protein, 66 aa, Homo sapiens
MPDSIGYRIRAPIISAVGGKSAAPTLETPIGTDLRSLKTPEQNNPALDCVLGEAQRHGPFNLVILS

SEQ ID NO: 1014222 - protein, 263 aa, Homo sapiens
LLFCRAFALSLCLGFLFVPSFAWLVLSCCIVFFLFFSVCVLLLFACFLPSALFFYLGLLFCLSFSLFLLYSPLFLLFLFLLSVSRSASFCFLILLLLLVYCLSIVVRSHFPFLSSPCFVPGEVLGLSSCFVSSPSVSSSYIWFLMCHLCMLCNTILPVLVWSYSSWLFLASHTSSLVMMMHFCPHVHAGHDACVWLLVPRAPLCSRAIGPHCSRCPPVHGGVYVGCGPPSWRCPCFKEALLSRDAHSVLKGAWELLLSCVTAE

SEQ ID NO: 1014223 - protein, 51 aa, Homo sapiens
SGGSVSRDHATTLLHHDEEEEDDGGDYDRNGDGDDNGDSRDGLALNNNDHN

SEQ ID NO: 1014224 - protein, 86 aa, Homo sapiens
MPNRVTPAESGQKLMSITDRVNGHRGRDGRVIILTSRGIAARTAYISHPNSAPAESFNTELDWLTGVAHSESLRSQSYQGVLLAPN

SEQ ID NO: 1014225 - protein, 53 aa, Homo sapiens
MAKLKQSYEINVTVQPHQPRPQPEGGKVTASLAAGSEDAAPDSGTRESLGLYV

SEQ ID NO: 1014226 - protein, 34 aa, Homo sapiens
MRARLLGTRTKFRPSGQSEAKLFTPLIPMTLTAG

SEQ ID NO: 1014227 - protein, 96 aa, Homo sapiens
GKHRDCRRRNSGPVGTADMVTEKDHHNKEGEEQNAGIKKTLVSAGLSAEKTPLEEEGSRKAGSATNRKMTGGTGAVGSDRGGTKKAGRSEGMTSHT

SEQ ID NO: 1014228 - protein, 46 aa, Homo sapiens
MEGSSQESYYYYFSIRGPADGLLESGRISQISEIDERPPTKKGSRL

SEQ ID NO: 1014229 - protein, 119 aa, Homo sapiens
DYCDYHFKQDGFRALLQLRPLNVLSYLYMLELYYYKTFYELEDLDELIRCTRWVLRCKVRCAVNAVLAPAASGPRLGLIDCLKWLRAEGSCVAVVSRRGLARKGAPEYAHPPRGNKVLR

SEQ ID NO: 1014230 - protein, 41 aa, Homo sapiens
GPQPIFFQMVNEAVTPAKKMVTVCHVGVPKVGEAVPTLVLD

SEQ ID NO: 1014231 - protein, 94 aa, Homo sapiens
AVLVGSLDQSTGSQMFVTSLVKYNIDPRSPRPLATRQRAAAGVSAQVFIEMSGVWRLGAFCGPLGNPRVLATPDCQLTESTGSQHMKLLLNGLR

SEQ ID NO: 1014232 - protein, 78 aa, Homo sapiens
RIASVREHIYRAQSGRECIFFQFTVRWLTWKGVVKPSGFPANSTCRTSPPECKRNVCWVVKGGTFIPWSGDLRVLESP

SEQ ID NO: 1014233 - protein, 51 aa, Homo sapiens
VNWYVGEGMEEGECSRPARIWLASRRIMMRWRIGSYEDEDEGEEESSCLEP

SEQ ID NO: 1014234 - protein, 119 aa, Homo sapiens
TVYQRAVVAVSVGRTGSIRGIVRCFTGFSGFCLQSHRLFSFRLPPSSGSEVPPRGVHRVAPRPTGALGVLVSLQPCRRATRRPCRAVLATAPASLGFSATAQGFGAPPSLESWESLEKL

SEQ ID NO: 1014235 - protein, 94 aa, Homo sapiens
DIERREVESILKKNSDWIWDWSRPENIPPKEFLFKHPKRTATLSMRNTSVMKKGGIFSAEFLKVFLPSLLLSHLLAIGLGIYIGRRLTTSTSTF

SEQ ID NO: 1014236 - protein, 90 aa, Homo sapiens
DIRRKVSIKKSDWLWDWPSRPENIPPKFLFKHPKRTATLSMRNTSVMKKGGIFSAEFLKVFLPSLLLSHLLAIGLGIYIGRRLTTSTSTF

SEQ ID NO: 1014237 - protein, 36 aa, Homo sapiens
FFSQLHVHSRCELLGFAPAVRNKAVMAITHNVPAAL

SEQ ID NO: 1014238 - protein, 81 aa, Homo sapiens
GGCRVGFRVYSPGEKEHCGYMEYTSEGLNARKLPPKQRFVLAGPWKQREKECPHSTYPLSSTIGMWPDSLKLAWGGARFEY

SEQ ID NO: 1014239 - protein, 184 aa, Homo sapiens
RPEGSWPPAPPRSPPPPPTPSVVEKMVGRNSAAAAGVCGAPFFGYRFHRYRQNPSDPHHQNGPPEQRKKLKPAKERAGPAKLPDPKDAEAVPKFPPEEIQPGEELPAPGEYEKGVDPPTNAIAVCGPPQPSPPAPPPTPPPPVSPMPPTKPPTISQRIVSAQGLAEDDVETHPAAPPSPFNPFR

SEQ ID NO: 1014240 - protein, 62 aa, Homo sapiens
RVGPLLILSQIVLMQTVLRLAGPVVALVDGLVRPLAGPDVRRRDPGLFHPSRPVFMMSSSQG

SEQ ID NO: 1014241 - protein, 56 aa, Homo sapiens
MATGTDQVEGLGLVVVSLIIFTYYTDWVILLACHSPRPLLTFPEPWHRHNYYIGSR

SEQ ID NO: 1014242 - protein, 42 aa, Homo sapiens
MPDVPSHPQEPQGPSLEWMKKLRAPPLIEAAPPTVPNKNVKT

SEQ ID NO: 1014243 - protein, 85 aa, Homo sapiens
DLCGKHIEDDIAQCIDTLDSAPCGGGGPLSSPPVCGAPSSFSPPSRREEKRYEKREVSEDTYDDMVCALCDYTPSPLHINSFHTS

SEQ ID NO: 1014244 - protein, 31 aa, Homo sapiens
MLSTMHVITSWVRTKTLGEELASWLIDNTPY

SEQ ID NO: 1014245 - protein, 36 aa, Homo sapiens
TVTNPKRTAQAGRARRPNRLLPKVNQTGSVTSQACK

SEQ ID NO: 1014246 - protein, 31 aa, Homo sapiens
YPTEDYKVYGYVTNSKVKFVMVVDSSNTALR

SEQ ID NO: 1014247 - protein, 52 aa, Homo sapiens
IEKEEQAAAEKAVGKEEFQGEWTAPVADFAAPEVADWSEGVQVPSVPIQQFP

SEQ ID NO: 1014248 - protein, 33 aa, Homo sapiens
GPTLPGAGQELWYDGLHLGRCGPVGLVWATDWR

SEQ ID NO: 1014249 - protein, 77 aa, Homo sapiens
VNSAEEAEEQANTNLSKFRKVQHELDEEVALPHFDLLIQLVLHLADEAEERADIAESQVNKLRAKSRDIGTGGLNEE

SEQ ID NO: 1014250 - protein, 46 aa, Homo sapiens
GVIRLLWRPAGNGTSKRNYVWKACGPMAMLLLCYEAGGSGTKGSTQ

SEQ ID NO: 1014251 - protein, 35 aa, Homo sapiens
MEFQDTECTYFSTPLLLGKKGIEKNWGIGKVSSFE

SEQ ID NO: 1014252 - protein, 33 aa, Homo sapiens
IVGEIRERYGASLRKMVKKIEISQHAKYTCSFC

SEQ ID NO: 1014253 - protein, 38 aa, Homo sapiens
DKFEFEGEAENARAYDIMNVRARVQMLAKFSKKAGTPA

SEQ ID NO: 1014254 - protein, 42 aa, Homo sapiens
CVVEFQLSSGAELRHVLATLGERLTEDEVEKLMAGQEDSNGC

SEQ ID NO: 1014255 - protein, 48 aa, Homo sapiens
KERPGAVSIPKPLLRTQGFSPQPAIPYAVLNSTIVPPLRHSPPLPPLF

SEQ ID NO: 1014256 - protein, 109 aa, Homo sapiens
SLEVGGPEWSPSMPALTVPKSFPGEFQLPVTEPDINNRLESLCLSIDGQALGKRVYRNFNIKKLKTRINALAVKSNAAGPVSGIFRVAQNPPRYFAAFFPPGPSPVLIL

SEQ ID NO: 1014257 - protein, 41 aa, Homo sapiens
MPRRYSVKHIMSDLNGALKNKHCLGKSARAFKVLDPEGKGT

SEQ ID NO: 1014258 - protein, 50 aa, Homo sapiens
MKDKLRRLRTIHVLKAVRENATLTELRVDNQRQWPGDAVEMEMATVLEQC

SEQ ID NO: 1014259 - protein, 30 aa, Homo sapiens
CGVNLEGRKKMFDAAKSPPHNRGQLAVLRS

SEQ ID NO: 1014260 - protein, 46 aa, Homo sapiens
VTDYAEEKEIQSSNLETAMSVIGDRRSRGQKAFEEREKELAKVTIK

SEQ ID NO: 1014261 - protein, 68 aa, Homo sapiens
VDSHSGVLLQYYGLTEASFYTVLFGVARAIGVLPQLIIDRAVGAPIERPKSFSTVKYKELVKKIESKN

SEQ ID NO: 1014262 - protein, 51 aa, Homo sapiens
SWAVWATLRDAHARNARAFRDVLAHLDNLKTFATLRELHWDKLHVDPENFR

SEQ ID NO: 1014263 - protein, 97 aa, Homo sapiens
SRRQARIELLRPSEIPTDCAGDRRKLRSGQEERAGLQRSLRGRALANVPQCEGHRVQQASSESTQARSEGPGHPSSLVLQQLLLTQACREEDLSFLL

SEQ ID NO: 1014264 - protein, 59 aa, Homo sapiens
GLAGIQDCIFMEKNLQILPPQGAMAHSSASASELLKTPGAWREWGVHRCSVLTGSVSEI

SEQ ID NO: 1014265 - protein, 36 aa, Homo sapiens
YIGEFEIIDDHRAGKIVVNLTGRLNKCCAISPRFDV

SEQ ID NO: 1014266 - protein, 69 aa, Homo sapiens
VKPIFSRMNVAKRVREFYARLVSGAEHCAPIPAGHNIVKMGRDKVREMFMKNAHVTDPRVDLLVIKGKI

SEQ ID NO: 1014267 - protein, 94 aa, Homo sapiens
TKGGKTLPLDHLRTKLYQNAHFLLDVLNGIAPGYVDYDLVTPGNTEEERYANARLAISIARKLGALIWLVPEDINEVRARLIITFIASLMTLNK

SEQ ID NO: 1014268 - protein, 70 aa, Homo sapiens
HWRHLDESNYKRYCLTKLTDRPKITTYQSIYKVRLGQIRVRVKVVYVKPTDGNREPVVYLLQISCKAEKP

SEQ ID NO: 1014269 - protein, 32 aa, Homo sapiens
MIPTAPARVTPALRRSCKCKKAKHLCKKAVLC

SEQ ID NO: 1014270 - protein, 256 aa, Homo sapiens
PQVGGPQCQKGPKPLPQHPYNSKKEQLLSGLCRKEAQSDLLQQKSKKSKKIEKLRKSNDLSDKFPVLPGSQLLLKKPALEFKKEVCKVLSLEKKNKKEVKKVKGEMLRLVDVGEFSEEAQFREACRSYVLPEVICRSCKFCRELELCKKSSFSEDGAVLPQWLCSKCQAPKDSSAIEMTLVEILKKKVMAFTLQELVCLKCRGVKEKKNACVMQLRGKIRPKIQKQVFMEDIGIFRNIAQHYGMSYLLETLEWLLQ

SEQ ID NO: 1014271 - protein, 49 aa, Homo sapiens
AVTRLPPGPDAVSAGSRAGVLPPPPGLTSHLGIPAPSHGVGMNTGLSTA

SEQ ID NO: 1014272 - protein, 33 aa, Homo sapiens
ANVTEGPAPAALAPVSINLKCSSLAVPRNRRCL

SEQ ID NO: 1014273 - protein, 38 aa, Homo sapiens
MWPQSELARRVNYARCRDMVGGLLSGLGTIECIGELPG

SEQ ID NO: 1014274 - protein, 92 aa, Homo sapiens
RASNPGPSGGARTRRHFSTSRGATTVRDGCDACAGKFVHRDNTGDMPYEDEGRILQAQECQRLPANHQKLGEKCGLDSFSQPSEGTSPAKNL

SEQ ID NO: 1014275 - protein, 44 aa, Homo sapiens
AYAETSVVSASQSLRALHVRDLRSATSMAVESFRLTPQPLPAHP

SEQ ID NO: 1014276 - protein, 87 aa, Homo sapiens
PSEPHARRATISVSFSSSHFPIALYRRVGARHGGSERIAQQLHELRLVSSTREEPAINASPLHFWHMAFIAFTLSTFQPSFASLSKF

SEQ ID NO: 1014277 - protein, 86 aa, Homo sapiens
EIFRASGEHGTDEEIESLMKDGDKNNDGRIDFDEFLKMMEGVQEGVDSRLYQDRVTLDSSILSTCRSFHQGGAAPCGSLSGRNKSK

SEQ ID NO: 1014278 - protein, 57 aa, Homo sapiens
EPYWTCSLRPPECAMTGMLFILGNVDFRTCRVPPCLKRAGAATLCPHSLAFPFLSQA

SEQ ID NO: 1014279 - protein, 34 aa, Homo sapiens
CILITLPPPHSGNCGGKAGNERLSSCRRKRHLVV

SEQ ID NO: 1014280 - protein, 70 aa, Homo sapiens
APDPRGGNKASASSSSSWNGMTPPVNHHWTFLASQLALRYTDLGSPQLAMHSIRKMDCTTGVLQTLTLFK

SEQ ID NO: 1014281 - protein, 42 aa, Homo sapiens
LNIFDEPLVDKTYEAALETGQNMSKVVYSLYNKAKKLTYELD

SEQ ID NO: 1014282 - protein, 54 aa, Homo sapiens
PPLRPFPAAAPASSRAPFMRSKLRRDGEANLMLKVITLAPLSSCGSISSNNTMK

SEQ ID NO: 1014283 - protein, 87 aa, Homo sapiens
GSSDSTVRVWDVNTGEMLNTLIHHCEAVLHLRFNNGMMVTCSKDRSIAVWDMASPTDITLRRVLDGHRAAVNVVYFDDKYIVSASGD

SEQ ID NO: 1014284 - protein, 45 aa, Homo sapiens
MSSYTSAQKPFKASYVSSPGVMLTPAAWSRVKEGSLTKTPAKTLG

SEQ ID NO: 1014285 - protein, 36 aa, Homo sapiens
TILLNHTFNETQIDCFSRWQCPQQNEGAATVRAVPP

SEQ ID NO: 1014286 - protein, 32 aa, Homo sapiens
QPFFRTLGWEALLARRLQPPFVPILSVRTDVS

SEQ ID NO: 1014287 - protein, 52 aa, Homo sapiens
LFSELRMPPKDDKKKKDAGFSAKKDKDPVNRAGGKAKKKKWSKGKVRDKLNN

SEQ ID NO: 1014288 - protein, 110 aa, Homo sapiens
ATGAGLRECVGRAFLTRALCDNEISRHGWVHCLAPQGSWRSVRPIIEQLCPNSRGGTWRTEVIAWGRYPALRDERDLCEAESGLRDKLIDPTTRREGNMLDVGYWKSGTR

SEQ ID NO: 1014289 - protein, 91 aa, Homo sapiens
LQSSKLLTIAFGAIMSSYLAQSPGKAGRRLISHVELTPAAESERREPYQDSCKTLDLSIVVPLCPSQAVLPVTAALPHPMGLMNKWLLAGF

SEQ ID NO: 1014290 - protein, 72 aa, Homo sapiens
ALVPRRCRSLLTAEPFRTGQTSFRGFVGGTDAHRSPERAGGRALRSSQHPFLIRHPHIQEDNDIPLYLKGGI

SEQ ID NO: 1014291 - protein, 43 aa, Homo sapiens
PAPGAQQAKGITEWGTTRGLHYLNLSLHRLEVVGTTPTKPRAE

SEQ ID NO: 1014292 - protein, 42 aa, Homo sapiens
LDDDDDDATTPAPVCDLKARCEKTTILLDEFWFSKWCNNLSG

SEQ ID NO: 1014293 - protein, 48 aa, Homo sapiens
MSSSGQEHTLRVKEGLSWEDGIMPVIPALCEDPLSPEIGDLPRRQRET

SEQ ID NO: 1014294 - protein, 71 aa, Homo sapiens
MRRLVEITRGDGKELTVASLVQCERENKQAGRSGSRLQSQHFEEAKVVGSLEAEEFKTSLGNMVETLSLQN

SEQ ID NO: 1014295 - protein, 64 aa, Homo sapiens
PTAYTEKRRGPAASRRALSLQESSYLGPAHEVLESRQAATLGREEEKPRPLPEKKQLMRLRKQP

SEQ ID NO: 1014296 - protein, 68 aa, Homo sapiens
ACGLWVWPHVPHEPLGKVREQGGLRAASLLTPLERRRPRPLGELRGSVLTSSQAKAACLCSPAQPQPL

SEQ ID NO: 1014297 - protein, 44 aa, Homo sapiens
IFGGWAWQGRTKSVRRQTVREMKVRILSELEKPLDIDYMEEQLR

SEQ ID NO: 1014298 - protein, 63 aa, Homo sapiens
TPELDEGEWTTLQGFRPAASIGRGWPAVAQPTLPSLAEARRHHDSLSIIRPFALALPPGLAEP

SEQ ID NO: 1014299 - protein, 43 aa, Homo sapiens
YPYTTTDPGANSAERGEDLGTRLQLGMHGHRFVLIPSLLGKTL

SEQ ID NO: 1014300 - protein, 41 aa, Homo sapiens
SPPPPDAVPRTQQSWEGQPPKKGVMLACPLPTPTFRQKGPG

SEQ ID NO: 1014301 - protein, 40 aa, Homo sapiens
EEQRDYVFYLAVNYRLKEYEEALKYVRLLQTEPQNNQPRN

SEQ ID NO: 1014302 - protein, 63 aa, Homo sapiens
TRRAGAIIERGEDAAHHRLGSLVMMGAREKTERKSERSCRGFRIFDRSRRYIDPGELLRFQAS

SEQ ID NO: 1014303 - protein, 89 aa, Homo sapiens
LGVGPRALVPAGLSPALPVAPCSAFGMALLSPRVRQAWRPRRQLALIGTWGAGANISGSSQGRGPVPLRDGVGRRQTSHSRNAEERSFH

SEQ ID NO: 1014304 - protein, 34 aa, Homo sapiens
FTIDTYSARNLKGVCLKAQKKSKEDRRCLPDLDT

SEQ ID NO: 1014305 - protein, 86 aa, Homo sapiens
FRRSRDPRMRSLLYLLLPENSPPAPDIKRFDSGYRATTTAHKVSGLKENIEDAFPGIASLQGPAGGCSRSAAQLSALLLVCPLREK

SEQ ID NO: 1014306 - protein, 95 aa, Homo sapiens
TTESQGKRTTIEKGRKVRARWLMPVTPALWEAEVGKLRGQEIQTILANTVKPRLYKKYKKISRVRWRAPVVPATREAEEENGMNLGGGACSEPRL

SEQ ID NO: 1014307 - protein, 52 aa, Homo sapiens
MLSETSKAAAEALEQTLLGPLELVGSLLEPSSHVAIYHGQELGKHNKGGIRR

SEQ ID NO: 1014308 - protein, 90 aa, Homo sapiens
SSWVKLLMVLTLQFLSHDQGQFTKELQFVVSGSPMRAPEEVTGAQGVQWRDLGSLQPPPPEQPALAFQSAEIAASAQPPRLGSEERLCLA

SEQ ID NO: 1014309 - protein, 94 aa, Homo sapiens
QVTLSTVGSVGSGPHHCRQRAHWLQTGRGAVRRRRWDSPKLQAQRRVTLPRIFTCPEHPWLALSPTTWRLQISEGIEGSQADLRLSCAVYHCMK

SEQ ID NO: 1014310 - protein, 84 aa, Homo sapiens
TCCAPDLSSHRLRRSPICCQRDYSEEMPSVARPRLSGVHRSQIQTTVGIAIGAQQWKSRQAEEQYGGQVASYGETSGAKRGRAR

SEQ ID NO: 1014311 - protein, 63 aa, Homo sapiens
VHAAVPRTGNTQQKVCSNAMRSCPEGFCNASKWSPPQNYKKRVAAWKPSKSQTSQSQGYTTRQ

SEQ ID NO: 1014312 - protein, 63 aa, Homo sapiens
NLTVVLQTKLSILSKKVFEYVHQFSRHLRTTFTLVVVTQGFRRAPWPHGRGAELKRAPPREAE

SEQ ID NO: 1014313 - protein, 64 aa, Homo sapiens
AVWVIRNQWGEGEYDPRTVAGEEYFGWTLNSGDVGQPRTLNTTVSSSDKDCGKASWTWCGLGHN

SEQ ID NO: 1014314 - protein, 42 aa, Homo sapiens
MAALRKHLTLPSASTMGLVCGGVLILWVYSATEKRSSGFWEI

SEQ ID NO: 1014315 - protein, 65 aa, Homo sapiens
VLPFWFMLLRVKLTIPSCLPFWPLGGREWRYVQLGPRTMGLCCLLQSSLPGSLQDKQGICGRLRE

SEQ ID NO: 1014316 - protein, 58 aa, Homo sapiens
KLTGISDPGLSRPPLEVRILDDRPSRPEGDNRVWYMDDYHNNHSYVSTSAMVDFMNTD

SEQ ID NO: 1014317 - protein, 77 aa, Homo sapiens
MVQPLIKGSILFNDLYKVLGDRESADRELKFARSVLLIYLPYIFLSLGSPAQRQLSMKIRRALIISTRRCLCCSLTD

SEQ ID NO: 1014318 - protein, 70 aa, Homo sapiens
ARRGPSRNPALTPAPRRRSVRHRTGSHPVNIRELTRTRAVPPPSAAATLGDAHGHEDREHAGAEEVEKAR

SEQ ID NO: 1014319 - protein, 69 aa, Homo sapiens
KAERVRDAAESDETSLTVLCVQVVSQNPLTMQLDKKTGVELAVFIFNLLPYMLVFELRINVPFLFLKKK

SEQ ID NO: 1014320 - protein, 84 aa, Homo sapiens
HVCVLRANVTCIAARTVWIICQRSKAGCSAVLVAGHEYLAGVAEDFLHGVQVQTLAGDFRGLAIFRDQFGKAVCLTLGARRSSR

SEQ ID NO: 1014321 - protein, 136 aa, Homo sapiens
QGCSKVLSFHLLQRFTQIGRRLVDIVLHLFVISSQRHWHRVDTVFQHIQLAEHKSFHPAVELPATDAVDGIHHVANRTGYIAIKRQPKISAIPVQNSIITLEIKISLYCCKRTDFEIQVQRNISQHILTICGHRYF

SEQ ID NO: 1014322 - protein, 70 aa, Homo sapiens
PGIPPATSSWDLGKLPLVFPPSVGPDAWRTPPGLGSLLHSQPCTRFKPPGLRHVSSGVLGCCRRLAVFKS

SEQ ID NO: 1014323 - protein, 50 aa, Homo sapiens
LDSVSTVLTSKYRYAGGSVAVPPGRWGSQRVLLPSLDRPFLVFEESLSGR

SEQ ID NO: 1014324 - protein, 279 aa, Homo sapiens
KAMYFRDLRAHLRLPTPPPTTPPPPPPPTPPPPPYAPPPPPHPAPPRPPRAPPPPPPPPPPPPPAPPPAPPTPPLPPPPTPPPPPPPRPSPPPAPTHPPPPPPLPTPSPHPPPPPPPPPPPPPPLPPAPPPPPPPPPPDPPPPPPPPHPPPPPPPPPTPPPPPPPRPPPHPPFSPPPPPTPPPTPPERSRWGSAKCGRCPLCTQGLTGAEPLLVQALFGGPRGTEEQPGTRLLPSSPRSGTRASLFTVTQVRAQSDPRLSPAHRDAGGWWRHRTAHGNA

SEQ ID NO: 1014325 - protein, 271 aa, Homo sapiens
YSELRLYYSVANLHLEETLAEFWARLLERLFKQLHPKLLLPDDYLDCLGKQAEELRPFREAPRELRLRATSAFVAVSFLSPGLGVASDVVRKVADVPLGTEFSIAVIKLVYCAHCLAVPGARPCPDYCRNVLKGCFANEADLDAEWRNLLDSMVLITDKFWGTSGVESVISSVHTWLAEAINALKDNRDTLTAKVIQGCWNSKVNSQGPGPEEKRRRGKLAPRERPPSGTLEKLVSEAKAQLRDVQDFWISLPGTLCSEKMALSTASDDRC

SEQ ID NO: 1014326 - protein, 72 aa, Homo sapiens
GDTDTAEQVIASFRILASDKPYILAEELRRELAPDQGQYLIKKVARLSGPRKVPCAIDEGWFFSGIFGEREL

SEQ ID NO: 1014327 - protein, 31 aa, Homo sapiens
MVAEYQEGVPEVLRLDIGPLPTMEIKLFSHS

SEQ ID NO: 1014328 - protein, 75 aa, Homo sapiens
ESHYAPRDGLPGEQGLATVRERKGVPALLTGLRSSLGTEMEGPTSQSLACDCLWHACEEFDRDLISKLRWQKIKT

SEQ ID NO: 1014329 - protein, 77 aa, Homo sapiens
PFLRLPKTLAMGWGWDSSLVNPSPGYPTLGYPKGIPKAQVGALKLRGRYESSLLGGLGPNGTKARGPEAVGGALKVG

SEQ ID NO: 1014330 - protein, 42 aa, Homo sapiens
MSLRLRALTRRLTSAAKGAHGGAELVLRLLTFVLALPSGALC

SEQ ID NO: 1014331 - protein, 66 aa, Homo sapiens
TGIVSAPVPKKLLMMAGIDDCYTSARGCTATLGNFAKATFDAISKTYSYLTPDLWKETVFTKSPYQ

SEQ ID NO: 1014332 - protein, 103 aa, Homo sapiens
PVSWQRDCHYLKMSIAQCTSSHPIIRQIRQACAQPLEAFGGRVFRTETEASLWGKLVPGAYCARFPCRCAGGKCSRHAHLQLWRHSHFLPPEDSSDGRKTGHE

SEQ ID NO: 1014333 - protein, 40 aa, Homo sapiens
GFVRVALVTPTSVHFLTGPCTSRTAFGPTDGHWLWSKVPG

SEQ ID NO: 1014334 - protein, 38 aa, Homo sapiens
NQQVALGAVGSGDLIDERRLCVTPESDSRIRELTFCDV

SEQ ID NO: 1014335 - protein, 28 aa, Homo sapiens
MRLPVGHHPGNRELALGSCSAWFGSELI

SEQ ID NO: 1014336 - protein, 49 aa, Homo sapiens
ALLLRLECSVTIALSATNSWAQVMPSGSASAAGTTGTGHQAQIVKDKNW

SEQ ID NO: 1014337 - protein, 71 aa, Homo sapiens
EFGRARVSDQLRSGVREQAGQQQEPKRTIEPTSSRKNSQPENWFLNFPAKGVLNLLAPPEGQLGGWVVNQS

SEQ ID NO: 1014338 - protein, 30 aa, Homo sapiens
RGFVQAGRGCDTNPNDEFAHYPDLFFSELI

SEQ ID NO: 1014339 - protein, 128 aa, Homo sapiens
NPDDHRSAAFSDWLKAECVRFGEDRFARAVEEAACVTTAAGGRLDRSAKIRAEGMAANYSLPSVGLRMACAWTGPGALSERPDTPDSRSTGRGIRSPATHRFPFLCLLKTWAARLFGIQRCALVKSQF

SEQ ID NO: 1014340 - protein, 147 aa, Homo sapiens
VNTPGSYRCACSEVTGDGFTCSDVDECAENINLCENGQCLNVPGAYRCECEMGFTPASDSRSCQGGSPGIPTHFQVGSTTVNETTTRAGTSSTWEGRNYIRHMLALLKVHFVLSVGFFFGRNGIDGWAGFLFMEVFPGAEPLVWEFW

SEQ ID NO: 1014341 - protein, 91 aa, Homo sapiens
RYGRTGRFAVVAAQVRFAPQRSATAAKEIKSLIVSSNETVEHGATLVTNAGETMAEIVQSVRRVNEILDEISPPSREQSAGIEQVNRAVGE

SEQ ID NO: 1014342 - protein, 241 aa, Homo sapiens
VFGSGRKRGFWGVKSRERRRKFDRNTRIISQLESGYAESTHRKMKVRSEEEITDSHHTKSLERGSRRKPSTLKTQRAAIVAENELMQERDQPIQMFLCRVIKKKIFSERIRSPGARYIMRRQKQRTHVTNERPHSTTDCPKRSRKIWSKKQIWKRKKHTYTKGQTRWFAQVEQIALRPKVKDRASTPRRALGGQTKQRSAPARGESTYKYNQAQEGEGKHDFYTTPQWVARDKIFENISTR

SEQ ID NO: 1014343 - protein, 34 aa, Homo sapiens
MVLSPAKTNVKAAWGKVGLYVASMVRRPGEDVPV

SEQ ID NO: 1014344 - protein, 60 aa, Homo sapiens
LVRSLQTFSQAWFTCRSATGATWVSIHNFNINYRIPVFCQRAQPGSSLGLEAGSQARVAA

SEQ ID NO: 1014345 - protein, 180 aa, Homo sapiens
MGAHLNSYNTREHTAYYIKALSKDLPKTVELLGYIFQNFSLEDSQIKKERDVILREMQENNASIRNVVFNYLHATTFQGTPLAQAVEGPSENVRKLSRADLTEYLSTHYKAPRMVLAAAGRSGAPATVRPRPEAPGGIPWTYAEDAVPTLTPCRFTGSEIRHRDDALPFAHVAIAVEGPG

SEQ ID NO: 1014346 - protein, 142 aa, Homo sapiens
VLTTSNIKSDRGFRALPTNVPHGCGGDGRTQTLCHILNLYRAGPPGCTRALRGTESSSVEQIREVASGGCQPRLGIIGLRVGQAVALRAKAFGFNVLFYDPYLSDGVERALGLQRVSTLDLLFHSDMTLQFGLNEHNPPQRL

SEQ ID NO: 1014347 - protein, 76 aa, Homo sapiens
EVSTCRAHGSSPMYCKSAGDFPPGAAPAVIPAPLRGRGYDREENGQTLRQNGDKRSAALMRRELVLTQPLGLLPEP

SEQ ID NO: 1014348 - protein, 29 aa, Homo sapiens
GEVGRARGPPADPGFALSPQGRIIEGCRL

SEQ ID NO: 1014349 - protein, 93 aa, Homo sapiens
QLNQYLKDEIGKGSYGVVTLAYNENDNTYYAMKVLSKKKLIRQPTFHVALHPEAPQLLEAASPGAPLRVYQGNCPSSSLDHPNVVAGGRCWDR

SEQ ID NO: 1014350 - protein, 111 aa, Homo sapiens
QIEMSTHISLREKLIQYCQSKVIVGDRPTAPSALPQPGSPEVPFSSWEGSQDQGRSQKHNKTTAQVLIRFPMAEELVVIPKSVTPERIAENFKVFDFELRQPGYDHLTQLQ

SEQ ID NO: 1014351 - protein, 68 aa, Homo sapiens
LSHCLLVTLAANLPAEFTLRLHASLKFLDFCEHRADLQILSWSLGGHAYLPLGPPPAPPPLPAPYPRG

SEQ ID NO: 1014352 - protein, 88 aa, Homo sapiens
MRMSERECNRTRGSATTQDAGRKYNIEKDIDGYSRREFNKEVQSHLIAIVGRNFGSVETKHFIYFYLGQVAILFKSGKKHGLCHPSNP

SEQ ID NO: 1014353 - protein, 161 aa, Homo sapiens
SERTHHGDSPDRTRPTFKDRPGKVRRRWAYGAVGPGRGCSSFPTTKYLLPALRPETTALPRLRATARRWDALTNAVANVDDMPNALSALSDLHAHKLRVDPVNFKLLSHCLLVTLAQLPAENPAVHGFLDKFLFFSTVTSNTVKLELGSRFFPLASGPSPS

SEQ ID NO: 1014354 - protein, 109 aa, Homo sapiens
AAGFLFQGLGCHHHGWAPGLRHTWKDCLAGSLGGPPFIGLPLLGLRFPLGEWGPLLCQPAPGRRHGAGQWLGGHLGPEAFCWSGNAVGGRSDHPHCSCLHGQHLWDVGG

SEQ ID NO: 1014355 - protein, 95 aa, Homo sapiens
TSCTLPTLDPDIAPSAPAPFQLPTFHTEVLSLFKADLQDGVLTPPPPPPPPPPAPDVLASAPPLPPSTAAPVGQGARDDSSSSKSSSVGASKGSW

SEQ ID NO: 1014356 - protein, 94 aa, Homo sapiens
RSHSQPTRPSETYCATPAKSERDVSTPPTVLPDNPRYPVGKFFQYDTWNQSTQRLEGPAALLRARRGHVLKELEAFREAKRHRPLIALPTQDPQ

SEQ ID NO: 1014357 - protein, 250 aa, Homo sapiens
EPVTTSSRDQPFLSPVLLATSLGSGQIQPSPTPGTTMSRGPCICIVPGITWPWNLLLQDPARLGQGRLPTRGPVDRPSASRWRDPDETRAGSHQPGQFLPTLSLSRRSTASRQASWLLSVLFTTAARTSRSPAAPSSPLTSRCGPWGWAGPPSRSQLCCRAPSSFSSASRGARRAALHSGPRPQPPALASQAARLGSAASRCSSSNACSPRTTRSNSPPPRSGTQGKKVGCEAAAGTPGQQVPKTVSIHR

SEQ ID NO: 1014358 - protein, 52 aa, Homo sapiens
MPIAEYSIAFRKWVSAFGNVFRFPTKGIHHHGHDVGGHEVSAKTVTTAYGSS

SEQ ID NO: 1014359 - protein, 80 aa, Homo sapiens
KSNPCPPPAFASANPRVPLKFQSITGTHPWSLQLPGPQRQDFVLASLVLCWGDDKTNNPRLERSGSPNPNILGGRGGWIN

SEQ ID NO: 1014360 - protein, 56 aa, Homo sapiens
ECNGEIQNAAYRRLSPIAIPTGIPNNTAANSATIMRVRLAARCCHSVVHKALRPAM

SEQ ID NO: 1014361 - protein, 37 aa, Homo sapiens
ALAPALSARLFSRRSPAKLHELYEKVSRRADRHSDFS

SEQ ID NO: 1014362 - protein, 32 aa, Homo sapiens
GLCGHCLQFSWIYTEDWNCGICQIDNTVRLRR

SEQ ID NO: 1014363 - protein, 44 aa, Homo sapiens
PVVWVAPPKSGKVNMNILHRKSFAQKKGIEQMTKQQISAASHIC

SEQ ID NO: 1014364 - protein, 62 aa, Homo sapiens
RNPRISCFIQTDDDLAMRASIALDAPIFSSNRRVSSVSGRRSPVCGTVMTPSSHSDEAWNVL

SEQ ID NO: 1014365 - protein, 143 aa, Homo sapiens
LAVSARLECSGRISAHCNLRLPGSGNFPASASRVAGIAGVCHHARLIFVFRIFSRILKQHGFTMLQAGLELLTSGNPPTSASQSAGITDVSHHAQPRTIWFLTQYRKEGNRVQEEGSLGTVGEGTQFPKVFQEVLLLHSVFRG

SEQ ID NO: 1014366 - protein, 110 aa, Homo sapiens
KLEECPAVPGLESARHQVLQELPGSIEMLANATTLAYLKRVLVALTPVPQDSCGSAVDLLLASGAVMAHAFCKVCDFTIQGPESWTVKHLPWGSAVCYPFSVAVKKEERV

SEQ ID NO: 1014367 - protein, 108 aa, Homo sapiens
MALHSSLGDSARPCLRINKVCDEDVHTLYANTVFFFFNLNSLTVLPRDGVRWHSSWLMGKLCLASSWGLQACSTVPQLIFFVFLVRQGFAILQVGLEISGPQVIQSPK

SEQ ID NO: 1014368 - protein, 33 aa, Homo sapiens
DEPVRKKRQAALEVTARYCGRELEQYGQCVAAK

SEQ ID NO: 1014369 - protein, 56 aa, Homo sapiens
ALAAFIQTADDLAMQGSIAVSTDQFYVRKGRFFPAIARYLVSVDDVSVRSSRRFKP

SEQ ID NO: 1014370 - protein, 55 aa, Homo sapiens
SASDQALYLHYSSGLATSRFAQHIAYALFSGSRNLSRSQSTQIVHVRLEVHVSSR

SEQ ID NO: 1014371 - protein, 33 aa, Homo sapiens
VTTGKSQLPAVWGPAVPLPKQREPLDLTKIIFK

SEQ ID NO: 1014372 - protein, 42 aa, Homo sapiens
CVSRRAGALCFLALRNADNSRTIVEGGWAVAALRAMKRRPQK

SEQ ID NO: 1014373 - protein, 86 aa, Homo sapiens
MLALLPESRTCAEEAVHLWPAVLRGPRWGNPGDGAWPAICGLGWSERRGRFFPPALPLLLRERAAGLGSGAGEDVNSNVNADQEVR

SEQ ID NO: 1014374 - protein, 42 aa, Homo sapiens
DLDTRYEKRYERERERCARESTNARSHRESVLRDSEIYTLPD

SEQ ID NO: 1014375 - protein, 34 aa, Homo sapiens
MRHLIKLFQCQDLRAWVACDGYADKEDLEILPTQ

SEQ ID NO: 1014376 - protein, 30 aa, Homo sapiens
KTGIKLNVVFSPDTAITPSHCQRMHHEESY

SEQ ID NO: 1014377 - protein, 53 aa, Homo sapiens
AEDARRDSRQNASVGTQNVRTSHARVVHSSYASLTSRRRFAELGMIRAIALDH

SEQ ID NO: 1014378 - protein, 35 aa, Homo sapiens
MYSVGLRTMSILRTLSDVACTDVYLQEQETAHETH

SEQ ID NO: 1014379 - protein, 76 aa, Homo sapiens
RPRSLVGKNGFGGQAWLLLSVAGHCYLHLADPAPPMAQSAPDTVQATALEDTSYKTWWLPHGVMSAGEQNARVKKA

SEQ ID NO: 1014380 - protein, 63 aa, Homo sapiens
MFERSSRCSQRGYYSTGQGHLYRCSEDAHLRCCASMHVFDLTMSMHSSRQANYACRIHVTVTQ

SEQ ID NO: 1014381 - protein, 71 aa, Homo sapiens
KNGCGGAYWKTGQWGPSENTTLPVAKLPPLTCLPYPGKVTLPSLSPQFLYSLNSNMPGMVAHACNPTALGG

SEQ ID NO: 1014382 - protein, 42 aa, Homo sapiens
RFEGYRPNLAESCPCRQYRAYVLTHSGELYERPERSDRQICV

SEQ ID NO: 1014383 - protein, 35 aa, Homo sapiens
DDHRQVISSLLSGALAGACPKQRSVPVTEPKSSSK

SEQ ID NO: 1014384 - protein, 154 aa, Homo sapiens
PSISNSPSSFQEISDPNLWGSNFRNKDYYIISTSNGSLEGRNQEGGVQTRAMKILMKVQDDKFCWINQEKDPTRRPELEATNRSSTTSPFVKPNPGSSTDGNAGHSGNNMLGSEVALFAGIASGCIIFIVIIITLVVLLLKYRRDTGSTRSTRP

SEQ ID NO: 1014385 - protein, 74 aa, Homo sapiens
RIALLAINVEFFFRLVQLARALQVTGTSVRIQGFVNPTSRPPGSDILLQIVVSDAVQNTSNQLGIITSHDLEIS

SEQ ID NO: 1014386 - protein, 81 aa, Homo sapiens
SRLVHGSGSSDYPPSSPSLRTRGTVPRREEGWTRIRWPEQMAAIRKKLVIVDGACGKTCLLIVFSKDQFPEVYLPVLRTLK

SEQ ID NO: 1014387 - protein, 94 aa, Homo sapiens
VEAVDGFCPSIGVRIVHPVSQALPCDLVPNQLAGLDVANAAEETLELILGHVLGQVVDDEVGLAVVSGSICPKELALGAGRPGPPETPWPPVSE

SEQ ID NO: 1014388 - protein, 112 aa, Homo sapiens
KGLRGRSSLPGVGLKPQGFLLLKYTPPWWWPPPMSPTDGSTVLVAMSPENPTQSPIPNFAGGSSQIHASLSGAATQAACPSVLPPAAPPGPWSGGAMARDTVASHVNPGHCG

SEQ ID NO: 1014389 - protein, 111 aa, Homo sapiens
MIQGRARFVRSLGGRTDWDQRDPLGSGGLGPWEAGSQGHRIHTTIVGPWEAGSQGTEIHTLTIVGPFGGQQPDYGIHMLTIGSQSLACETLLVAPFIGEQGERVLCSCCLG

SEQ ID NO: 1014390 - protein, 132 aa, Homo sapiens
MVPQDQSHQVTGNHQQASSGRTLGFPRRQSGPITIVVVCLVEGSRGARGLMNGYRGPANGFRGGYDGYRPSFSNTPNSGYTQSQFSAPRDYSGYQRDGYQQNFKRGFGRVDHGEPHEVVEGPQPTEGFRNYP

SEQ ID NO: 1014391 - protein, 115 aa, Homo sapiens
GRKKTGRNSLELRKRCGGGGDYGGCSSCRRCTGKQSCRQVEELAAEVQRLTENQRLRQENQMWNREALSVMRSGYLGVPPPGGPKEKVPFRAHSGPVWVSRREVADENHRQPVRP

SEQ ID NO: 1014392 - protein, 54 aa, Homo sapiens
LVTTPRAPGPTRVPCTLGPVQFGVSSAQEKNLKNFSLLVFQSFDSLHLNKVFKR

SEQ ID NO: 1014393 - protein, 109 aa, Homo sapiens
EVLWQEAGAGRPRTLLTPVERMVAETFSAGPQGEGQTTEPLPNSIEASLEVRSSHAEAARQLLAGSPAPTDEEDETPSCLWLLRSLEGPACLNLTPWTYEESSTHPPPH

SEQ ID NO: 1014394 - protein, 74 aa, Homo sapiens
EVVVRQELSHYRAVLSRYQAQHGALLRLPHIPTWELSFALLDLRPVPFLPWCHGPAVPQGRDNADKYIYIFKKK

SEQ ID NO: 1014395 - protein, 144 aa, Homo sapiens
ERKVEVVFFDGKSDPCGLRGRELRHARRRGAPGGLWVREEGLAGLRELLLVGNQKYWQSVCAGASVGGDGPTLATRRPGGRRGPASHRLPDGGEGGLRHSGVAVGSQAWPLGTVGAQGQAHGYGMQGDAKGKRVAGISTVTMQN

SEQ ID NO: 1014396 - protein, 63 aa, Homo sapiens
PQPRKARKEPKKNHGTKRPPTCGIPVAKNGRGQSKGFRNYPGLNLELKPVGCKRLPSYCGTQG

SEQ ID NO: 1014397 - protein, 85 aa, Homo sapiens
MYAYALQVFPSKKSVWLRAGNLEKNHGTRESLEALLQRAVATCPKAEVLWLMGAKSKWLAGDVPAARSILALAQATPNSEEIWLA

SEQ ID NO: 1014398 - protein, 106 aa, Homo sapiens
MPGSSNLAVQLFHAGQGGHEVSPADYVPGTGPCGETFGRYQNSELLISKLPLLRESALDPHESEAEELCDTIVHLPAKALSETHIFPDGSCEAFSYPPYCMLQSIL

SEQ ID NO: 1014399 - protein, 108 aa, Homo sapiens
MRPIGSTTSVAPRKQRKVITLQEKVDLLDMYYRLRSAAVVAHHFKINEPSARTIIKEKGNLWKAVHWQLCQAGMEKPCYFFAKIPFLCLYLKAAFYVGLQGLAMEGRL

SEQ ID NO: 1014400 - protein, 122 aa, Homo sapiens
FISVQPGPTVASGENVTLLCQSWRQFHTFLLTKAGADCPTVASGENVTLLCQSWRQFHTFLLTKAGADAPLRLRSIHEYPKYQAEFPMSPVTSAHAGTYRCYGSLNFRPLPAVFTPVSPWEL

SEQ ID NO: 1014401 - protein, 62 aa, Homo sapiens
MGEARRRAAAAGPLFLQGGTGGNDTELVACLRTTTSAGPGEPTNCNVLQESVFRFFFVPVVD

SEQ ID NO: 1014402 - protein, 54 aa, Homo sapiens
GEALSLLEVQSQPHMVAYACDSRLLGGLRRSRLGLGGGGCGELEIVPFSNLGSK

SEQ ID NO: 1014403 - protein, 107 aa, Homo sapiens
IERRKEVESILKKNSDWIWDWSSRPENIPPKEFLFKHPKRTATLSMRNTSVMKKGGIFSAEFLKVFLPSLLLSHLLAIGLGIYIGKASDNLHQHLLDEGTGSLDLVR

SEQ ID NO: 1014404 - protein, 103 aa, Homo sapiens
ISVKTSGSKERASKSQDRKSASREKRSVVSFDKVKEPRKSRDSESHRVRERVNVQRMQAQWEREELEWEIARERLAFQRQSGERDHWSGERLERERCTSTSAG

SEQ ID NO: 1014405 - protein, 62 aa, Homo sapiens
VQRQVIGAREGTIAQMALEHAVARVLSVVARELVWARKLPAAAVPVAVVGLTCVRCAFRCEL

SEQ ID NO: 1014406 - protein, 61 aa, Homo sapiens
LGKGKRVAQLQVSARKAKAKGGERTVSMSSLGSGSRVIPSPCGPISSMSLGLGALCWRLSH

SEQ ID NO: 1014407 - protein, 70 aa, Homo sapiens
TGRFSARPQCWSSFGLQYLGMAIQPPEFFRVSGWHFGSPERHLTPPHPGSPPASRDVPWSLVTYPGREES

SEQ ID NO: 1014408 - protein, 100 aa, Homo sapiens
DEALDDSPQKPMFTLREELVKPEFQQLSGPLKTKHVPLSLANLQPSCCPEDCTGLAEMALPILGKVLPCPKLSFSNQKQGWSPTNYCTKSGWALQGWVKL

SEQ ID NO: 1014409 - protein, 61 aa, Homo sapiens
SHECTHLLEGPGFHHAAGKLVENVKYEDIYEMLVHTYSSMDRHDGVPSHSSRPLPSGSVFP

SEQ ID NO: 1014410 - protein, 118 aa, Homo sapiens
GSWPPQDLLNPPWEEEGNWWRALPFFLSPKHPRSRVPFLVTSHLRVTFLEGGILEGKSFIFSARQGTWIVFRSYLEFPEKSKQTKKTGGWEIYSSFLIFGNGTNGLNGLTIAHPWMVI

SEQ ID NO: 1014411 - protein, 293 aa, Homo sapiens
FARGATVFSKGDQGAFTRDDDSFSPLFLRPPREGVFIPLLLSLLPRWASKRNVFLRPRFLCENPSGVAQDVVVATPRRCCAAPRKRCPWFHNSVLFCGRTHPAPFSCFSCGNSSNLLPRTPPPVVGIEQQPTRGPTTRMFSSGEEIVPTPEEFFWSPNRVCCERFLRSPPPGFLPPTPPFPLPLMVFITLKLFRHTLSLTHHTTVGCFFSSGECARVPSWATSGPPRLGFRRGDCPPPGPPRFLPLGPLLPPTTEFPRAGFFILFPPFSGVSPPRERTFFFWGPHTQINPGVP

SEQ ID NO: 1014412 - protein, 30 aa, Homo sapiens
LGPTLVVGSDKKNKTCCLLTSGKFLVHNIK

SEQ ID NO: 1014413 - protein, 43 aa, Homo sapiens
NSLLSFFSFRSVLSLRTVSRTRRSSSAFRLGAGRKFSSSGASS

SEQ ID NO: 1014414 - protein, 78 aa, Homo sapiens
NSRSSSSATGSPTRRGGGPKFGGWAHEESQAKALVEVVGVAEEACRGGSPKGGGGHGNSQGSCARTWEGGAALSPSSP

SEQ ID NO: 1014415 - protein, 34 aa, Homo sapiens
MLTLRSKVHPAHDGKTSSTGWGSESAHPHKPWVP

SEQ ID NO: 1014416 - protein, 41 aa, Homo sapiens
FLGRVTCEGVWLGPHPGPALETKALYASPYESVSQLLSLPE

SEQ ID NO: 1014417 - protein, 34 aa, Homo sapiens
MWRHGQTIGGCDPILSRLHKVVLNLTQEGTKWET

SEQ ID NO: 1014418 - protein, 85 aa, Homo sapiens
PLHARKLADTGRYRIGVGLCRRWRHLPHEFVADAVISGLMRVQLDTQVPVLSAVLTPKSFHDHEDHRKFFSEHFVVKGREKGLHQ

SEQ ID NO: 1014419 - protein, 113 aa, Homo sapiens
MWELPWAIGFPCGILLFILTKREVDKDRVQMKARQNMRLSNTGEYESPEVQGFLPELPRPLMLGGVWGAPEERLLTLLGLLTVKLRFGPEFRFVPLRHQRAHEDPGLLKPYPP

SEQ ID NO: 1014420 - protein, 81 aa, Homo sapiens
CWTGYELEIRAFLQQLKRRVGDAISESASGPSGTKAPGHMPPAPIEVTDLAEKITGPLEEAVAVAFSQVLTIAATEPVTLL

SEQ ID NO: 1014421 - protein, 120 aa, Homo sapiens
MPLPVPFCPLNVTVLQAQTCFQTIQMMLLLQRHGPVPRRKGHLCQQCAPDSVRRQDRSHEKGRPEDTYSGWKTRTPEDQERSYLGTMKQLRQYQDTSCLQETIKPLLSSLDVDPILGLSP

SEQ ID NO: 1014422 - protein, 72 aa, Homo sapiens
IYWSEEMEPAAGPGEGQAIPEGHLLRLPAAGCCPGRPARATLGAHQPMALTLAPRFGRETPAESGLFLASIF

SEQ ID NO: 1014423 - protein, 34 aa, Homo sapiens
TQSLVTLAEDNILLLESRVLGKRSQRLFRRFCRT

SEQ ID NO: 1014424 - protein, 97 aa, Homo sapiens
HAHQVLHWASHPGVSSPSDDAIASVARACTRQWYMGFIVVPGSCTWSFLSVVGPIRAGVTRACTPVCLPHVRHPGRRLSRSVGVRAFSRVPCSHTGA

SEQ ID NO: 1014425 - protein, 79 aa, Homo sapiens
TLTALTTSVQVTICVPGQTSSNLLQGGLPPVSIDDLFSGKSVPHRHVLSIVVRLCIMYLRRCILSHGAVLWHPGNSSVY

SEQ ID NO: 1014426 - protein, 61 aa, Homo sapiens
TPIYQSLPGMQSNTRDGGNWTEKGDLDQPKKPKAPDNPFMIVSKCFEPHLYVYIFQKNLGG

SEQ ID NO: 1014427 - protein, 129 aa, Homo sapiens
MLVRDPGKKSLRLPLSPTAVSMTPFHGRRCSDMFVAGIPTVHSIIRQNDALMRELMGLPGTSQHRTVVMHRTEAHCPAEPGLCSPRSAAWVENNERVFHKQGTYGGYFDQKDGYRKNEGYIRGCYSSSF

SEQ ID NO: 1014428 - protein, 154 aa, Homo sapiens
SKIIVKKIWVLANARDHVLQWVQKMGTDIPKGNTGAPSSSQGHPIMNPHKVLNDFLHVLELKQWLEARFIVKSHIVVGKDRWAFGFGGAIDSESDRAVWCLHRVSLGPSGVCPGNSGFSSVICTSCSPPWWLGSYWLDAVGLGVLTPSELWGSA

SEQ ID NO: 1014429 - protein, 77 aa, Homo sapiens
IAAQGAGGGPDLERPEHRPESPPTAAPGAPPHSPAPSPDLPACPPGTGETQLLGTLDFYMARLHGAIERDPQHEKLI

SEQ ID NO: 1014430 - protein, 39 aa, Homo sapiens
GTYLGVPRMPVPQMGGGRFAHPALLQLRDPGGGGSFSLL

SEQ ID NO: 1014431 - protein, 122 aa, Homo sapiens
DRVSLCLPGWSCSGAMTAAPPGLTASCLSLLYSREQRCTPPDLAYFLIFCRDEVSLCCPGSQTPGLKQSSHLGFPKWDYRHELCSAFMFTFLKCMYFFIGDVGSSLCSPGLSSELLGLKGDN

SEQ ID NO: 1014432 - protein, 130 aa, Homo sapiens
PGEIVLCRLKPNSPEVPFQGGRSQGRSSLRGPTDILLAQLRKLWLPVCAQSGFGSQGSWAGGKPSLGHLLGTGQPLHSLDPDNLVVRLALHVDAVDLDQAVPPAQRGGLGGGTGFHAPDEARGGPSRRAG

SEQ ID NO: 1014433 - protein, 76 aa, Homo sapiens
APLVTTLGAQLPPQAPDPLLRTQATQLPIIPTAQPSLTTTRSPVSPAHQISVPAATQPALPTLLAQSPTNQTSPIS

SEQ ID NO: 1014434 - protein, 79 aa, Homo sapiens
MQEVGDALGVGLVHRLRLLGVQQRGGEHRPAHWLWRFRKPAWPGRLSTRPCCRWRLLHRMAGEMPASSPPSFFYLMAMP

SEQ ID NO: 1014435 - protein, 102 aa, Homo sapiens
WFIISFLEKTTPQYFILNLAGSSVSVKVPTMSGHVPVIQKDSALGCGAHLARSRPTENSGTMLSWQEGLGVLLGHGRTRSREALSKFSLTRKLAAAAEAAGA

SEQ ID NO: 1014436 - protein, 82 aa, Homo sapiens
MNPTWLLDHDERLHESVFLRGVDHIYTPAACPCQACPAQCQLSPGTPKPFALGLPSQPVPRTSSSPLIIKSMDRAVVEVLTQ

SEQ ID NO: 1014437 - protein, 31 aa, Homo sapiens
NLKWERPVLAHNDVEPCESRIRIKGHVCTQK

SEQ ID NO: 1014438 - protein, 47 aa, Homo sapiens
QALGPPSLWSLAVWVTSVGSIPELLSKGPVSLSQEPKRQLNDVLFHW

SEQ ID NO: 1014439 - protein, 140 aa, Homo sapiens
GTLWQFQEGAESYSLDACHQIPLSSDLSHLVEKVRALRGQLEQFRGTIVCDSCNSEERCWQSTSPSSINQNFPASTDPGNKQLLLQDSAVSPPVRDVGMNSPALVFPSSASSTSGFRNAHNQQSKWLWVLDNFSSNRPLP

SEQ ID NO: 1014440 - protein, 123 aa, Homo sapiens
ADWFGVSKDDSTQKWQRKSIRCSRYGKLKPQVLRELDLPSQDNVSLTSTETPILYVGPCQLGMQKIIDPAARGRAFRVADDTAGRPECPTHSVTPAASLCSFQSRSGFQPAAAHESRWTKMSP

SEQ ID NO: 1014441 - protein, 96 aa, Homo sapiens
GLIRVFLEESRVGPGISDDTRETGGTAFHYLHECIGNVGVCLLSAMPLPITLQTRAKRGILNIWSLEPEEEIAEYDDDPVDYETRLGGPTTKGTRC

SEQ ID NO: 1014442 - protein, 98 aa, Homo sapiens
MSGELLPSWRLPYSGCFCLPLAQRAWLKMFVIVFSPPDRFVPPVVERGHEQCPAQRSGLPQAGVGCEVHADYPLDHSYQLIAPCLFPLSYLCIGFGFL

SEQ ID NO: 1014443 - protein, 60 aa, Homo sapiens
NPGSCVISPLSQGPTGTGGQPLSEVPYQDDLVGFKLFLPEGPDHTVSSFQPGDMAAITTK

SEQ ID NO: 1014444 - protein, 125 aa, Homo sapiens
LKLAILSPTTGAGASRSSVTVLGCESKAPPWTCRFLPPSTTLARTGGRSFFRPDVVRTGSYPARAMDGPAHKSGAEDWQCHSYAIMVKFVFRQKSSAGAELHGEPALGQLQKGNVGGALAESPLK

SEQ ID NO: 1014445 - protein, 69 aa, Homo sapiens
EKQASRCCFMRFKERSHPYYIKLQGEARVDTEAIASYPEDLAKITDEGGYTKQQTFNVGKVFYMKEGAT

SEQ ID NO: 1014446 - protein, 111 aa, Homo sapiens
GHSANRGHFRIGGPGRPKAPFLPFPASLGPGINPLPGRTPGQAPSPLCTSQDAEIVRDPGSRKTRFLDIVVEVGGEYDPRRHRYDHQEMYENFVEEVDADNGIFPVGQRGS

SEQ ID NO: 1014447 - protein, 130 aa, Homo sapiens
RCPRKDQDMPGTTFNTNDHDCGQPTAACAQHCPEGHDLRSLPIRLIPPSPSQAGSFQEGMGVYNPNKIFGRGRPWDIVRGQHLCWQSWKGLDPGSSQRPCHWWAMLGKDHHPPDLSVHPQGGTFPRSLTA

SEQ ID NO: 1014448 - protein, 63 aa, Homo sapiens
TWVHLGSPTTAPLPLFYLRRPQLEALPFTDAKGLSPRHYHVKHVLVVFSYIHSALRGSMGCSL

SEQ ID NO: 1014449 - protein, 56 aa, Homo sapiens
GTRTLGETWMRSGWAVWDLARTWSVLSTPRGMAGDLKNPRCEGTTKKFVALLEGEN

SEQ ID NO: 1014450 - protein, 37 aa, Homo sapiens
GRIQCFKIDTKEFVREIKHPSFGRNVFAISYIPGLLF

SEQ ID NO: 1014451 - protein, 35 aa, Homo sapiens
VLHFGFNNCLGFFDFLNLNASLLNDRCSIFSVEVN

SEQ ID NO: 1014452 - protein, 90 aa, Homo sapiens
DRPGPSLLAVVSLWRVLGRLVLGLVSMAGRVCLCQGSAGSGAIGPVEAAIRTKLEEALPEVLELRNESGGHAVPAGSETHFRVAVVSSRF

SEQ ID NO: 1014453 - protein, 62 aa, Homo sapiens
MAPGDLAGDRESDRISQGETFVTLTSLGRNGDRSSFIDLVSSGLRVVVNFNGELKSNLNWSL

SEQ ID NO: 1014454 - protein, 85 aa, Homo sapiens
FPRGSGIHRLAFLLFKQGQPIDFSEEARPSPCYQAQRAFRTFFYKKHQTMTPAGLSFFQCRWVCSVTYIFHHSSGSCGSRCLELR

SEQ ID NO: 1014455 - protein, 116 aa, Homo sapiens
YEAALRKKLAVRPNLLVKGHFQQLECAGAQLEPVLQELVHRGLEDGFSLVSAATGKERTTTCSPTRGSVGIPVKMTRYVVRKTAPSAGSNVVPQHCPPALLTPIRQQVDAFAHTSP

SEQ ID NO: 1014456 - protein, 45 aa, Homo sapiens
IHCQGFDELLEVWGLGRLLLDQGSPVELRLQKRMQGCMCGTVRSG

SEQ ID NO: 1014457 - protein, 64 aa, Homo sapiens
MLMLSPWRISCLFRPSKDTHAVFLASGDSMIFLRAGTTMGRKDSEWGQMGVIMIYVGVDHGRSR

SEQ ID NO: 1014458 - protein, 112 aa, Homo sapiens
EAEEKSLETLTRTITETSEQQVSWETIPLIEPISLSLGYKLVALVDKAQGNQLTQRIRGVRQVISDGNGVLLPEIRIRENFRLKPSQYAIFINGIKADEADIPADKLMPCPP

SEQ ID NO: 1014459 - protein, 37 aa, Homo sapiens
PRILILQKRGQVSSATGESREAHSEGSASDHPAAPRA

SEQ ID NO: 1014460 - protein, 35 aa, Homo sapiens
IDKLTEKSQVSEDGTLRSLEPESQSSSAEGSPSEG

SEQ ID NO: 1014461 - protein, 103 aa, Homo sapiens
RIAITAQGQNRTSTHRKEIRPGLLRDSSGVLPGNGTCWLLRSWELGAPGFPRCEGAVPLGRDRPLSAAPRGSPPAAGVGRRRRGYNPRRRGCTAQKNTFGTGA

SEQ ID NO: 1014462 - protein, 66 aa, Homo sapiens
LFRLEDSGPPDAVLHKGHTTSVFPPKVSNRTLVRQMKTEGKIHKNKIHFQNAPVKEAREDRRKDDR

SEQ ID NO: 1014463 - protein, 42 aa, Homo sapiens
FQGDSHLEQPGCTIIVVDENIERRNHYLDLAGIENYTSQFGP

SEQ ID NO: 1014464 - protein, 44 aa, Homo sapiens
CCACPAAQGSEGKRFGSLPPATSRTVPASDAHAHAVANSGVSSD

SEQ ID NO: 1014465 - protein, 130 aa, Homo sapiens
ASKNSLGSDHSSVVTPKKSGKSKSGRSLNEELGEDSENKRKAAFFFVVADQEHREVPEKGARGPQTIALHAQWRPCVVRESQGSVCLCREPGPCRRPAGLWSPEKDKHQALAFISRMGTSRGGLSRRFSI

SEQ ID NO: 1014466 - protein, 48 aa, Homo sapiens
TWRKNLLFRKPEDTQKRFMTVTWERMLTIDGNTVNAHQMEDTITSKQS

SEQ ID NO: 1014467 - protein, 63 aa, Homo sapiens
VIILLQHALATANLHHHGHFCILVPFLYAAVCCGICVPRCSLPVREVINICSMLYRWERGQHY

SEQ ID NO: 1014468 - protein, 33 aa, Homo sapiens
YFIPANKDPPMAKVKAKDFQETGYWGRDFNNKT

SEQ ID NO: 1014469 - protein, 32 aa, Homo sapiens
LPCVKKPVQGLPCQGLKVFGCNKPGTQTCQQP

SEQ ID NO: 1014470 - protein, 30 aa, Homo sapiens
VLQNVQKFAYLVGDYWLETGEQAGKQAEEQ

SEQ ID NO: 1014471 - protein, 80 aa, Homo sapiens
GMTLFKGSLLGLTSLGLGQMQPCPSQLVSGGAMKMLKCPSPGTVCTSLSSIQGCYRLSQERVEALDDAKWKPQARARKGF

SEQ ID NO: 1014472 - protein, 42 aa, Homo sapiens
LLNRKDKTTFEKLDYLMSKEDNYKRTRDYIRSLKMVPSIPYL

SEQ ID NO: 1014473 - protein, 127 aa, Homo sapiens
GSAPAPPACGQLASSHSPMPVRLSLGTGRCWSTNFEVVPPPSVQCGPCGKIGQLAEARQRDRVRDGDHMIIRTAEALLGTTSWDFQVGKEFEELQGIDDRKCMTTVSWDGDKLQCVQKGEKEGRCLT

SEQ ID NO: 1014474 - protein, 31 aa, Homo sapiens
MYILWALLFAFLAVSLVRVFAPYACGSGIPE

SEQ ID NO: 1014475 - protein, 54 aa, Homo sapiens
QGHNPCFENYCSNDFEDTMGTPGDGKSYSERATQKKWRPDCLTSSSQSELTMRG

SEQ ID NO: 1014476 - protein, 107 aa, Homo sapiens
RSSCSAQTVSKWGRRNFHVFREPKDPPRRPRGFHRRTPRPLRHITQRQWANIADPCALSQMGAGPQGVDTAGSMGSDSASFCSAAKDGQKHCHSNIKCLKTWQPFST

SEQ ID NO: 1014477 - protein, 48 aa, Homo sapiens
RRVSGCILSQGPWTLGPENVYLPAGSAVSGTPQANRDSPRTHLDDYVT

SEQ ID NO: 1014478 - protein, 98 aa, Homo sapiens
PLKLDNYRGPGEDAWVPLGALPRGPVRTPPLHWARTTPRAARSVLHHVLRPTFPPNSGAHSLGSQVIRASAVGPGTPWPWGTTCPHMLQTLGQGRPGV

SEQ ID NO: 1014479 - protein, 97 aa, Homo sapiens
MFVGFLGCYGAIQESSLLGTFTCLAILFPCQVAASGASTSQIAKDVKFYDQALQQAVVDDDANNAKAVVKTFQETFDCCGSSTMTALTNSLLKITLS

SEQ ID NO: 1014480 - protein, 64 aa, Homo sapiens
LLDIKTRLEQEIATYRSLLEGQDAKMAIGIREASSGGGGSSSNFHINVESVDGQVVSSHKKKSK

SEQ ID NO: 1014481 - protein, 33 aa, Homo sapiens
AQEALLQMLQEAQQACWPHNLPVVQAAQQRELE

SEQ ID NO: 1014482 - protein, 88 aa, Homo sapiens
PQELLIFPHDLNLCGLTEPRSSGFCDAAPEQCWELNRDWGGGRLQPPPSLWARTLLVFEVQQPFLFVLDQQHKFPVFMGRVYDPRGLR

SEQ ID NO: 1014483 - protein, 107 aa, Homo sapiens
HTGFWGKTREIINYEFDTKPGVPGALSSIVGVLVPAESTGIANNLFGPGPSPLMGVELLHLNNVSLGCILLGGLFIYDVFVFWHQCDDSPSSFEGTNKIVFPGSLEK

SEQ ID NO: 1014484 - protein, 64 aa, Homo sapiens
WRQCNPLVIQADVLQRELESCLRREYTPENLPLLLLQHYTERITQLVQNKYLHMLRWRRLCQTS

SEQ ID NO: 1014485 - protein, 56 aa, Homo sapiens
MLKDVDTSWTVLASSGFKEQLGRTPALNVFPDLEDGTEDTGQTSTASMHQHVEACA

SEQ ID NO: 1014486 - protein, 38 aa, Homo sapiens
MSGSGRELGEYGLQAYTEVKTFTVKVPQKNSEESCKLS

SEQ ID NO: 1014487 - protein, 70 aa, Homo sapiens
MGAPPGSGATWGDAFGGARPPADANLSRQTTGFPERKDREMVGHTAGDDGRGEAPAAGTTSPTTLSGLLK

SEQ ID NO: 1014488 - protein, 57 aa, Homo sapiens
YKAPSFIPGVYDKAKGKNLSVFCFRGSPHCLGSDSICLDSGHLSPPPCPEPCADSFT

SEQ ID NO: 1014489 - protein, 110 aa, Homo sapiens
GPGLSPQSAAGLAAQDFSVYVHPQPPGRAGRQSSFLKSRDRKNLDATAKQRTHFLPGTRFCPLLLSACPASSALLGRVPLTACPRTRGLSPFPPHRPGGDLFTPKDYKMK

SEQ ID NO: 1014490 - protein, 72 aa, Homo sapiens
FDEGRNNFEGEVTKEKLLDFIKHNQLPLVIEFTEQTAPKIFGGEIKTHILLFLPKSVSDYDGKCGNFKKRAE

SEQ ID NO: 1014491 - protein, 121 aa, Homo sapiens
GPSSRTGDLYEAPAVADRLSSPEWPSRARQTVTSTPAALLKGQYSWGEGLESFAHLPFFPPAPTRFECRDPGLLFVVGGAEEVPPPLGTAAWECRTVTAVRVMTSLPSSSCSLVLGGRRCV

SEQ ID NO: 1014492 - protein, 38 aa, Homo sapiens
FTVGAKTFKMRKHRHLPLVALFSLLLSGIAMTHAQQQS

SEQ ID NO: 1014493 - protein, 37 aa, Homo sapiens
EKDVMFLIEGSEGVRSGFPLLKEFVQRVVETLDVGLT

SEQ ID NO: 1014494 - protein, 31 aa, Homo sapiens
SLIDGQTLSKESPSHGLELSAPEKASPSNAS

SEQ ID NO: 1014495 - protein, 35 aa, Homo sapiens
ETILGLTGATMGSLICFICPALIYKKAHKNAPSAQ

SEQ ID NO: 1014496 - protein, 46 aa, Homo sapiens
SRADGVFEEDSQIDIATVQDMLSSHHYKSFKVSMIHRLRFTTDVQL

SEQ ID NO: 1014497 - protein, 33 aa, Homo sapiens
FSSAICDSFLICPQGSEWQGVSPRMTQDKRQQQ

SEQ ID NO: 1014498 - protein, 52 aa, Homo sapiens
YWANLKLWFKQKISKEEFDLEAHRLLTQDNVHSHNDFLLAILTRCQIFGFYT

SEQ ID NO: 1014499 - protein, 34 aa, Homo sapiens
MMSRGINKGDTQGLLTFAFRGFDENLTFLISYNV

SEQ ID NO: 1014500 - protein, 67 aa, Homo sapiens
KAVFLARDKHHLSDICHLVRHDVPYLFQKYVKESHGKDIRVVVVGGQVIVSMLRCSTDGRMQSNCFL

SEQ ID NO: 1014501 - protein, 44 aa, Homo sapiens
AGDRSQERGNSMVPPHWVQLLGMQRRLTGDGKAGQGSTSGKITR

SEQ ID NO: 1014502 - protein, 32 aa, Homo sapiens
GVNLFYFCIIIYLYGDLAIYAAAVPFSLMQVT

SEQ ID NO: 1014503 - protein, 58 aa, Homo sapiens
VLEEPAAHTSAPALRRCVRSHLFLRSLLLESQCPILSFTVKSADMMNQCVHMPFHVLT

SEQ ID NO: 1014504 - protein, 32 aa, Homo sapiens
PYDFGGVLTNSNRDIINGDAIHKRNQSHREMH

SEQ ID NO: 1014505 - protein, 70 aa, Homo sapiens
IRHRGRPEPHAIPTGDAGGFPVGAAALPEPRGMDFLLCIADTNRRRKYSVEEGGSLAKAPPSSLDTRGPK

SEQ ID NO: 1014506 - protein, 96 aa, Homo sapiens
HRLGSSSPERFPHVHLGKALPFIWGQRQGRHVRPFLQGPVFGDMNSLPSPPCLSVDKPGHVWVNWAPCSHCFLGFKYATRPQEKKSSRDPFPHLSS

SEQ ID NO: 1014507 - protein, 115 aa, Homo sapiens
AANFPGIMTSRVQAAGWGISARQWDWAALDSWWPRHPYVRLPVCRTNGGRYEHQGGIGRRCNPHFGETFAFKVPYVELGRVLVMAVYDFDRFSRNAIRGGAGPYELRGPAASSGL

SEQ ID NO: 1014508 - protein, 85 aa, Homo sapiens
FGTMAVPSRGVERRGKAVQTWARMSVVSACVLLTQCLRDLATPTGRQDVGPQGEAEELGLRLSEGCTLLSQALRERSSPRDFNRQ

SEQ ID NO: 1014509 - protein, 71 aa, Homo sapiens
EPRLSPEAGGFLTYNLSGGELMKSKYSDITIMFEETQVPALLEAGFMENIRTEVVALVPPADCRYYFPQMD

SEQ ID NO: 1014510 - protein, 31 aa, Homo sapiens
RIGKRVKALLEEFPDKGFFFAFGAGHFMGNN

SEQ ID NO: 1014511 - protein, 42 aa, Homo sapiens
FYQRQDVARRCLSPSGSSGAPASPACSSPPSSFMDVNEPWLP

SEQ ID NO: 1014512 - protein, 82 aa, Homo sapiens
MAVCLGVGGPRKALQDPGEYLSLSLQTSSFSFSLLNYRNIWKNLLILGFTNFIAHAIRHCYQPVEMREPIGLLPVLSAGQRT

SEQ ID NO: 1014513 - protein, 110 aa, Homo sapiens
MEFQLLSPMLEFNGTILALCNLQPSPSRLKRFSCLSLPSSWASKYLPPHPANFVFLVGTGFHCVGQAGLKLLTSGDPPASASQSAGITGVTTPGHESTSLLDVVSEILRM

SEQ ID NO: 1014514 - protein, 80 aa, Homo sapiens
NLAKLKAYLALTQSGLLVYYAKACWLPIGRGYSSLRRAHRRLLREYVTLKGCFYGRCLGFQVRPIRPLQTISMGLVSSGS

SEQ ID NO: 1014515 - protein, 92 aa, Homo sapiens
VHDVVDKPSSSLPQAGTAEGPQPKKGAPPTSSQTFLRTLAPVQAIPPPTSIWGLASHPTGCTVRRTLSPSTGLLELQWGPRVLTQQPGRYSH

SEQ ID NO: 1014516 - protein, 65 aa, Homo sapiens
MVEKVDKGNSEQATVFSFPAAAQDPAAHCEILPNHPLVGFGIWSPGTHGQFPTSKKGTLRVNVRY

SEQ ID NO: 1014517 - protein, 122 aa, Homo sapiens
ESMIRMPTLRIHLRDYVIEDDVNMAIRVMLESFIDTQKFSVMRKLLPATFQFRRDNNELLLFILKQLVAEQVTYQRNRFGAQQDTIEVPEKDVDKARQINIHNLSAFYDSELFRMNKVSATT

SEQ ID NO: 1014518 - protein, 115 aa, Homo sapiens
GCDCAPAQLPPPPPLPPPCALHRPPSRLLLGSEANLTHTDRPEEMPLVPPTWDGPQVGRGAVQGPPEAVTSVGCYSVSSVLPGPAMEPWGDLLHCCPPRVEDPTNRQHYKIRKHI

SEQ ID NO: 1014519 - protein, 41 aa, Homo sapiens
PGLPPLRALPPPTLEEEAASSGLAGLPALFLPSQWCVVSSV

SEQ ID NO: 1014520 - protein, 111 aa, Homo sapiens
GSTEFQCKPESLCVSSKHTDFFLHAMQPLPQGMGEKWHQQFKTVFCTLFSASFSDMKLKPGTLITHLIFDSYQGAFCEDSCSIWWNKLGGVMISGGLLFGPSCSVSILIYY

SEQ ID NO: 1014521 - protein, 29 aa, Homo sapiens
IRNEEGLKSGNVFKYGRDKKNLKELVEYR

SEQ ID NO: 1014522 - protein, 55 aa, Homo sapiens
LSAGTSPPGKPRDCQDFSLSVRGFTPARQAQGIDAETASPSQCRDVTPRQAQTQA

SEQ ID NO: 1014523 - protein, 29 aa, Homo sapiens
DGAGSDLETGATAPTPSTSAPSHPGPPQR

SEQ ID NO: 1014524 - protein, 87 aa, Homo sapiens
NPKCPLVEPRWPLPLENPCLVVLESLLKPAMANEANLLPLESVYRLLVRYCIVCLLSQEAERLNYPPWILPEIARNTQLGSSHTIPG

SEQ ID NO: 1014525 - protein, 37 aa, Homo sapiens
QTWRQVQKIEADSRTLWAHCWCPLLQGIACLCCDARR

SEQ ID NO: 1014526 - protein, 107 aa, Homo sapiens
DLLTSCSARLSFPSAEIAGLRPAGLFFKKKCIYLVCFRWGPYVAQAGLKLVGSNDPPASASQSVGITRESTWALFHFFRDKVLLCHPHWECSGCVHYSLNLLGAQVI

SEQ ID NO: 1014527 - protein, 70 aa, Homo sapiens
MTGLALLYSGVFVAFWAALLAVGVCYTIFDLGFRFDVAWFLTETSPFMWSNLGIGLAISLSVVGAAWGIY

SEQ ID NO: 1014528 - protein, 101 aa, Homo sapiens
GRIDDTGPGHGDEAGWRHRLPFGVLAVKGLGDDAAARAFAKRRGVERRRRRGGVTANSVIAVGKSGGEFQRRVDAGMPRRRDHPGRFARFEPPLRVRSSSP

SEQ ID NO: 1014529 - protein, 126 aa, Homo sapiens
EKQPLKEFTGRARWLTPVVLVLWEAEAGGLLELGSSRPTWSTWRNPIYTKNLQGVVVRACGLSLLGCWDYRHLPPHLANFCIFSRDGGEQRGSAPWLAGPRRLPQESGRPREEPSTMPNVGKGTSN

SEQ ID NO: 1014530 - protein, 117 aa, Homo sapiens
VTNLKWERRITARALAGVDPSLLELTALRVPAGPGIGQGSWGLPTHLVSSLLFFPGPCCLLSRTPEPDFSRPPGQGLFPNSWPLAALVSAGFQPPPQPLLGGPEKRVRPCDHVQDKP

SEQ ID NO: 1014531 - protein, 64 aa, Homo sapiens
MSETKWLLVEHPMLSASLSVTFTLYFVSNLGIKVTINKLKISLRKNARITVSVPHSLRNRCTPF

SEQ ID NO: 1014532 - protein, 136 aa, Homo sapiens
GFYQLVFAENILQNFWKLYGVYYQVFVCVHLTMCVHMCLAGKGHIRSPCCWEGRLTGLTVPRPQAQWRAGRGCIPLTATLPGGLVALTGPDLQGAESNRKHAETRQLFLCCVSYLERVLCPAMSLMYAGAVLRLVS

SEQ ID NO: 1014533 - protein, 99 aa, Homo sapiens
GGSKRVVEMLPLPPRAALHSGRDPGLKRFKDGGRIGREFSSGPKYEVGIRCEARLGRCSSAAGGSPGPPSLRGAATDRAALSRELRASLLAALGLKVTA

SEQ ID NO: 1014534 - protein, 37 aa, Homo sapiens
MCKVALASRLHACCVCGLDSQGHETGGPALTPYALGR

SEQ ID NO: 1014535 - protein, 43 aa, Homo sapiens
DILQPKGDDVARIWYLRDIITRYQATFNVIERPKPVIAVHGCC

SEQ ID NO: 1014536 - protein, 33 aa, Homo sapiens
RRAPIGSSAGDAIWSRVSLVLHCGLSALENSLP

SEQ ID NO: 1014537 - protein, 47 aa, Homo sapiens
MNSGFYVQISPGLWRASQCLLRDSIEGVLFVFLLAPGMKYRVLGPLY

SEQ ID NO: 1014538 - protein, 38 aa, Homo sapiens
MEALSLLFQHYACLLAAMFSAMMIMNGPPSETVMKQAP

SEQ ID NO: 1014539 - protein, 31 aa, Homo sapiens
PPEDQWKVDSKEWASEDPFSVTKVTPRNTVN

SEQ ID NO: 1014540 - protein, 30 aa, Homo sapiens
VLFHPNSGAAGEYGGLQTVRLDHHKAFYIT

SEQ ID NO: 1014541 - protein, 61 aa, Homo sapiens
RILLNYAVYNPDIGYSQGMSDLVAPILAEVLDESDTFWCFVGLMQNTIFVSSPRDETWRDS

SEQ ID NO: 1014542 - protein, 49 aa, Homo sapiens
VVKVKPNDKDAKMKYQECSKIVKQKAFERAIAGDEHRRSVVDSLDIESM

SEQ ID NO: 1014543 - protein, 30 aa, Homo sapiens
MKLYHQWLSTVRAKDHAKMGIKEVKNRLKQ

SEQ ID NO: 1014544 - protein, 71 aa, Homo sapiens
MLTDMMKGNVTNVLPMILIGGWINMTFSGFVTTKVPFPLTLRFKPMLQQGIELLTLDASWVSSASWYFLNV

SEQ ID NO: 1014545 - protein, 51 aa, Homo sapiens
LLDEGLPDRPGLSKWCPFMGARIQVKGSLEQRLENVELAGGHLSTLKAIPV

SEQ ID NO: 1014546 - protein, 43 aa, Homo sapiens
ISRLTNMDPPRKIPPGCYDCGDGFYNPTTRVIKDYLNRFLRNA

SEQ ID NO: 1014547 - protein, 60 aa, Homo sapiens
HSLFTVFSQFGLLYSVRVFPNAAVARPGFYAIIKFYSSRDAQRAQKACDGKPLFQTSPVK

SEQ ID NO: 1014548 - protein, 48 aa, Homo sapiens
MPCHRQNPLCAKLHMEYKQVMADLSTLENENTEALDKFKELDKESLFY

SEQ ID NO: 1014549 - protein, 43 aa, Homo sapiens
MVSCEELLAVGGLDGGRVTLFGHWTRAMEGCLCPQWMVLHPCE

SEQ ID NO: 1014550 - protein, 41 aa, Homo sapiens
LKEGLAKGEGAFRAVLCCMQLQGKLQLVSSILAKSLSGESL

SEQ ID NO: 1014551 - protein, 69 aa, Homo sapiens
VTIPWLELGMKSSKISEQKAFCSTWRTKDGEPAYREPGLLLPRASLLPSQVLLLGTIFPRHQGRPGGRS

SEQ ID NO: 1014552 - protein, 53 aa, Homo sapiens
KCWALGLPHDPSASPQAVSSPRTTPPLLTPPAGAPAPALEGLGHRHSSLISGW

SEQ ID NO: 1014553 - protein, 36 aa, Homo sapiens
SSPRTTFPSVACAPKQPLFRLLHLGFLPGILEDLGY

SEQ ID NO: 1014554 - protein, 34 aa, Homo sapiens
VKRQLPVKNSDYFQDIRQWGGQREVTTESSHYLN

SEQ ID NO: 1014555 - protein, 106 aa, Homo sapiens
QEPQGRHGAQRIWSGLEAPLPQGLAAALATWFNQPARKIIRKARQAKARRILPRAPRVPIRPIVRCPTVRYHTKVRAGRAFSLGGAQGGRHQEGGPDHRHFCGSEE

SEQ ID NO: 1014556 - protein, 69 aa, Homo sapiens
MLSTHRCDWFKGLAHLFLGFTTLSSFLPSQICAHCFQLFIKKALSNSFQIKKDQLVYTQHLWMPPVPGP

SEQ ID NO: 1014557 - protein, 49 aa, Homo sapiens
LLVHGPWGGETQNIGLGSSCPCRSGQERQVEQLQHPPGMRGSSRLVGGT

SEQ ID NO: 1014558 - protein, 112 aa, Homo sapiens
MVSLCHLGCSAYAWMPWPLRLKLSSFRASQVAETTGMCHQARLIFKYLWRRGLTMLPGLLLGSSDPPASGSQNAGITGVTHRAQPMIHFLKKTALLRYNSHTITHHPFKVYS

SEQ ID NO: 1014559 - protein, 79 aa, Homo sapiens
AQERTQIASDLGPLLGHEGNSGRLLLRLFTVYPSTKVYFPHLSACQDATQLLSHGQRMLAAGAAVQHVDNLRAAGARWR

SEQ ID NO: 1014560 - protein, 108 aa, Homo sapiens
MTVFLPFKPWNPLCWFAGLCGVLTQPELRLLPQLFGKRERQSLFLRSMGRCIEMPFVVLAVVLSHEGIELHFGHSGFGDGHKSEERFHYFFLSSFFLRQHLALFPRLE

SEQ ID NO: 1014561 - protein, 111 aa, Homo sapiens
IRRPLPPFLRHQSGDFRETRAQLAWQVCLPDEPLLILALLAWVALADQESCKGRCTEGFNVDKCQCDELCSYYQSCCTDYTAECKPQVTRGDVFTMPEEYTVYERLGEEKN

SEQ ID NO: 1014562 - protein, 69 aa, Homo sapiens
TGEVVMGVYSVSFTGYVFIPADSLMPKHPIHYQVSLLIGNSFTLAVPLWFLSDLHLVYSCQDSHSLGDP

SEQ ID NO: 1014563 - protein, 130 aa, Homo sapiens
QLSFSYICGFGERIIPGMIFREPESRKLKGPEIRAARSRQRTPISQTLSQSEQGTKGSLEVAPAQKLQRASCSGHEVMPCFLPIPNAPGPPMSPMCPSPNSIPTHFFFFFFEMGVFNSCPGLGVAVGKVQ

SEQ ID NO: 1014564 - protein, 39 aa, Homo sapiens
MCFRKKTTEHNILKFFGYCNDVDRELRKCLNEVLALSPK

SEQ ID NO: 1014565 - protein, 139 aa, Homo sapiens
LPSPIGPPGGKGKYPPGFSPWEFPWLRSQDATRKPSLRAPFPGIFIHPKSGKILDRSLLAPAFGGGVCWGGVFLPGIPSHLGKVCRFLVNSRVFTFQWLEPVIQRSHKSQRQTFPSVFESENLCKDQQAQSRRTEVNSC

SEQ ID NO: 1014566 - protein, 67 aa, Homo sapiens
AWNPCQSLTTSSFDDVGVLQKKLVPFLTELNMHLGPGIREAERMDPGGWSSQAAAGLNFLVHTNEVI

SEQ ID NO: 1014567 - protein, 81 aa, Homo sapiens
PAEALVVVPLHVPTCLSWSPTPRPERPCVLFPSMYSRVCPDGLLPPVPLRGPGVCCSPPCTHVFCAVFECVCCVCMCVRVL

SEQ ID NO: 1014568 - protein, 124 aa, Homo sapiens
LLCPPPTPTNLPWCQRKPPDPKLPHSRPSGRCEVEACGMRVPHRSWLLELGRNRECGLAGYIVKQRARGGGGRCTEKSRDGNLGIRKQKTKDRQIDTDRGCLLLAGFPVPNVPRSRPHESFLFL

SEQ ID NO: 1014569 - protein, 70 aa, Homo sapiens
RNHKVGKIENYPWPNMVKLSLLEIQGLAGYGGARLWSRLLGRLRQENHLNREAEVAVADIAPLHSSLVTE

SEQ ID NO: 1014570 - protein, 74 aa, Homo sapiens
LPPRFTPPPASAPYRDLQAPAHYAPAKFFVFLSRDRGFHPFVARDGPRSSLTLVPPRLGLPKVGITGVHELLHE

SEQ ID NO: 1014571 - protein, 127 aa, Homo sapiens
SPPNGFPTDINDSPFGTLPGSAEPPLTAVRPEGSEPPGFPTSGPRRRAVHARTAPAATVWARQAAGVAGLVTQKAQVPYPASPASPWAWRWCCGQCLGPAGPPADTRACFSSQVCVTYGVCFHAVQA

SEQ ID NO: 1014572 - protein, 78 aa, Homo sapiens
LLHFFRNFLPNYSVWRKLQLERKLGVTAHAYVVDCSNREEIYRSLNQVRLQVHKFLQIILFPEDADVENEKGLYDCLI

SEQ ID NO: 1014573 - protein, 111 aa, Homo sapiens
LCTPCSSAEHGLLCVPSMAVSKRRLGRNRGGQPPPRHPHSQQDCSFKGVVGLGQNMGFRVAAGGPRHCLGDGSLRVALRGGPGPWEEGVWGLLRGFSERRGQVYTGQALFL

SEQ ID NO: 1014574 - protein, 34 aa, Homo sapiens
EAIELALGFPELVIQAYFACKNELAANFLLSQNF

SEQ ID NO: 1014575 - protein, 102 aa, Homo sapiens
SLGNSRALHMPDHPYTTTADALLILHFLAGGKQHKTSAINKTTTKDPHRVHFTLLPPPPEQVLLSTAKRPEDGSHHRTLCRHPQVPAWEPGSSAGWLDPEEK

SEQ ID NO: 1014576 - protein, 39 aa, Homo sapiens
KRREKKAAEGCKGQGPGEVPKVALRGAPPTLWSQIKAFR

SEQ ID NO: 1014577 - protein, 107 aa, Homo sapiens
MESLSPRLECSGMIWAQCNLHFLGSSDYSASASRIAGTTGTHHHTRLIFVFLVETEFRHIGQAGLELLTIVDLLALAAQSAGITGVTMPGNNFYLSINLFLNKKLKN

SEQ ID NO: 1014578 - protein, 87 aa, Homo sapiens
AAADSGHSRGLSRQLDHVWTTHYVGAAIPGSGYPNTLHWVDEAGKVGEQLPLEDPDVYCPLQRHRNVTGELVYAHYGRPEDLQDLRA

SEQ ID NO: 1014579 - protein, 72 aa, Homo sapiens
HINEVVLLDDPVVGVLRLADESGHVVIRWLPPETPMTSHIRYEVDVSAGNASGAVQRVEILERTECVLSNLG

SEQ ID NO: 1014580 - protein, 72 aa, Homo sapiens
GKVGAGDPAAYGGPAPAPASEFPQYLSIIIGHFWESGMWQDNRVIVGRGSAGKHVNKCLCIINKLEKKVLCF

SEQ ID NO: 1014581 - protein, 67 aa, Homo sapiens
AGAFDLKAAVLEAPAFRRAGADIILPYYTAAAAVAEGGMMETVPGPRTRTLKRSRGRQVKTKVNAAF

SEQ ID NO: 1014582 - protein, 108 aa, Homo sapiens
PEARRIALPPKFEVPVLSNHNKTPVLLKKKNGLGRGLSRPVIPSSLGGPRWVDHEVRSLRPSLTQHGETLSLLKIQKLAQVWWRVSVIPATQEAKAGKSLEPRRRRLQ

SEQ ID NO: 1014583 - protein, 127 aa, Homo sapiens
IRQSLALSPRLECSGPSRLTANLHLSRNSPASASRIAGTTGICHHTQLIFVFLVETGFYHVSEAGLKLLTLVDPPASTSQIPGITGVSRCVRPAYRFFNVKGTSRDYLGGQKGSLRYIGWGYLSGDH

SEQ ID NO: 1014584 - protein, 29 aa, Homo sapiens
MARAWEVEVAVNHDSATALAWATERDPVS

SEQ ID NO: 1014585 - protein, 66 aa, Homo sapiens
DKSLLPRLERRGTITTHRFNLLGSNDPSTSASHVAGTIGAHHTQLIKKIFLCGVYVAQAGLLTPRK

SEQ ID NO: 1014586 - protein, 62 aa, Homo sapiens
PNMVTPCCSHQVYPRGDCHGTVTALRRTVPPAVPGVTFLSGGQSEEEASFNLNAINRCPLPR

SEQ ID NO: 1014587 - protein, 107 aa, Homo sapiens
GALGVRLSSTWLDMVGTLAPSKREREPKLSVLQMDRKEPGHSSACSRPEREKVKLLTLKARESRLHSVCGSHGFKQPRQGGTVLRELVLSCLMESCLELKPYFTLPK

SEQ ID NO: 1014588 - protein, 73 aa, Homo sapiens
IRHSGTVQDMMLLREYRQLQEQQSLLPSLSPQPSPLSSKKQPEDKAPLFYYLLKGWNVRNKLHQNPSPPAPVF

SEQ ID NO: 1014589 - protein, 71 aa, Homo sapiens
GPIGPRRRAIIGAPQLPMVPCIDPGLPPLPTDGEGQDFPGIPISKVSPQPPITTTVWPKCCHACNPSTLRG

SEQ ID NO: 1014590 - protein, 68 aa, Homo sapiens
STTHYPLMVKGQDFPGIPPSAKVLTHSPPNNNYSLAQVVVTPCNPSTLEAEAGRSRGQEFESIPGPTW

SEQ ID NO: 1014591 - protein, 123 aa, Homo sapiens
FRHRGQWNESSPRSQAINSVLFMGKTNPFEGNAVPIKVSNKSHLRDMAHEHAVRMISSPPAMCLVLSWVQATTRLMKWCPCSNSGTELEQIHFNTMWDIWGQRHVIRGSSKSHLAIWDEVDGW

SEQ ID NO: 1014592 - protein, 109 aa, Homo sapiens
RLPWKTHWAETGGRALEPSWRISRALISVLKPSWQWRADSERQNQEYQRLMGHQVAAGAGDCHLPQPARGQEDHYNNLSGLQGPRQQALGASAVLWKVSCGVEGWGKGP

SEQ ID NO: 1014593 - protein, 104 aa, Homo sapiens
DEISWAVAGLCFPRSRAASPGRPASSTPAPFPPRCLNLLLVGPSLPAWDLPVLLKSLAVAPSPGAPLPAAAPPPSWGLPGLVSSTARLGACGSSSCAGCLRPVP

SEQ ID NO: 1014594 - protein, 32 aa, Homo sapiens
VSAMTEEAAVAIKAMENNGSQGGGSSDPLNLQ

SEQ ID NO: 1014595 - protein, 75 aa, Homo sapiens
KNVPGPTNKNLTCGNNNPYYSDLALKDEPYNPILKKRLVKTYNPFSGDLIPIPEKFIFKTLINFSEFQLFNLKNG

SEQ ID NO: 1014596 - protein, 128 aa, Homo sapiens
LRQSLGLLPRLECSGAILAYCGLHLLDSSGSPASASQIAETPGIHHHSLIFCVFSTDRVLPCWLRWSRAPGLKPACLGLSECWDYRCEPLHAAMFSVFLREIPRSRIGLCNFQGSLKGLAWDVEHGFP

SEQ ID NO: 1014597 - protein, 105 aa, Homo sapiens
GDRVSLCSPMLECNGAILAHCNRCLPGSSDPPASVPQVAGTTGTCHHAWLICVFLVETWFCHVAQAGLKLLSLSDSAQRCPKCWDYRELLHLANRFSTKMPRPFT

SEQ ID NO: 1014598 - protein, 109 aa, Homo sapiens
LCERLTPRLPPRVRFSLQGHPGTNPALGSGFMSGPRRTNVAGTALQPHGKLAAARGSFLDSGLVAGNGPCGTQNPDESRWDFLSRGLQSAGPEALLSRLCPESVDVAVS

SEQ ID NO: 1014599 - protein, 67 aa, Homo sapiens
TLPRLECSGAISAHRKLRLPGSCHSPASASPVARTTDARHHAQQFFVFLVETGFHRVSQDGLDLLTS

SEQ ID NO: 1014600 - protein, 73 aa, Homo sapiens
GKVGAGDPRQHTEDPRRHQPLSSLSIYQIIIGHFWESGMWQDNRVIVGRGSAGKHVNKCLCIINKLEKKVLCF

SEQ ID NO: 1014601 - protein, 90 aa, Homo sapiens
IRHGADFYGNQIKPKMFCAGYPGGMMLPGHGGPFVCEDSISRTPRWPCCGIVSWGTGCAWAQKPFYTKVSDFREIFQAIKTHSEASCVTQ

SEQ ID NO: 1014602 - protein, 103 aa, Homo sapiens
GLTCNSCLCCILTLTGAAQQQTRVGVCARVCTPLRAPVPWGRCPSMLCGVDAWPWSVRCFSDPSCCVRGLRPPSHSGLSVTAQGVWAEWVEMSCCTRSRLRSL

SEQ ID NO: 1014603 - protein, 250 aa, Homo sapiens
GADPYDGGGVTPCAATTHKGGVAPTRRDARGGTITITVRRGANNKQSAACFVILGGGPPTKMWCISIRGAAPTKRRGVGLPTPDEAPCINTGQTGYDLSLSSGEDRFSRSSPAYSQTENWLCLATNMKFGALFSGFSPNLMKSFCFLQPEGGEYCPHRENFLYHQAPAVFPLIVLLVGAPWRFVPSGIPQHIVDAPLECPHRGCSTLRGITTSRGCRSGKFYSAVAPFTRAPLSGDFSRNTARLTQHPPN

SEQ ID NO: 1014604 - protein, 129 aa, Homo sapiens
MLSEKVVTKDYKRVPPCLANFLYFLVETRVCHIAQAGLKLLSPSHLPTSSSQGAGITGVSHCTLPIYLLFLEMGVLLCCPGWSQTPGLKRSTHLGLPNCWDYRHESSPGPVMYTPGTTSWNLGNCYEFP

SEQ ID NO: 1014605 - protein, 112 aa, Homo sapiens
MLSEKVVTKDYKLCHHASLIFVFFSRDKSLPHCPGWSQTPEPKPSAHLVLPRCWDYRGEPLHPAYLFTFLRDGGLALLPRLVSNSWASKDPPTSASQTVGDYRHEPFFTWAS

SEQ ID NO: 1014606 - protein, 101 aa, Homo sapiens
TKPECFPPLWLQGYTLTPVLLSQPKPSRFLDGGSLYRPGSAMAESRLTATSASQIQAILLASATLEAKARESLPGRCKFAVSRDSHHCTPAWDDRASASSK

SEQ ID NO: 1014607 - protein, 82 aa, Homo sapiens
VSSNVLFLLDFHSHLTRSVVGYLGRWDVNSQMLTVLRAFPCRSRLDAETAAAIEEEIYQSLFLRGLSLGGLVPQPPTQPGGH

SEQ ID NO: 1014608 - protein, 100 aa, Homo sapiens
TDKWRNGTTPFHCTSCSDNTYVCDGWYYWNDPLNLQYSPTDKGMRMWPACCLILPRRLHLLFSCLCKLAAPAIPLLMPLPLAILIPFSPASLLLYSLLLN

SEQ ID NO: 1014609 - protein, 109 aa, Homo sapiens
NGNTMRAGGPRCSLVGCILPWALTHSQGTGPMGMEGSVTTGLLCKCEAWPPPNSGTENPTRTDDLHTEAALLSPRGARPGDRGSCQFSGCSHPCGSSAPHNLGGPRPHH

SEQ ID NO: 1014610 - protein, 102 aa, Homo sapiens
ESRSVAQAGVQWCSLGSLQPPPPRFKRFSCLSLPSSWDYSHTPPCLANFWIFSGDRVSPCWSGWSQTHDLVIRPPQHLQQVPRVMPMWLDLGDHTLKTTGVR

SEQ ID NO: 1014611 - protein, 114 aa, Homo sapiens
FYFFETESRCVTQAGVQCHNLGSLQPLSPRFRRYSCLSLLSSWDYRRAPPHLANFLYFSRDGVSPCCPGWSLLSSGNRPPWPSESARITGMSHRIQPERYISNSRNRHGSYSVH

SEQ ID NO: 1014612 - protein, 80 aa, Homo sapiens
SSTGPYADICKRLGVGEPQGVVGPRWSNNSLQCGLLEAPPNGECIIIKGTTNVVQKNLNNSPGVPDFSTEIVYPNEKESK

SEQ ID NO: 1014613 - protein, 81 aa, Homo sapiens
QLCCPMECSGHNLGLTVNFTLPGFKQFLMPQPSPSSRDYKQYPPMPQDVQPSQHGARFPNAIPQYLLQRRKQHAQDRWRQD

SEQ ID NO: 1014614 - protein, 108 aa, Homo sapiens
PRMPPESSLVNHTFQPSKLPLLIWPLGESVGSVFMPGFFGSDWLSGAICVPSCLYVCSLPPSLPSSSLLFSFFLSISFLSFFLSFFLSFFLSFFLSFLPSFLSFLPSL

SEQ ID NO: 1014615 - protein, 66 aa, Homo sapiens
RQRTIKFGKPLDALWLSLVASPEKTQGLSGCDGVKIVIATPGAFLAGEPANLVLSRCTVVLDEADV

SEQ ID NO: 1014616 - protein, 116 aa, Homo sapiens
ESLTSSPRLECSGAILAHCNLHLPSSSNSPDLASQVAGTTGTCHHAWLIFVFFVETGFHRVRQGGLELQASSDLPTSASQSAGITGMSHHTWAWDLVISDFQIQVKKWEFIYVGFL

SEQ ID NO: 1014617 - protein, 73 aa, Homo sapiens
GMESGSVAQAAHCNLRLPGSSDSPASAFQVAGTTDVHYYARLIFVFLVKMGFCHVGQADLKLLTLGDLPALAS

SEQ ID NO: 1014618 - protein, 80 aa, Homo sapiens
GVQCKQSESTGRRARSADVQGQEKMDVTAQEARTLPFYLFLFRSSMNWMMSMHIREGCLFITRSTNSNANLFRHPHRHTQ

SEQ ID NO: 1014619 - protein, 112 aa, Homo sapiens
SPVKCNSHLNPPKKSKTFFSGHFKPGQPLAEGAGRVTLLSRGFGLSSCEVGDRGIFQGSWGVPGEGAVTLSVLAGSGRRRLLLGRRTQERRGRRSARVCGFREGGGNEPVLW

SEQ ID NO: 1014620 - protein, 137 aa, Homo sapiens
MHSASIRLRTCYDNDGSERATALLSLQRQHMHHRCCCASRLSPHSAPTVDAAATHLFCVAAQPQQRHYYYVAERLVMLLLRCCCCWCCGQHSRRCCGGSVALLLQHAAVLQGPTTQRWLLLVRQHTPTQQAAEKRER

SEQ ID NO: 1014621 - protein, 71 aa, Homo sapiens
ALPPLPLQHRGAGCWGPVTYCVPRNAGLGGSKSLFSTQPVGSSLILLGLQTLLPPLEPGHLDADSVVASDV

SEQ ID NO: 1014622 - protein, 70 aa, Homo sapiens
ALPASKEDLLCTPQQYRASGSYFGLEENGRLFAPPSPEGEAKRSAFVEVKAARAASLQEEGSDGAGVASE

SEQ ID NO: 1014623 - protein, 69 aa, Homo sapiens
ETLTKPEIEGNFLNLTTDIYKNPADKITLNGERLNVFPLRSGIRERCSVSPLLFNIVLEVLAREMGQEK

SEQ ID NO: 1014624 - protein, 116 aa, Homo sapiens
IRHRKCLVTVSDSANHRSEDHKNSGFRPTGNTLGTEALPSLPSPAAWGITPNYSQGKHGNPNRICLTPARRWLLRIFHHPVRLANVSGAFALKARERAGDETISFGLLKGPPSELK

SEQ ID NO: 1014625 - protein, 49 aa, Homo sapiens
MMSEKVLQSAGQLPDRLSLKPPRGKGAEDADSGPESRSVGEETSVCEKC

SEQ ID NO: 1014626 - protein, 114 aa, Homo sapiens
PPPPGGVPSNRGVPCLVVLGSDLFVVVSRPQLPSLLLAAFPPRGPPRAVLADLIMAAFSFTPVGFNISQLLKRVLSSPHENLGTFVSTKIPWTPTEFHAISLNLDIKNFKPFLN

SEQ ID NO: 1014627 - protein, 67 aa, Homo sapiens
MARAPRPSSLPAAGAAPAGSEARAPQPAGEGAVPPWEEASGGPGSLSLRCRGRKWASAQARPRAAQR

SEQ ID NO: 1014628 - protein, 112 aa, Homo sapiens
MAGTSPNPKFPEASPGPALCAGVSNGASLHEPCVSCARVCVVSYVWGAAGGAFVGAEGSSGCAIRTTWLLKAARDYQRYLVSSIYIWISCTSLGQFFFKHGVEERHKLPDFA

SEQ ID NO: 1014629 - protein, 68 aa, Homo sapiens
PTKTPDTGADVGGQQIICHMYILCNLPTAIRIKKSPSPTRISLPHLPLTPGNPLIVHLFLFCHFKNVV

SEQ ID NO: 1014630 - protein, 120 aa, Homo sapiens
PFPLLLNCFKTRLPRWPSKTPNNLPVKAGSFLNLLSKGPEVAVLVQRPSVSRTVLGLLTQSCSPEPAALAPHLPRSARRPRQRWTGCRRAPVRRRRRLFLPCAFCSCSTAALLDTDAGRL

SEQ ID NO: 1014631 - protein, 58 aa, Homo sapiens
NIFIGSEITLRRAGTGQSGGSFALGRTCCVGSAGGSLAHPSSSWHMALGAWHDLCRLG

SEQ ID NO: 1014632 - protein, 63 aa, Homo sapiens
FRHRATCAQGGQGVTPGRAFYYNAAALDDHQTVRGQDGSVLLLVTPGSLGWRRQSIQGDLGTG

SEQ ID NO: 1014633 - protein, 90 aa, Homo sapiens
NYCSCGGNTGSRRRHRSVRFPPLIPVFTLGQGVDLYWNRRGLRRLSRHGSVGTHSLAAQARRALLRLVAAQHEVASCHRGSSLRIFSIHA

SEQ ID NO: 1014634 - protein, 91 aa, Homo sapiens
PELKWQTISETSVGRTSRQAAAQKHQMVKEKETQKCCSRRQFQFLYLLRTKQPKECFLIQPKRKENTTTRKRRKKKITDVLAKINQNQGPG

SEQ ID NO: 1014635 - protein, 96 aa, Homo sapiens
DYSKSPETFKSVNMIQENMTSPNELNKAPGTNPGETEMYDLSDREFKTAILRKLKEIQDNTKKEFRILSDKFNKQIEIIKKNQAEILELEKCNWIY

SEQ ID NO: 1014636 - protein, 153 aa, Homo sapiens
MTDRKTGREPSPRNQIGQYLDFGFLNLKNHEEMNVCCSSHPVNVHESKHLCPFGSLLDSLFEKYHPAQQKVWKPSSRKWSSKVWSMDEFDLQTACYWFMTRSTNCILRAQISREQCNLSQKDDYVYALSCLFPCLTQRRHKEKVSSAWINWRL

SEQ ID NO: 1014637 - protein, 49 aa, Homo sapiens
MAVVYVSNNLGLAQGDFRVLRFQNLCFKIEVMFLKIIVLYSTEDELIDK

SEQ ID NO: 1014638 - protein, 84 aa, Homo sapiens
QAVSRRGGEVKYKRIRVNDPGEIMYTDVVGGIIKDINGRGGNALNKGGGSRVSVKVIGRVVVARRAGRRARVWTHIRVKPIEVI

SEQ ID NO: 1014639 - protein, 76 aa, Homo sapiens
NIVIPKMDATANDVPSPHEVRGFPTIYFSPANKKLPKKYEGRELSDISYLQEATNPPVIQEEKPKKKKKAQEDLKQ

SEQ ID NO: 1014640 - protein, 77 aa, Homo sapiens
MYAIVCTVAAAQYNDEEEAPRHKNFRYNGLVRRNAVIVVCSYLGPIYALAIFQCRKQGVDVDPERVNESGRHGEGSK

SEQ ID NO: 1014641 - protein, 83 aa, Homo sapiens
KVDKIPELDQETEAALENRIKNEEPTEPGAASSEKLTDPNKDTPENADGSDENKADYTIPDYRIGPQPNVPGIDYVIPKTGFY

SEQ ID NO: 1014642 - protein, 34 aa, Homo sapiens
EPTGCLVTLQSLPRPTEHSPPYSLEMTDLVAVWD

SEQ ID NO: 1014643 - protein, 51 aa, Homo sapiens
ILPYSVTSTKSFEVIQVIHGKPLDMVGPVQIPITLVGNKNLHMERISYEEA

SEQ ID NO: 1014644 - protein, 92 aa, Homo sapiens
MRLSEATARMHCCHEVQPKPVKEAFLLNKSIRVETPAVNLDQDGRDPDGAVDEGAGGINGHASPAPVNGINGYNRRHKSRVWLPKASFKAGV

SEQ ID NO: 1014645 - protein, 32 aa, Homo sapiens
ATKVPWNIELSDCYTNLYGCSLWHPKTVVVTS

SEQ ID NO: 1014646 - protein, 127 aa, Homo sapiens
RALILFKPPVSEPIPIHRKSPLPRSRKPATNDEASPLSVSPEVLVPGCIIPVCTGRRRRIQGKSLLPLSPPNHWLSHPVFLAHGQQVVSGKWLITWRNTKELLVGTGRQESLLVRGSSLVSGPVLGN

SEQ ID NO: 1014647 - protein, 57 aa, Homo sapiens
RCEGFIPIISNAAEYENIPRHHEDLLRQLAQKVPHNLNNPKFDPHVKTNLLLQAPLV

SEQ ID NO: 1014648 - protein, 129 aa, Homo sapiens
PRLMKSPIGEGMTRKDHADLSNQLYPCYAIGPDVQAMNRCVGEPLTSDDPLYLEFPQKFESNIAQGPENRTVETLDIGWQLLRIFPKEMLKRIPQSLSEFYPRDSGKAFSWLAFWHCSGALGENHWVSG

SEQ ID NO: 1014649 - protein, 89 aa, Homo sapiens
MGLWDLTCLLITYTTNAFPGEYIVFDNYSANVMVDRKPVNLLWDTAAQEDYDRLRPLSYPQTDVFICFSLVQSLLYENVRAKWFPRSAV

SEQ ID NO: 1014650 - protein, 122 aa, Homo sapiens
QARQPERNMNSPKAEASGKSGPRARPQVARSGLSGTANSSSRPCCPWAGRGQAELGTKAPGQLCAQASHLNAVLPQTRPAATAKLESSLEGEKYASMRSRAIFYTDTSRTPLVSKVFESWKL

SEQ ID NO: 1014651 - protein, 74 aa, Homo sapiens
PKSSILPLPSTHTFKKRINQGGEDQECFFGSTGIIQNNGVSKRHRQSKIDVRIWVLPDTEVGLTLQVTGDDRIQ

SEQ ID NO: 1014652 - protein, 79 aa, Homo sapiens
RHRSLGVPWGGPGPWNVSAKGPGSASGPPVTLWVGGCDSRSIAILDKHGHFKFSVIKNQPKTFSLMAHVSMSRNISTMR

SEQ ID NO: 1014653 - protein, 97 aa, Homo sapiens
MESCSVTQAGMEAGPLCIRLLVAAITKSHTLSALNNINFISYSSGGQKAKIKVRVGLVSSEGHKGGICLKPLSLVYETAIFSPCLYMVFISVCVYVL

SEQ ID NO: 1014654 - protein, 128 aa, Homo sapiens
RAEDCFSSLLQGLVTEPAALTHAAEGGILFLCYLLLFTCSEAGKKKCSERNSGSGFWKALTFMAVEEDSQSPGCPRWAFTGAGIAANSVAASLMSWSAILNGGGVPGGLVATLAEPSGLGWQQRSFIR

SEQ ID NO: 1014655 - protein, 102 aa, Homo sapiens
WVKKPLPAARVEIQNRSQTGLEDEHQMLTESPDPEEEAEEEEEFLDPLTTPREQCLEKCVRERLECDERVSSRSHTDCTEELFDFLHARDHCVAHKLFNNLK

SEQ ID NO: 1014656 - protein, 69 aa, Homo sapiens
RNVPEIPVYPAFPAPPQYALPTYEIPVKMPEPEPPPPLPAWRNPAFDNKYTSFLSVYVTECRNSGLFLV

SEQ ID NO: 1014657 - protein, 93 aa, Homo sapiens
RKLYGTSPLFGHHFVLENPGTIKVADPVYLLRQYMGTACPGILDRLLKMFPKMTTLDRMVFQNSDLYIFFQICDFHFRLLDWCLNASMSQCKK

SEQ ID NO: 1014658 - protein, 87 aa, Homo sapiens
ICRCKPERPLLSWGRLEATTWLQGRIRGLLGPSPRQCPQIRMWKPLRKSGALAIMSSQSAKPSLPSPSKSRLLNDLAHKHHLLLIQL

SEQ ID NO: 1014659 - protein, 57 aa, Homo sapiens
PVNFKLLSHCLLVTLAAHLAEFTPAVHAFPGTSSWSVEHRVGPSKLPFKLGASVAVP

SEQ ID NO: 1014660 - protein, 94 aa, Homo sapiens
LEKLPKFTGKPTIMSFIQLMEVNPSILIVSFMVMKLPKMCMKPIAAPIIHSAIQGNGTIFALWTDCFKNIYHAWVQKIIWELYPGFMTFQKIKF

SEQ ID NO: 1014661 - protein, 82 aa, Homo sapiens
MPVFIRVPEVQELPLTSPVDDFRQPRYSSGGNFETPKKSTCKGKSRKVQREQSKITMRQTTQLASPVIELEEWREFPPIHFR

SEQ ID NO: 1014662 - protein, 102 aa, Homo sapiens
NLNPTWKRFSLVQHFSGGNPSTPIQVCPDYDSDASHDLIGTHTSLQLQAVPAEFECIHEKQQKKSYKSGTIRVKICRVETEYSFLDYVDEAVQINFTVGVDF

SEQ ID NO: 1014663 - protein, 69 aa, Homo sapiens
VVQQSPNSALCADSPLCSQSYCCQTELQGEDVGACATYSCGSGVGIFLRVRECQVLFLAGKTKGCFYSP

SEQ ID NO: 1014664 - protein, 112 aa, Homo sapiens
MWKETPGVKLSSLPAQPLWNNRLPKLFTPPLHRLYKTLEKGRKEERQIWMNSSKNLKIFLERTSNSSISSVVIDEPIIEEPSRLQESVMEASRTNIDESAMPTTTSGSLSEK

SEQ ID NO: 1014665 - protein, 110 aa, Homo sapiens
HPLEDHANHGGHILTWCQDPETREGSPLGGCSSSPPLWVIQGRLRGSFYSHFYPASASRVAGTKGAHHHAWLIFVFLVETGFHHVGQDGLDLLTSWIRPPSAFPKCWDRC

SEQ ID NO: 1014666 - protein, 118 aa, Homo sapiens
LNSKPIFLVPSSKNGSIKPARDNLANHPTMPFGPRNCLMNIQCSLFKKFCKGEEEDEECSDQPLEVDNNQVGAIIKAHPFTTTREGAEELTIDHSMVIWHLKQTGKVKKLDKWMPHEL

SEQ ID NO: 1014667 - protein, 42 aa, Homo sapiens
AAVPPAPLPCPGSPPPPRPRVAQDAPSCINSFPSSASSSRST

SEQ ID NO: 1014668 - protein, 61 aa, Homo sapiens
NIALEAEIRPRGPKFKNMPKIGQAAVVQLENPSTFGPEVQITLKKFKDAMAKQGENHCHHT

SEQ ID NO: 1014669 - protein, 118 aa, Homo sapiens
VDLVKALDRDTVLCSGELPFFKGKIRRDPLKSKDTEEDHFHVDDHRARCPMMKRLGLFNIQHCKKLSSWVLLMKYLGNATAIFFLPDGKLQHLGKWNSPTDIIKFLGKLKTEGLASLH

SEQ ID NO: 1014670 - protein, 68 aa, Homo sapiens
SSSDALTSYITAAIPTRRRRSRDCRSLSCFDDFQGCFRFLFTFLLLLVQDLQLLLIQKKCMCELYFLL

SEQ ID NO: 1014671 - protein, 101 aa, Homo sapiens
RHRALTMPLANRTRFSSPFLARVGLTGGGMMVVGTGTSLALSSLLSLLLFAGMQMYSRQLLHRVASPSRAACLVRVSSCSRLPFNNLENLCLWAKFPSKDL

SEQ ID NO: 1014672 - protein, 56 aa, Homo sapiens
GGESELRRKPCPAAWGSQCLLHGDCRNLWWGREFQFGRVLTALMQTLPAAKAVSGD

SEQ ID NO: 1014673 - protein, 47 aa, Homo sapiens
MACLSVSLFSYPLYVKKPHFAWSYRDAVNCPSECFSNLQTIYILVCS

SEQ ID NO: 1014674 - protein, 55 aa, Homo sapiens
MPGQERTLNGSQMLLVLPVLSWLPHGGALSLAEASRAKFPGTLVAHRRQIPRVAE

SEQ ID NO: 1014675 - protein, 36 aa, Homo sapiens
TAVYYCTRGDYDFWSGHYRPLGQPTYYFDYWSQGTL

SEQ ID NO: 1014676 - protein, 32 aa, Homo sapiens
TAVYYCARRLGSGGYYLKPTWGQGTLVTVSSG

SEQ ID NO: 1014677 - protein, 34 aa, Homo sapiens
TAVYYCATNSLLYSGSYFAFDIWGQGTMVTVSSG

SEQ ID NO: 1014678 - protein, 33 aa, Homo sapiens
TAVYYCARTLYFDSSGPGNDAFDIWGQGTMVTV

SEQ ID NO: 1014679 - protein, 35 aa, Homo sapiens
TAVYYCAKGGVPDIVVVPAAIRFDYWGQGTLVTVS

SEQ ID NO: 1014680 - protein, 35 aa, Homo sapiens
TAVYYCARVVGLRYFDWSIGGAFDIWGQGTMVTVS

SEQ ID NO: 1014681 - protein, 31 aa, Homo sapiens
TAVYYCARLSITMVRGVINPYWFDPWGQGTL

SEQ ID NO: 1014682 - protein, 41 aa, Homo sapiens
TAVYYCARHQVSMHYYDSSGYYWPTSYYYYYGMDVWGQGTT

SEQ ID NO: 1014683 - protein, 32 aa, Homo sapiens
TAVYYCARDGYYDILTGYYKTGDAFDIWGQGT

SEQ ID NO: 1014684 - protein, 110 aa, Homo sapiens
VVLNQLCVPHEKTPASDRVTNRCTESLPNRRPCSALEVDQTYVPKFNAETTFHADTLSEKRQIKKQTALVELVKHKPKATKEQLKAVMDGFRSFCEVAARLDDKETCFWP

SEQ ID NO: 1014685 - protein, 34 aa, Homo sapiens
TAVYYCARDRGYYDSSGCTNWSDPWGQGTLVTVS

SEQ ID NO: 1014686 - protein, 30 aa, Homo sapiens
TAVYYCAKGSPHIAAAGIGPFDPWGQGTLV

SEQ ID NO: 1014687 - protein, 121 aa, Homo sapiens
SPAAAKGIPQRDAAGPRTASHTKDMFPGPYPRTPEERAAAKKYNRVEDYPYPDDGGYGDYPKLDRSQHERDPWYSWDQPGLEVELVNRCTGHLDMLQQGTVWDTSPTLFFWCHVFGSFLVF

SEQ ID NO: 1014688 - protein, 30 aa, Homo sapiens
TAVYYCARDECSGGSCVYDYWGQGTLVTVS

SEQ ID NO: 1014689 - protein, 74 aa, Homo sapiens
FGTGLKELVLGADTAANKQNRHFVDAYDYIIQYISGFLIPMLFMRAFIRSVEKSFCSFSLMNYKQWSLEIQMIG

SEQ ID NO: 1014690 - protein, 34 aa, Homo sapiens
TAVYYCARDLDDIVVVVAANDKRFDYWGQGTLVT

SEQ ID NO: 1014691 - protein, 34 aa, Homo sapiens
TAVYYCAKGTYYYDSSGYYFAPRRSYYFDYWGQG

SEQ ID NO: 1014692 - protein, 36 aa, Homo sapiens
TAVYYYARQNRYCSSTSCYDPRDLYFDYWGQGTLVT

SEQ ID NO: 1014693 - protein, 32 aa, Homo sapiens
TAVYYCAGSYSSGWGHHDAFVIWGQGTMVTVS

SEQ ID NO: 1014694 - protein, 30 aa, Homo sapiens
TAVYYCARDRTHYGSGKNWFDPWGQGTLVT

SEQ ID NO: 1014695 - protein, 32 aa, Homo sapiens
TAVYYCARHLHTVTTFNWYFDLWGRGTLVTVS

SEQ ID NO: 1014696 - protein, 30 aa, Homo sapiens
TAVYYCAGEVVPAAETNNWFDPWGQGTLVT

SEQ ID NO: 1014697 - protein, 33 aa, Homo sapiens
TAVYYCARGDIDLYYDILTGYTKWGQGTLVTVS

SEQ ID NO: 1014698 - protein, 33 aa, Homo sapiens
TAVYYCAGGLGGANVLMVYAFDYWGQGTLVTVS

SEQ ID NO: 1014699 - protein, 34 aa, Homo sapiens
TAVYYCVRLLGDYVWGSYRLNAFDIWGQGTMVTV

SEQ ID NO: 1014700 - protein, 35 aa, Homo sapiens
TAVYYCARGEYYDILTVYYKTGDAFGIWGQGTMVT

SEQ ID NO: 1014701 - protein, 31 aa, Homo sapiens
TAVYYCARETWWDIVLKGPLKDDWFDPWGQG

SEQ ID NO: 1014702 - protein, 35 aa, Homo sapiens
TAVYYCARVPLLHCSSTSCYYYYYMDVWGKGTTVT

SEQ ID NO: 1014703 - protein, 36 aa, Homo sapiens
TAVYYCAGEVVPRYYDYVWGSYPDAFDIWGQGTMVT

SEQ ID NO: 1014704 - protein, 36 aa, Homo sapiens
GRVLLCEIRSPESSPSHGSGIKVGWFGLVRPLGPGN

SEQ ID NO: 1014705 - protein, 31 aa, Homo sapiens
TAVYYCTARGWELPRRYFDLWGRGTLVTVSP

SEQ ID NO: 1014706 - protein, 30 aa, Homo sapiens
TAVYYCARDSGSGSSWGWFDPWGQGTLVTV

SEQ ID NO: 1014707 - protein, 30 aa, Homo sapiens
TAVYYCAKSPYYYDSSGYWENWGQGTLVTV

SEQ ID NO: 1014708 - protein, 31 aa, Homo sapiens
TAVYYCAIGNYYDSSGYGIDYWGQGTLVTVS

SEQ ID NO: 1014709 - protein, 112 aa, Homo sapiens
ILSGKLSSSVMGEQQKRLANSCISQTKLKAPPTSPLIVIVIYKFDCTMLQTPGTPDWLGEPSCVMVKISLTFWKEAGRCPVFRPFPGLVKLRSAQIGSCDTSIPSPQPNLNL

SEQ ID NO: 1014710 - protein, 74 aa, Homo sapiens
DPNAIFLSFQHLLRGKGLLDCWRQTSLPQPEQLSKLLKWQQGFRAKIPGLLNQTSKTLTKNTRIPEQIHELLNR

SEQ ID NO: 1014711 - protein, 420 aa, Homo sapiens
RRFSFCFSPEPEAEAEAAPGPRPCERLLNRVAALFPVLRPGGFQAHYRDEDGDLVAFSSDEELTMAMSYVKDDIFRIYIKEKKECRRDQRPSCAQEVPRNMVHPNVICDGCNGPVVGTRYKCSVCPDYDLCSACEGKGLHREHGKLAFPSPIGHFSEGFSHSRWLRKLKHGHFGWPAWDMGTPGNWSPRPPQAGDAHPGPATESASGPSEDPSVNFLKNVGESVAAALSPLGIEVDIDVEHGGKRSRLTPTSAGSSSTEEKCSSQPSSCCSDPSKPDRDVEGTAQSLTEQMNKIALESGGQHEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 1014712 - protein, 224 aa, Homo sapiens
SFGTVIQEVKTSNVAREAALGAGFSDKTPAHTVTMACISSNQAMTTAVGLIASGQCDVVVAGGVELMSDVPIRHSRNMRKMMLDLNKAKTLGQRLSLLSKFRLNFLSPELPAVAEFSTNETMGHSADRLAAAFAVSRMEQDEYALRSHSLAKKAQDEGHLSDIVPFKVPGKDTVTKDNGIRPSSLEQMAKLKPAFIRPYGTVTAANSSFLTDGASAMLIMSEDR

SEQ ID NO: 1014713 - protein, 143 aa, Homo sapiens
VKIWRIRDHYPRPVVKFYWVQAEIIAMATDLAEFIGAAIGFKLILGVSLLQGAVLTGIATFLILMLQRRGQKPLEKVIGGLLLFVAAAYIVELIFSQPNLAPGVKGMVIPSLPTSEAVPVQQAVLRGDDGRLILFGTPSLTQH

SEQ ID NO: 1014714 - protein, 97 aa, Homo sapiens
FAGRPYGAYRTFCVPGTNYFCSSHIAITLPLPATADLRLVTGSWKKHPFISESVALAPPQYRGAGGRVNVPHHVAQLSWPGHLPPQKQCAWVILECR

SEQ ID NO: 1014715 - protein, 59 aa, Homo sapiens
GAGHHCGLLDGGEEIRLPSPCGRVPCCSRNLEGAVRPGLGAPCGRRGPQRLGGSGNTVS

SEQ ID NO: 1014716 - protein, 74 aa, Homo sapiens
GFMDRISYQDIGVIPAPTNRIRVDVFINLAIPKIFSYFCRLPLRSTMELCLPFLVKEQNRGPDNAGSPWRIQHE

SEQ ID NO: 1014717 - protein, 38 aa, Homo sapiens
LYLHMNSLRAEDTAIYYCATPFGEVDFWGRGTLVTVST

SEQ ID NO: 1014718 - protein, 45 aa, Homo sapiens
VFLLINSLSPDDTAVYYCARGPFTTDLYGRYFDTWGQGILVTVSS

SEQ ID NO: 1014719 - protein, 57 aa, Homo sapiens
PAPVKDRFVISRDDSKKTVSLQMDSLKIEDTAVYFCATELLPGLDHWGQGALVTVAS

SEQ ID NO: 1014720 - protein, 210 aa, Homo sapiens
HRAFLNLACSLMYYPCIPLYVTRDLFRCISIVHTYWLICHLLSLIYRPLPGWALTWHLATGFELPCAAFRSGPIPLVYTFNHIVNFFPLPSRSCSIVPRASSLWGLHYATRPTVVNSNNCGWSILCLLLVAAANEPRRPKAPRAPYPRVSTITDGRHPRDRGICHLSQKPAMATDLEAASHRCRTLGDLGVCALHATVDLSPSSSTVVSI

SEQ ID NO: 1014721 - protein, 31 aa, Homo sapiens
DLALNYYGSGSPHLQGAFDVWGQGTMVTVSS

SEQ ID NO: 1014722 - protein, 31 aa, Homo sapiens
GHKSPGYYYGSGRYSVHFDPWGQGTLVTVSP

SEQ ID NO: 1014723 - protein, 68 aa, Homo sapiens
FANSNDKDDQVLNCHLAVKVLSPEDGKADIVRAAQDFCQLVAQKQRRPKDLDVDMLVYSVQMVVLILI

SEQ ID NO: 1014724 - protein, 33 aa, Homo sapiens
DARYYCARAWEVRIDHRYFFDLWGQGTLVTVSS

SEQ ID NO: 1014725 - protein, 35 aa, Homo sapiens
TAIYYCASPLYPPKGPIVATTTDYWGQGTLLTVSS

SEQ ID NO: 1014726 - protein, 31 aa, Homo sapiens
MAKAKRGRAVTHDLWGDPRVMSTPSRHSKGA

SEQ ID NO: 1014727 - protein, 133 aa, Homo sapiens
HAASRSQADDMRVEGAFPVTMLPGDGVGPELMHAVKEVFKAASVPVEFQEHHLSEVQNMASEEKLEQVLSSMKENKVAIIGKIHTPMEYKGELASYDMRLRRKLDLFANVIHVKSLPGVQDSTQQSRSRDHSR

SEQ ID NO: 1014728 - protein, 94 aa, Homo sapiens [sequence omitted]

SEQ ID NO: 1014729 - protein, 347 aa, Homo sapiens
RDGERHRETVSCGSLLAQGVDHRGVARWMSVLGSLSCLLYQRLSVTADIVVAVSGCVCHRSVCLTSWRDYIGADPFMAVVWQSRRLYSSSQVAVFRMSRPDAGNRGLYSASFGVAYECVLCISPDGVCVGLTCLRPCVMFSRAVACDSRCVVSVLVRVGWFGYCALFSYAGLLLLASYVRCGVLCDVCAWCYRGGRSNYTLPCAVALCGGAISRVGAAVAGVYLWRRCGLMRITRRVWRSGKAVMRGSLLADTCGRCVGPSFMRCDVVCRRLYCVLSGPAVPVWGCHVLFSPECRFVVVRVSVVSCVVVVVWAGARSWVRVFFSLGVRGEACCGVPWMRSMCLAQGR

SEQ ID NO: 1014730 - protein, 511 aa, Homo sapiens
MASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALARTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALSICPA

SEQ ID NO: 1014731 - protein, 372 aa, Homo sapiens
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQAGAHQGARLALDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 1014732 - protein, 32 aa, Homo sapiens
LSVLLCQQFIPFSERGSTLGLHLRFGDQVNRC

SEQ ID NO: 1014733 - protein, 79 aa, Homo sapiens
APARCDPRSRVVRAPPIFGATRGRPFAEKHNLVVPKKPALGKIIIACWELWLPPRGPPQHTKAQGVFAPPTPRRSGFSH

SEQ ID NO: 1014734 - protein, 32 aa, Homo sapiens
ALYLCASSQDEREGQGYNEKLFFGSGTQLSVL

SEQ ID NO: 1014735 - protein, 30 aa, Homo sapiens
ALYLCASSQLTSGGSSDEQFFGPGTRLTVL

SEQ ID NO: 1014736 - protein, 174 aa, Homo sapiens
HERRGSRSSPSADQQGAQDREEEAATAPAPTSRGHRTEKRKPQQPQRRPAAGTGQRRGSGCSSSANQQGAQDREEEAAKAPVPDQQLSQDREEEAAAAPAPTSSGHRTEKRKRPGPSADQQRAQDREEEAQQPQCRPAAAQDREEEAQQPQRRPAAAQDREEEVRKWKKRVDLS

SEQ ID NO: 1014737 - protein, 133 aa, Homo sapiens
MAGSLAGMVSTIVTYPTDLIKTRLIMQNILEPSYRGLLHAFSTIYQQEGFLALYRGVSLTVVGILATPEPLLFSFPGIPPGIYVLKPVFSQDSSSFSLALFCRCSPVLCWLPSCLHEPGEVLSRSLLAPFLFT

SEQ ID NO: 1014738 - protein, 101 aa, Homo sapiens
TGKTETTKDLAKALAIQCVVFNCSDGLDCKMMGRFFSGLAQSGAWCCFDEFNRIDIEVLSVIAQQLITIRNAKAAKLSRFMFEGREIKLVMTCAAFITMNP

SEQ ID NO: 1014739 - protein, 30 aa, Homo sapiens
LEDSAKYFCALGDALLPWGILPGSDSDKLT

SEQ ID NO: 1014740 - protein, 1171 aa, Homo sapiens [sequence omitted]

SEQ ID NO: 1014741 - protein, 101 aa, Homo sapiens
GAGLLKTSETLSLTCGVYGGTVSGYYWSWIRQPPGRGPELIGEVDQGGNGNYNPSVRGRVSMSLDTSKNQFSLQLTSLTAADSGVYYCARYSDTWHKYVQY

SEQ ID NO: 1014742 - protein, 482 aa, Homo sapiens
AGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVIQPNYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 1014743 - protein, 452 aa, Homo sapiens
MDDIFTQCREGNAVAVRLWLDNTENDLNQGDDHGFSPLHWACREGRSAVVEMLIMRGARINVMNRGDDTPLHLAASHGHRDIVQKLLQYKADINAVNEHGNVPLHYACFWGQDQVAEDLVANGALVSICNKYGEMPVDKAKAPLRELLRERAEKMGQNLNRIPYKDTFWKGTTRTRPRNGTLNKHSGIDFKQLNFLAKLNENHSGELWKGRWQSNDIVVKVLKVRDWSTRKSRDFNEECPRLRIFSHPNVLPVLGACQAPPAPHPTLITHWMPYGSLYNVLHEGTNFVVDQSQAVKFALDMARGMAFLHTLEPLIPRHALNSRSVMIDEDMTARISMADVKFSFQCPGRMYAPAWVAPEALQKKPEDTNRRSADMWSFAVLLWELVTREVPFADLSNMEIGMKVALEGLRPTIPPGISPHVCKLMKICMNEDPAKRSKFDMIVPILEKMQDK

SEQ ID NO: 1014744 - protein, 30 aa, Homo sapiens
ERDEGSYYCACDTEGISSGGIRTWDTRQMF

SEQ ID NO: 1014745 - protein, 32 aa, Homo sapiens
LKTVPLTTVPFQGSSCDGGPLRWWVLDTDKLT

SEQ ID NO: 1014746 - protein, 30 aa, Homo sapiens
LEDSAKYFCALGAFSYLTYLLGDIIPDKLT

SEQ ID NO: 1014747 - protein, 30 aa, Homo sapiens
LEDSAKYFCALGDPPFLILGDTVGATDKLT

SEQ ID NO: 1014748 - protein, 31 aa, Homo sapiens
LEDSAKYFCALGELPRYVRRDWGSKYTDKLT

SEQ ID NO: 1014749 - protein, 31 aa, Homo sapiens
RRFSKVLLCSWVEFREIFVLGDTAVYTDKLT

SEQ ID NO: 1014750 - protein, 33 aa, Homo sapiens
LEDSAKYFCALGEPSPFPTRLLGDGLTAYTDKL

SEQ ID NO: 1014751 - protein, 31 aa, Homo sapiens
TEDSATYYCAFKVLAYKVLHLGWRWCIDKLT

SEQ ID NO: 1014752 - protein, 109 aa, Homo sapiens
QLLQQLGLAFQQVGVIRRARRLPADAVGIVEAQRPGRQHQQPVAQAAGLHRIVGDQQHGVLRQQFGGQALDLGAGNGVQRGKGFVHQHDRLVFVERAGDGGALAHAAGQ

SEQ ID NO: 1014753 - protein, 66 aa, Homo sapiens
QHNPCFYTQHNLCPNNQHNLCSHNEHNFCPYNQHNLHSTDHHILCPYKQHNLGSYHQHNSLPLQPG

SEQ ID NO: 1014754 - protein, 86 aa, Homo sapiens; identical to SEQ ID NO: 884960

SEQ ID NO: 1014755 - protein, 125 aa, Homo sapiens
GCIQPAASSLRKVLLHLLKHPSVTQEVRCDESNRLDTHHYLSQRRQAVDYFILILQGRVEVEIGKEGLKCENGAYTFYGVSALTVTSSAHQSPVSSLQPIRHELEAPPKVTGRIHLCIPYYNEEG

SEQ ID NO: 1014756 - protein, 263 aa, Homo sapiens
MWELRSASFWRAIFAEFFATLFYVFFGLGSSLRWAPGPLHVLQVALAFGLALATLVQTVGHISGAHVNPAVTFAFLVGSQMSLLRAFCYIAAQLLGAVAGAAVLYSVTPPAVRGNLALNTLHAGVSVGQATTVEIFLTLQFVLCIFATYDERRNGRMGSVALAVGFSLTLGHLFGMYYTGAGMNPARSFAPAILTRNFSNHWVYWVGPIIGGGLGSLLYDFLLFPRLKSVSERLSILKGARPSDSNGQPEGTGEPVELNTQAL

SEQ ID NO: 1014757 - protein, 50 aa, Homo sapiens
MSKRFRQSSHLTTHKIIHTGEKPYKCEECKLSTDSFTLLHIREFTLERNP

SEQ ID NO: 1014758 - protein, 339 aa, Homo sapiens
LWGAFFVLYLLLLCLPIWGPFGGFSPALLIGGPHAACLYIWRVPVFFHLALVAATHRVVPHIGRRVSCAPRGAPPPASRPFRGQSPHGGVSHCASPLSPEIVPLGAADLRVWDPNPPLWFIPGKPREEGGYSRPSSPVVSAVGAHRGPPLGPSRPLGEFLEVYQNMVGFDWENSPLHTFSFWCTHGWKGPPQEGPPVGPPPKHLKSVVAFWGMAFLPRVTPSNVFAVSRAHRQSAMVCPPPPVTEMGATPSVHTREASTPHCAPRFSHTPAFPWRSPSPGAPPPQVSLGVPHGVFPPLGCTHRLDAFWSHACVVVFFLGVQGCPTLLLRHSAFTCARLG

SEQ ID NO: 1014759 - protein, 80 aa, Homo sapiens
GRSQLSENGPASYKMSTVHEILCKLSLGGDHSTPPSVYGSDRAYTIDAERDAVNIDTDIKTKGVEVTIDNIVHTPSNQRQ

SEQ ID NO: 1014760 - protein, 149 aa, Homo sapiens
RERYTKIVEIPFNSTNKYQLSIHKNPNTAEPRHLLVMKGAPERILDRCSSILIHGKEQPLDEELKDAFQNAYLELGGLGERVLGFCHLFLPDEQFPEGFQFDTDDVNFPLDNLCFVGLISMIDPPRAAVPDAVGKCRSAGIKVIMVTGD

SEQ ID NO: 1014761 - protein, 139 aa, Homo sapiens
SVGNSRKKFLFSLFPAYLMPVSNTGAQCLQCLCIVRVTLFHFPTNSSSPSETTSAWTLLSISLLTFWSKPFKSLGSSKLSHIFLSSSEPSKPLQPLPVTHFRSCFHIFGYLYSSTPLYWYQLIELVCSHTANKDIPETG

SEQ ID NO: 1014762 - protein, 116 aa, Homo sapiens
GEEEDEGEEEDEEEEEEDDEGPALKRAAEEEDEAAPKREKTENGVSVGPPDNVGLGGLSGSGGGGGGRQVQTLYTWLPALGPSNRDDTLFSLPSPLISVSPDTASTHTLTLLHLLT

SEQ ID NO: 1014763 - protein, 103 aa, Homo sapiens
TARGDYPLEAVRMQHLIARAEAVIYHLQLFEELRRLVPITSDPTEVTAVGDVEASFMCCSGAIIALNKSGRSDHQVDRFRPRSPHHCCAPFNPQDSSIRFYLY

SEQ ID NO: 1014764 - protein, 120 aa, Homo sapiens
PRVRGTRGFLGIKESDPSKLQHNTTICRSDTVMEKRTFRVPLGKGRRCVVGGDVFYEWQRCQGTTQRETYFIYSPQLKTEKSGSIGAADSPENWEKVWQQLEAADNRLLLLTAGPQREEM

SEQ ID NO: 1014765 - protein, 122 aa, Homo sapiens
VYEVYRKGLIDHQTYLELSEQECEWEEITISSSDGVVMSMIIDRRSGRQYDIDDVIAKNLIDRSVLDQYRAGTLSITEFADMLSGNGGGFRSRSSSGGILLLLPHQPRRLQDQLASWSDPLR

SEQ ID NO: 1014766 - protein, 102 aa, Homo sapiens
VGSDELAPCRRVADMGGVDLENAGGVGRGKRQSVSCTGGEDAQDMNSSVRCVTHMDIYVGDNLSLIYEVYEGLGGGGENIKAAICVSLSNIIVGGTIIESSR

SEQ ID NO: 1014767 - protein, 647 aa, Homo sapiens
MRCFVDGKDFIPEGIDIGEPLTDCLKDVDLIPPFNRMLLEVTFGKLYAWAVQNIECLVDASAKFKELGIQAGSLQTITNENHRTELGTIRKPTFLLVMLSMLTLQHSANNLDLLLNSGTLALAQTALRLIGPSCDSVEEDMNASAQGASATVLEETRKETAPVQLPVSGPELAAMMKIGTRVMRGVDWKWGDQDRPPPGLGRVIGELGEDGWIRVQWDTGSTNSYRMGKEGNYDLKLAELPAPAQPSAEDSDTEDDSEAEQTERNIHPTAMMFTSTINLLQTLCLSAGVHAHIMQSEATKTLCGLLQMLVYREQHWCTLGFVQRLALTLKVCGTLSSLQWITLLMEVVDGHAPFTATSLQRQILAVHLLQAVLPSWDKTERARDMKCLMEKLFDFLGSLLTMCSSDCRYSEVGGRLPSLYPGEERCSAITQRWVAISLPCVLVKSRVCHHSEVGGRLPSLYPGEERCSAVTQRWVVASLPCVLAKSRRVPHSEVGGLFPSLCPGEERSVVTQRGVTISLPCDPGEELVQQLLPWFPPQSQKMRRRRVCPQASLTATHSSTLAEEVVALLHTLHYPDQWNGLINKYINSPCRSITHSFAEGLPKGPVRDYFPDSENPEVGGLMAVLAVVGGIDGRLCLGGQVVHDDPA

SEQ ID NO: 1014768 - protein, 102 aa, Homo sapiens
EFRVPRNTIWVIFKNFGASFPKVKERSCAPGQYCMAKEFCDLNFLLHNYWAKKIDIAHIIEGACTIWSPATSRSSTRSGVRYSLFEEGSYFHPLRCHLAVVV

SEQ ID NO: 1014769 - protein, 35 aa, Homo sapiens
DLTTNDDFLEMIPPAVTPKLTLRINVQPQRTESQN

SEQ ID NO: 1014770 - protein, 78 aa, Homo sapiens
MLVAVPGTYPPPCRTREQSTKHKKRPQRTTSNVCAMCAQTQIQEYREAYNMIAQHRDGLIDKEDVHDMLASVEKTPTD

SEQ ID NO: 1014771 - protein, 51 aa, Homo sapiens
MIPHGEIPDTSAHDSEVPYNWLQPAFQDTVSASPLSPCFSEMLCFFANGRF

SEQ ID NO: 1014772 - protein, 80 aa, Homo sapiens
TPLTDRCYLCLMGALQLDLGGAPAGPAGTGKTETTKDLAKALAIQCVVFNCSDGLDYKMMGRFFSGLAQSGAWGCFDEFN

SEQ ID NO: 1014773 - protein, 108 aa, Homo sapiens
FPWDVPRQRELIWLDMYSIWYMWLTRRLQKVLLCRKGIPSSLRDRVWEHLSNSKDLLEQTPGKCDELERSPGDPMLVYVIEKDYTSSSLTGYVCSRGGMKTALYSEAT

SEQ ID NO: 1014774 - protein, 127 aa, Homo sapiens
PSPHPSPCSLPPPHLIQEWHDYKLRWDPADYENVTSIRIPSELIWRPDIVLYNKESSTGPWWAGVARACPCPDRELHQGPAWPSGLCQPHACQPRPRRKKQEKEEAGAMEKLVWVEEGRVPPGQQRG

SEQ ID NO: 1014775 - protein, 77 aa, Homo sapiens
TPLTDRCYLTMTQALEARLGGSPFGPAGTGKTESVKALGHQLGRFVLVFNCDETFDFQAMGRIFVGLCQVGAWGCFD

SEQ ID NO: 1014776 - protein, 94 aa, Homo sapiens
ASSPPSFYCSFPTRMSGDRPPQITGLCPFGPREILVGDEEKRTLRFSHSGEYKTAPPEGCSPWSVAALESGVVFSIAHGLSHTPGDVSGEGLIS

SEQ ID NO: 1014777 - protein, 55 aa, Homo sapiens
PAGTGKTETTKDLAKALAVQCVVFNCSDGLDYLAMGKFFKGLASSGAWGCFDEFN

SEQ ID NO: 1014778 - protein, 37 aa, Homo sapiens
VTPEDTAVYYCARDYFVDSGRFKIDYWGQGTRLTVSS

SEQ ID NO: 1014779 - protein, 82 aa, Homo sapiens
RLEHLTLVCENMAPGAVCSPGESKELGVAQMVWGNNLALRDVEVTCAPSLWRLSGATEMWSGADGLAPGLGAPECGALWRSM

SEQ ID NO: 1014780 - protein, 40 aa, Homo sapiens
SLRGEDTALYYCVRYGFDSTDGYFMAYDLWGQGTLVTVSS

SEQ ID NO: 1014781 - protein, 49 aa, Homo sapiens
AFLQMVSLRTEDTAIYFCTRAPGYYDGSGYSGHDDLDLWGQGTMVTVSS

SEQ ID NO: 1014782 - protein, 34 aa, Homo sapiens
TSVYFCATSLPRGLWGGRTRNEQFFGPGTRLTVL

SEQ ID NO: 1014783 - protein, 30 aa, Homo sapiens
TSVYFCASSPGLAGGPNEQYFGPGTRLTVV

SEQ ID NO: 1014784 - protein, 55 aa, Homo sapiens
RPHEPDLSAALKDTRAQYEKLAAMNMQNAEGFFEEPGFTVLTESAAKNPPCAPPT

SEQ ID NO: 1014785 - protein, 520 aa, Homo sapiens
MEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 1014786 - protein, 55 aa, Homo sapiens
PAGTGKTETVKDLAKSLGKHCVVFNCFEDLDYKIVRKFFFGLVQSGALGCFDEFN

SEQ ID NO: 1014787 - protein, 107 aa, Homo sapiens
GAQATSYDASQKRSRKPTNQVDDGEPQTSTRGLPGSTNYLPLTPMVKLLWRPRMNGVGVRYPSHAPRGSAPGDLTLREERRPPGGRTSIMTHPRSTTTCAGNHRRRR

SEQ ID NO: 1014788 - protein, 344 aa, Homo sapiens
SGVVFVVLNGGPPVVSHTVVALVVRVGVPVVCPAFPGGCKCIVAAVQGDVLGGVHRAAASQGFFFCLVEGGDGSYLVCHPSCVAGYFPREVWGGTTPGGWFPGVLFVNQQRYPADGGGVVGGPRVAASVVGGPPPSWGCPFLVSPADAPRRVMHSAPPCGAPPRTRTRLSAGCVRPTPHAPLCVGELSPSLWRVCCNTGAPHSVCESCVGRHTDRRAREESVSTALSLSLDEHTTGRVCVCVHTALVCLCVCGRHTAHDDSSVRVAAHSHCVRAHPPHSHTERERRERERESVWGLLERRPPLRDATHVCAHTERGVTHTLVSLSVSLCCVVSLSLCPTRVSLV

SEQ ID NO: 1014789 - protein, 101 aa, Homo sapiens
QRICVVLGAWITRAAFISGKVDIVDITDPHIDHIYMVYMFQYDSTHEIFDTDRGENGLDINGNPTPSRRDILQHHVARCCAEYVVESLCLTHERCAHGGGA

SEQ ID NO: 1014790 - protein, 46 aa, Homo sapiens
TKLKRKRRQISRSSQKTKNHSCSSRSSRSRRANGHRLSRRIEIEVG

SEQ ID NO: 1014791 - protein, 33 aa, Homo sapiens
DRSEVTSLYWYEARVTVSHYSQSTNIVTLIRTP

SEQ ID NO: 1014792 - protein, 79 aa, Homo sapiens
KRHLLQDDAWFCNWISVQGPGANGDEFRFPCYRWVEGDRILSLPEGTARTVVDDPQGLFKKHREEELAERRKLYRWGNW

SEQ ID NO: 1014793 - protein, 36 aa, Homo sapiens
AEGVENGEATAGEGNPLVTSSATSLRLVAGVSARSQ

SEQ ID NO: 1014794 - protein, 39 aa, Homo sapiens
RYTHMLTTLECTHVPRTQYFLTESSSPPGPGPSMILKSA

SEQ ID NO: 1014795 - protein, 146 aa, Homo sapiens
NWVRQRPNIAVWDGKLEVTSGMWQGCEVQEDCLARITQSVSFPTFLAIDSRATMWEGRPTKTVPCEPSLKFRFKMPRQFWKSGGRDEMNGCSVEDEDFGKAPETPRSMGLPGDDHMAYQHRERFIVVRGPRWAHLRQAFLGRNGAE

SEQ ID NO: 1014796 - protein, 66 aa, Homo sapiens
GWLGVVGLRGCHGARGQVCSASVQGSGRPDNGLALLVAAAAGAGALAARAAGVGAGRYCISYHCLQ

SEQ ID NO: 1014797 - protein, 100 aa, Homo sapiens
MWKFPGGLSEPGEDIGDTAVREVFEETGVKSEFRSLLSIRQQHRSPGRFGMSDMYLICRLQPRSFTINFCQQECLKCEWMDLESLARTKHTTPITSRVAR

SEQ ID NO: 1014798 - protein, 444 aa, Homo sapiens [sequence omitted]

SEQ ID NO: 1014799 - protein, 50 aa, Homo sapiens
PDELVAWEGCGSLVPLPMLSSSNSNNLLVALPPPQPRGIKPGTRGRGRTK

SEQ ID NO: 1014800 - protein, 75 aa, Homo sapiens
PEIPVCEKGCQPPPGLHHGHHTGGNTVFFVSGMTVDYTCDPGYLLVGNKSIHCMPSGNWSPSAPRCEETCQHVRQ

SEQ ID NO: 1014801 - protein, 331 aa, Homo sapiens
RLRANIDPTLFLIRTFSNVISSIVFGDRFDYKDRELLSLFRIMLVIVPVHVNSTGQLYEMFSSVMKQLPGPQQQAFQLLQGLEDFIAKKVEHNTPLDPNSPRDFIDSFLIRMQEEEKNPNTEFYLEKLVMTSLNLFIGGTETVSTTLRYGFLLLIKHPGVEAKVHEEIDRVIGKNRQPKFEDRAKMPYMEAMIHEIQRFGDVIPMIWPGRVKKDTKFRDFFLPKGTEVYPMLGSVLRDPIFLSKPQDFNPQHFTELEGAPKKSDAFVPFSIGQPNCFGEGLARMELFLFFTTVMQNFRLKSSQSPKDIDVSPKHVGFPRFPRNYTMSFLPR

SEQ ID NO: 1014802 - protein, 37 aa, Homo sapiens
MVVKVHSITKKTGPQCRGGGDVQASPTPSGAQGIPFT

SEQ ID NO: 1014803 - protein, 33 aa, Homo sapiens
ILELAGNGARNNKKTRIIPRNLQLAIRNGGTEQ

SEQ ID NO: 1014804 - protein, 39 aa, Homo sapiens
MRGHYLDIEKHVDRAALKTHAGLPLTYSCSNFLTDPHIQ

SEQ ID NO: 1014805 - protein, 100 aa, Homo sapiens
GKTETTKDLDRPLGTMVYVFNCSEQMDYKSCGNIYKGLAQTGAWGCFDEFNRISVEVLYVIAVQVKCVQDAIRAKKKKFNFLGEIISLVPTVGIFITMNP

SEQ ID NO: 1014806 - protein, 101 aa, Homo sapiens
GKTESTKDLGRAIGIMVYVFNCSEQMDYQSCGNIYKGLAQTGAWACFDEFNRITVEVLSVVAVQVKSVQDAIRDKKDTFNFMGEIISCVPTVGIFITMNPG

SEQ ID NO: 1014807 - protein, 101 aa, Homo sapiens
ARRKRQRTWGKALAIQTVVFNCSDLLDFMAMGKFFKGLASAGAWACFDEFNRIDIEVLSVVAQQITTIQKAQQQRVERFMFEGVEIPLVPSYAVFITMNPG

SEQ ID NO: 1014808 - protein, 33 aa, Homo sapiens
GVSTWALPVFLISHKSSNKLRIHLIKQAWCLGD

SEQ ID NO: 1014809 - protein, 236 aa, Homo sapiens
DFVWTRGAVLLEHRFEHVEMWNSLFGYDVSFSVETHGYDLLTEILTFLIDHSLKSGNEWWSQDHRGVWTHITLFNIHQLMNKVSEDHDFSHYRKKWSQCQKHPMDMEFVFELKRDLVENSAVAHEYVSEVEKHSSQTDFAKFLGVSTELRFDIADKLSVGFDYKVEVEKLTSHKDFSRGFGGRYVVEKDKWDKAALGYDYKGETQKHESQRDYAKGFGGQYGIQKDRVDKSAVGFN

SEQ ID NO: 1014810 - protein, 42 aa, Homo sapiens
DPQEQVPPDLRMAAIRRPSGILRSEACDGEEEAVPNQELLEA

SEQ ID NO: 1014811 - protein, 84 aa, Homo sapiens
MYKNVVTYRGAKVYVLGAIRWGLEGLIFILIFLIEYHDPFQFIHTTPSSVPCFAMSQVYCPPQCICRLDWLHDIYYTTIHHRLL

SEQ ID NO: 1014812 - protein, 295 aa, Homo sapiens
SFQKIKKMKNILLLILCVFLAKSQGVKKMRRVSSVHVVIEPLRKKREEAPRLRTAPTPISGGGYRARPAKEAANQKKVEKKAPDAGGCLHAEPDLGVLCPKGCELQEALLKKERQRRNSVDELKKKVEDVSQKSSSSFQKMYLLKELWKKRKKKVKEKEKVVNEYSSEMEKNKLKKDENVKRKIPNKLRVLRSILENLRSKIQKLESDVSAQMEYCRTPWTVSCNIPVVSGKECEEIIRKGGETSEMYLIQPDSSVKPYRVYCDMNTENGGWTVIQNRQDGSVDFGRKWDPYKQG

SEQ ID NO: 1014813 - protein, 181 aa, Homo sapiens
MLEAVFTLTQTWGCCVLEDVSCKRLCYEQERPMRNSVDELNAKVEGVSQTSSSSFEEMYLVEEVWEKRQKQVKDNENVVNEYSSELEKHQLYIDETVNSNIPTNLRVLRSILENLRSKIQKLESDVSAQMEYCRTPCTVSCNIPVVSGKECEEIIRKGGEDLKCISFNLTVLSNRIEYTVT

SEQ ID NO: 1014814 - protein, 273 aa, Homo sapiens
MYEKEREKEAPSRRPAPAPSSGGGYRGSLQPKKLALKKKKKKKKLKLVGCLQADPKVGVLCPKGCQLQPGLVQKERPKKSVEGGERRRREELRERFSYYSLVNVFAERTVEKKAEEVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATTQMGKILWPT

SEQ ID NO: 1014815 - protein, 144 aa, Homo sapiens
MMYERKFQEHNVQGCCHQKSNLRIGGYCCGEAGLVFILIFLIVFHDPFLFIHYYTIICAMFWDVPGVLCTPVVSAVGVGCVSFIPPSTTVFFALFSGCCGPAVIVSVIRAGEHAVVNGHGPVLVHQLGCSIHEGITGCSSVFVH

SEQ ID NO: 1014816 - protein, 40 aa, Homo sapiens
CRAPPSSVSVPSYRSRALLASLSASHDPPYASFTLLPVPS

SEQ ID NO: 1014817 - protein, 66 aa, Homo sapiens
AMGWDPGNSAIMAGKEDEFEDQAFFPTELVPIPYNFGSSEWDTILDHKVMGIFFNPEYSFKTLRQT

SEQ ID NO: 1014818 - protein, 78 aa, Homo sapiens
QFQFIQVAGRSGDKIFIGNVNNSGLKINLFDTPLETQYVRLEPIICHRGCTLRFELLGCELSGCTEPLGLKDNTIPNK

SEQ ID NO: 1014819 - protein, 39 aa, Homo sapiens
TRSRTYLLLRAFEKDRFTGIATREELARETGTPESRIQI

SEQ ID NO: 1014820 - protein, 104 aa, Homo sapiens
MRKRVCALMITGSWMIGSINSCAHTVYALRIPYCKSRAINHFFCDVPAMLTLACTDTWVYECTVFLSTTIFLVFPFICIACSYGRILLAVYHMHSAEGRKKAYS

SEQ ID NO: 1014821 - protein, 111 aa, Homo sapiens
ICNPLRYPIIMSRHVCVQMAAISWVTGCLTALLVTSCALQIPLCGNVIDHFTCEILAVLKLACVSSLLVDMVMLVVSILLLPIPMLLICISYGFILSTILRIGSTEGRNKA

SEQ ID NO: 1014822 - protein, 165 aa, Homo sapiens [sequence omitted]

SEQ ID NO: 1014823 - protein, 35 aa, Homo sapiens
NSVTVADTAVYYCARGKYGEGTRRWGQGTLVTVSS

SEQ ID NO: 1014824 - protein, 30 aa, Homo sapiens
NSVTAADTAVYYCVSGYYFWGQGTLVTVSS

SEQ ID NO: 1014825 - protein, 56 aa, Homo sapiens
YKCEECGKSFILSSHLTTHKIIHTGEKPYKCKECGKAFNQSSTLMKHKIIHTGEKP

SEQ ID NO: 1014826 - protein, 59 aa, Homo sapiens [sequence omitted]

SEQ ID NO: 1014827 - protein, 33 aa, Homo sapiens
VVSEIPGKGGAGVWNCRGPWSAAAFFVYIRRSS

SEQ ID NO: 1014828 - protein, 142 aa, Homo sapiens
VFCLCIACSLSVRSRCDLLGGCLVCFASFHKLASTIVDMHSGSAIGGPLPPFGGFSARGVGYSLNMARSLSTFKCVPPRSLCWRTAPPYCLVPAPYEQFPRLPGARAKNPCGCFSHFPARWFSFPPIRVLVEPLWSRAFYRE

SEQ ID NO: 1014829 - protein, 94 aa, Homo sapiens
NENRMEESKALFRTIITYPWFQHSSVILFLNKKDLLEDKILHSHLVDYFPEFDGPQRDAQAAREFILKMFVDLNPDSDKIIYSHFTCATDTENI

SEQ ID NO: 1014830 - protein, 242 aa, Homo sapiens
MSGAPRCPTCAWGDPGPVSFSGVRSTPLYPTFHVLRFSGQNISPGLFGSFLARPDGFFIPATYYVAFFLCMTDPFSWVPRDLLLKEETNRFWVSTSLVCPRSSHLISPDIKYRALFLLRNPKGGYPPALFFVNNEEGSVLLPPRSGHTRHFYISAAKQICARVIIDLYYATEAHHSGVHSSCVRLIPLTAACVVLPGVNTYFSAPDGERQRTRGCDAHTSRRSQHLSPRQGSPFVHHHDMPR

SEQ ID NO: 1014831 - protein, 180 aa, Homo sapiens
IAPVFVLMEQITLKKMRKIVGWSNKDGDGIFSPGGAISNMYSIMAARYKYFPEVKTKGMAAVPKLVLFTSEHSHYSIKKAGAALGFGTDNVILIKCNERGKIIPADLEAKILDAKQKGYVPLYVNATAGTTVYGAFDPIQEIADICEKYNLWLHVDAAWGGGLLMSRKHRHKLSGIERAN

SEQ ID NO: 1014832 - protein, 104 aa, Homo sapiens
FVFTSFTSFLALLVLASFFLSATFFVSPFPFVSSVSCLAVLVVLPLSLVFLSSGRLYVFFVTSVSAFALDFLFLSRLFSALVFPVCPLLCVSSSLWLYFLLRCF

SEQ ID NO: 1014833 - protein, 119 aa, Homo sapiens
MRAKRTTTLLAVAKFVVTPGKELEKVAVEGNASPSVKGGGVGVAVEVRGDHLGPSVAQDALEGAPDACFTTFLMSSDLAGFSRRQGRPTTETLAVGTRKAMPVSFPFSSGMTFPTALAA

SEQ ID NO: 1014834 - protein, 225 aa, Homo sapiens
HSEPLRERPVPAAPACLALPGLLGAGWGACRPALYGPSLCAPPSLRGSAEDGGRSGSCTRLPRAQPPLRWQPAGSSEQEAQGGWSVGPGLGERHHGPRPRAIWTASASAFEVVGGLFVRQAALALGLEVVFTALMPLNLFPGDPGSIRPGPEPGCQASRVIKGGLGPFIEVEPETGECSASAAPPAGQAGREVGPAGHDHRVGKPEDGKERALRAPVRGPWLRPF

SEQ ID NO: 1014835 - protein, 86 aa, Homo sapiens
FFPPRGGWPFSPPCPPGVWALWPPPPPGAQGGGGGPPWGGGGSPPFPPPPGGSPPPACAFAPLGGGGALGPPPPFFPPQNTPFSPP

SEQ ID NO: 1014836 - protein, 103 aa, Homo sapiens
PRAPTGCEAAEVAGGGQAAAGAAMRGEAVAGAGTVRTEGALAASAELRGAAQHPATLADSPAPSRVGQPDDRPESLGFGNETDGHKSAIYLELTMCQSHTLSH

SEQ ID NO: 1014837 - protein, 1134 aa, Homo sapiens
AQFFRFDGWLINIENSLSLAAVGNMPPFLRYLTTQLHRQVPGGLVLWYDSVVQSGQLKWQDELNQHNRVFFDSCDGFFTNYNWREEHLERMLGQAGERRADVYVGVDVFARGNVVGGRFDTDKVGGGFRPRASGPVPPLGPHFLMDLPFPSAPQRNDSSCSSQSGDPVALRNRCPAPAKLCPQLKPLSRLFLQSDNVFLCGCYQTEARRSPAVRSSAGLGLLSQLRSLIFPVREACGEHRGLQRLSLRLRGEDGGGAQGLGIGRCHDEGAFSGKAGHTSTEEGAGPGRCPWRGMRRALPASGLSVLPVPRAPGMFSALNLALNEEINPKLKSLFTARDSDNRMRGVPEDNGTAQPQPVGAQPLPPCPCSSADRLSRALFWRACGTTGVMPSSLQSLELIRKHGFSVALFAPGWVYECLEKKDFFQNQDKFWGRLERYLPTHSICSLPFVTSFCLGMGARRVCYGQEEAVGPWYHLSAQEIQPLFGEHRLGGDGRGWVRTHCCLEDAWHGGSSLLVRGVIPPEVGNVAVRLFSLQAPVPPKIYLSMVYKLEGPTDVTVALELTTGDAGSCHIGGISVLNETSSRHSLRPLRVPPTKLARWVGRCGRQLSGGWVQHCYEVSLRGCLLLDLLVCFSRPPGSREEESFTCRLGEIQVVDAASLLAPLPQVQAVTISHIRWQPSASEREGPPALLQLSCTLHWSFLLSQVRCFRIHCWGGMSDDSPGRELPRPEMPMFLGLAFATQYRIVDLLVEAAGPGQDRRMEFLVEPVPKEGFRVPQAEWGRAVLLYSAPAGADAKAGWSPGLGLRPLPGCLPLACAGPAKCPQWQRGPGPGAGVGDPGLSAVAFWWGAMETGNQAVGSQRWSLRGEWRAFCFCLVPPHGTWFPGENERRGEVENRTFHKGYFLIGCKMLMPRMMIFFPADETIRKGLRLWQVGFGAGAETFLSMRTSYSSSWGGAACGMAGEDALENRPPSVEGPFPWGVGILGQPALASCLHVGQPQLLRVSWRWQFTVLLSVRSSPERFQQPLALRRLFRAVGMQGSGSEAVCAVALPLPSERPWALDKPPFRLGEQVSPGRKQHLPPAPAQPQPECRSCRTRGGFSSYSVPSRPPFSASSKHREDLQADPLSSSQHRCVGA

SEQ ID NO: 1014838 - protein, 217 aa, Homo sapiens
AAHHVAGVAVAVHADVLVRGLGVDLLHPFEQVAGHGFVGRQQAAGNEVAFQQGGQRVFAEVLHTEGFAVFERTGGAHGVQAAEQLSEAIELVEIARFRGPAATPGEQGEAKTGVFEQAFAVVDHRRDDRDVAVGQFEGEAVFFEDGLVGPALRAVELGDQGFAVFDAHLIDTVFVAVERQDPGVTEKADAFHGVEHQVGGECFKRVGHADSCGRQAA

SEQ ID NO: 1014839 - protein, 114 aa, Homo sapiens
HSVLFSCCSPLRVFLALLLVVCFVFVLLVVVSQSGFRVFVWLPRFLPLQGGGFFKGPKGIYSCPPFVVPPVVRTVWYPLVVVCPSSPVFSPFPLCAPPFLHPLARSSRDTLVFL

SEQ ID NO: 1014840 - protein, 231 aa, Homo sapiens
QLSGGDPGFAPPSVPPRLLPPTGLPTLAKVTSTLGILEGLRTTVHAIISTHKTVDGPPGKLWRDAPGSPDIIPASTGAPQAVGPRSSLTDGKLTGMTFRVPPAHVSVVDLTCRLETCPNDDLQKVVNRRLEGPLQGILGYPEPPVVSSDFTATPPPPPLTLGLALPYDPFVKLISWYDHEFGYRHRVVDLTGPPGLPGVRPLDPPPPPRAPEEERDPHCWGVPATLSPPPH

SEQ ID NO: 1014841 - protein, 383 aa, Homo sapiens
LSVQSRGYKCGYEYVLFNETRFSSTLRTTSGCDNVSYIVDSTPMGKMPVGTGKGCRTGKLVNRTGISHHHLPGAEIPPKSSGAMLALSYVGGGPLAIFTTMEKAVGIILQGGAIKESSISDPLVLMPPVFVMGVNHEKVMTTAVKIISNASCTNQAGLAPRGQGHRMDNFGIVEGLMSTDQCHHCTPRRRVDGPVRETVAVMAAGLYQNIIPGSTGSCQGVVGKGHALSCNGKLTWHGLPCPNGDVSVVDCLATRKTGPYDDIQNVREQAIRKAPKGYGEQHWHQGEQLNSTGSPVPHIERGAGKPQRQHGGPKYRREHNNVRNRRGGQAAQFTDKPGNAKRNRRTRRADDTHNHDCDKQRRPLPQTRRLDREKSYEQQIKRR

SEQ ID NO: 1014842 - protein, 275 aa, Homo sapiens
SVYIGLHVPRMIPPIGKFHGSVKAENGEAVIDGDPITIFQERDPSNHHRWQAMTEADDTSWMLHCGVFTHHGRRLVASFCMGGDAQHTGSVSLSDSTVCMTCPPSDVVSTGGVQSRWKDTLIGRNKAVQSNRVECKWLVFVENPKQNMGSKKNPRVSRPQGSHTPSREQHTFFEGKFQVEATRVHVLNLTPSTKVRRNLAAKITERLSPKAPKEKLIPITHLCHTFSLFGRAATSFGPKKGGPLWFGGCPHHPWVVEIGVHRWVREPLGKSPGCA

SEQ ID NO: 1014843 - protein, 237 aa, Homo sapiens
MSRERGWQPSLPSLWQQVPSRCPHRLLMLIFSPRALKVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 1014844 - protein, 197 aa, Homo sapiens
MAPKKPEPKKEAAKPMNVKMLDFETFLPILAPAPAPAPAPAPAPAQHISRNKEQGTYEDFPEAPKEPAFDPKSVKVEGLRVFDKESNGTVIDFTADQIEEFKEAFMGAELRHVLATLGEKSLFDRTPTGEMKITYMTEAEVEQLLAGQEDGQCGDVLRALGQNPTANGCINYEAFVKHIMNAEVLRVLGKPKPEESG

SEQ ID NO: 1014845 - protein, 38 aa, Homo sapiens
WRTSTRNISSEEKASWTRPEKQETLDGHMVVRSHARVS

SEQ ID NO: 1014846 - protein, 161 aa, Homo sapiens [sequence omitted]

SEQ ID NO: 1014847 - protein, 39 aa, Homo sapiens
TYEQLVALENKFKATRYLSVCERLNLAVSLSLTETQVKI

SEQ ID NO: 1014848 - protein, 184 aa, Homo sapiens; identical to SEQ ID NO: 843745

SEQ ID NO: 1014849 - protein, 338 aa, Homo sapiens
EFRKTLETDTVTGKSGEKIDYSTTPRIDEWRDKGYRLVEDGFAEAGTPVYDDNDDVEQIFIVKLDHDTAPVGPNDPHEPETPINPNDPNGPKWPAKDSYTKQYTSTVHFVDENGNKLHDYNVQTSNWTRTLIVDKATGEILNPDEAWHSDIDKYSDVKVDPIKGYYTDRNSVPGEVAQQQDIVNTVVYKQIGKIVPVDPSGNPIPDAPTPQYRNNPNDPTKVIVTNTPEIPGMTPEVPSVTPENPGEDTPIVYNKVETPTPKTVDVTPETPKTVDVTSETPKATPVKTAPQVEKVKAPELPQTGEKQNKALTAVGASIMTGLLGILAFAKKKKDDKEI

SEQ ID NO: 1014850 - protein, 271 aa, Homo sapiens
LFGLCLFCVVVVGCAVSCLRIRLVLSFVVSFCCVCLCLVGVSVFGCAVGLFGLRVLCCGLGGVVGAVWVWVVLVWCVWFCLWLCAVCSGVSAAACAARWVLCVCGRRSPAGGAVSAPPKRGVRIFSTRLGGRPPSFIVCGGVGPNIGHTQFGSRGSCCKRVGNATRWYGSGGYFVRGEKVNSPPPPRTSVVGVDAQTCCNNAPSKCLFCGLIRNSAAPRGPTKVETVYSSTTGLRHQKKRGVEATEKRHIVVCVVRKYLLRGGNSTDERRL

SEQ ID NO: 1014851 - protein, 34 aa, Homo sapiens
HSDLKPENSLCQHPNQVSPVKICDFGLGNRLHGT

SEQ ID NO: 1014852 - protein, 46 aa, Homo sapiens
KLGDFGSASHVADNDITPYLVSRFYRAPEIIIGKSYDYGIDMWSIG

SEQ ID NO: 1014853 - protein, 1124 aa, Homo sapiens
MAPESHILASNTMETHILASNTMDSQMLASNTMDSQMLASNTMDSQMLASSTMDSQMLATSSMDSQMLASNTMDSQMLASNTMDSQMLASSTMDSQMLATSSMDSQMLATSSMDSQMLATSTMDSQMLATSSMDSQMLATSSMDSQMLATSSMDSQMLATSSMDSQMLATSTMDSQMLATSTMDSQMLATSSMDSQMLASGTMDSQMLASGTMDAQMLASGTMDAQMLASSTQDSAMLGSKSPDPYRLAQDPYRLAQDPYRLGHDPYRLGHDAYRLGQDPYRLGHDPYRLTPDPYRMSPRPYRIAPRSYRIAPRPYRLAPRPLMLASRRSMMMSYAAERSMMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSLPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDSVTIPVPVVSALEPSVPVLEPAVSVLQPSMIVSEPSVSVQESTVTVSEPAVTVSEQTQVIPTEVAIESTPMILESSIMSSHVMKGINLSSGDQILAPEIGMQEIALHSGEEPHAEEHLKGDFYESEHGINIDLNINSHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVIISTSPSGGSEADIEGPLPAKDIHLDLPSNNNLVSKDTEEPLPVKESDQTIAALLSPKESSGGEKEVPPPPKETLPDSGFSANIEDINEADLVRPLLPKDMERLTSLRAGIEGPLLASDVGRDRSAASPVVSSMPERASESSSEEKDDYE

SEQ ID NO: 1014854 - protein, 54 aa, Homo sapiens
SRGQRRKMAQENPKMHNSEISKRLGAEWKLLTDAEKRPFIDEAKRLRAVHMKDY

SEQ ID NO: 1014855 - protein, 50 aa, Homo sapiens
MSSKDGLSEKSIGGSRARGVNSPEPSEKIPLWTEERGGLWKWWKIRSYRY

SEQ ID NO: 1014856 - protein, 40 aa, Homo sapiens
LFSADLAASIVIGLMRLQPRPGLQFSSRAQRCTGQRSYRY

SEQ ID NO: 1014857 - protein, 40 aa, Homo sapiens
CFCLLIRTAAAEELHHGVWTEVDSPCRNIKRECIRPNPFP

SEQ ID NO: 1014858 - protein, 377 aa, Homo sapiens
EFLGIVKGDDDSARGIVAQNMTTAEIETFGSDAVIMATGGPGIIFGKTTNSMINTGSAASIVYQQGAIYANGEFIQIHPTAIPGDDKLRLMSESARGEGGRIWTYKDGKPWYFLEEKYPDYGNLVPRDMPTREIFDVCINQKLGINGENMVYLDLSHKDPHELDVKLGGIIEIYEKFTGDDPRKVPMKIFPAVHYSMGGLYVDYDQMTNIKGLFAAGECDFSQHGGNRLGANSLLSAIYGGTVAGPNAIDYISNIDRSYTDMDESIFEKRKAEEQERFDKLLAMRGTENAYKLHRELGEIMTANVTVVRENEKLLETDKKIVELMKRYEDIDMEDTQTWSNQAVFFTRQLWNMLVLARVITIGAYNRNESRAAHYKP

SEQ ID NO: 1014859 - protein, 172 aa, Homo sapiens
MGTTKRCLGQPPEKKSANGARVWVHPGGSPGESSPPPGGINYRVVGDPHNVRFSRGGHNMLPLFAVLFPPANIPAGVFPTSREDTSHGPALLCFNTQLGAPRRPVRVFRSPLPSLRHGIVSKTGLGIYSPEEGGPPPGRGGEKISRVGTTPFLAPHWAAPTKRSSPAPLGVL

SEQ ID NO: 1014860 - protein, 157 aa, Homo sapiens
ICHPLDYPVIMNPCFCGFLVLLSFFLSLLDSQLHNWIALQITCFKDVEIPNFFCDPSQHPTLACCDTFTNDIVMYFLAAIFGFLPISGTFSSYYKIVSSILRVSSSSGKYKAFSTCGSHLSVVCLFYGTGFGGDLSSDMSSYPRKGAVASVMYTVVT

SEQ ID NO: 1014861 - protein, 210 aa, Homo sapiens
SEEAHRGNILFGRPGSGLSDPRAPPPSAEVDPHEIQVVYLRAPGGEIGAKFCLAPQIGPPGLSPKKVGDDHAQATGDWKGLRITSEKLTLQTDRPQIEVVPSASALIIQALKGPTQRPERNQKNHETPVGIITFDEIVNHCSTDAAPILSPRNSLGHLKEDPGGCPDQMGCNVDGPHPHDIIDDINRWCFGKPQTQFSPKGNISNKGSFD

SEQ ID NO: 1014862 - protein, 64 aa, Homo sapiens
PQLLAWTDAGNWVRELQEEPDRLLAGSPQVLKGTSLEKGSWDVAKCEARFGILTVPGYKFLATL

SEQ ID NO: 1014863 - protein, 50 aa, Homo sapiens
GQHLGTLGCWTNFFQHVRTDGRGPSQALEGSSPRGTVGGLRKHHIKVLRL

SEQ ID NO: 1014864 - protein, 109 aa, Homo sapiens
FFLIKKKKKERKKIPHLLKSLSLENFWFPADWMSFCCGCVLSVYFNGFISLSSVIDFKTEQKHKQTSLNHCPKTQEAQQREPPENCSQSSSPKEAWGHCKPQKQALHQN

SEQ ID NO: 1014865 - protein, 109 aa, Homo sapiens
MRPVMYLGDVRIIRPQNALVSSVGLYYVVLTHDAPYICCKVTTPQPLVVFCSHPRFKKPLTGTQIGALSDTGEKSHFGDERQKTLLAEWRAPCEIGAAVCTIDGKTCPL

SEQ ID NO: 1014866 - protein, 201 aa, Homo sapiens
IFLYNKFIFKFFIFLCLCDMFRCLQLLVVYIKVEIDMEKSSPTPSGTGKMTVVRKHRLACGTGVTVDTGVGCFFTSSHYANRDAETFRCLCRKRCQRLLKSQRGGVKKSCISVPHKTAVSGFSSCERNIRALGTVAGRSLRVAPSFSTWALPPTHHSDHSPDDHNCQDSQSHNAHDGDGGLGRWLPSQGEGLRQRLMLYMA

SEQ ID NO: 1014867 - protein, 146 aa, Homo sapiens
SRPMRRAESVSTPPTEVVQKSRINMRGCPPRKSCKSRCPHNSCPLAPPQDSGPPLGSLFSPTKKDLWWNDTLATRATPGVRLARRAPLRASYPRGEARGPPFTDSRATAPRSFERVVALFLGPLSPLEFTPSMAPLSRDLPTRTTE

SEQ ID NO: 1014868 - protein, 68 aa, Homo sapiens
YRDIAGVRKKGVGIRTVFRKTRNPIGRGTVGRRSSHDPWGPQMNFYGNCKAAFLRTHKILRGPHALSR

SEQ ID NO: 1014869 - protein, 1062 aa, Homo sapiens
MESNFKKIALTACSLVNKVFGDFVIESLFCQVASLSCNKLLVCVLYLRYLIKSKELKMIDRNLASWMVYTSTYRDVIFGGYELHWLYKASLCICVTFCIFRELLSHIFGITILLLKSELELWNRIVKTILKSMWYLIGYYSQLISLIEKSQRDFESGMYECDTCLPLPVLPYAVYAKPERVLKYTLVSALRCLDFPGVYPPVLICLRILRMSISINCNISFHVMRKNKDFFEIVNLSGFNFGVGKGYTKIKDELLSILIPEVFFLSGKRYFGDKVRFVEELQERGLEYPLSTVNILCNPSTFNRTEEINIDKILLMKDFIWISLVFLLMSFFCSRIQSKMPHCMESPDLCQFLSFLLSFVTMTLDLFGFDVKDETEVTDFWGKNTTEITLITSDWGSIIYNWLNLTDDLVQVVSVQVSVFFPFRYYSLDASHQVQLTLKERGELGSTFQREENVNLWKYIKATVIILGEMLRSHGNKVPLLNFSILMDLVCSYYYFGVLMVIFFIFLIPSTVEIFCEEDLCILHVFSFFHLYHYETTDINFILWVVIHNYPCCCLLIFDYYLFYIFIKYRPGCLTLLGSSNPLVLASQSAGITGVSHCAGHSLFCCSCCSSFFFFFWLLSPFDTSLSYLFFKSMFFLSLITRYFRLILHFACLRSRINHFSKEASGRIVKEVTGGKCEEFGKMIDSRPSDVDTFLALSTDVGFCIHVTPVLKFVSKFPRFREPDIKCLNTGHNPEKFDKNLIYSQVSTHKHLLFFLGVFDNFFKVKRPLKYYQYSELTFDILHCPLRLLFFYTGFHSLPSRDLFHIFPGCFIDGEFLKIALLSIIDNKLHVFKMYCLIISDTFCNPSFSKELRQQRGLLEPRCLSCSCSDLWSCYALQPGRHRRLLKEGIPMKTITTIKIVNLSITPKSFLMSLFPLSCLFLLPFSLQEILDLFITVDYFAFFENFFVNTLCSFFNCSVLVCCVGISQFFGLPVGGHGKTAKAVCFQLFDCYKIKLLNFVYKSLYGYTPLFLLGKCLIGECLDHVVDVCLTFKETPCFPQWLYHFTLPPAMFGGFQFCQYVG

SEQ ID NO: 1014870 - protein, 196 aa, Homo sapiens
QHVPFSVLFSPVYSGFLIFRTHHTNLAHSNTHCSRPRKVFVTPPNRRDSHKDSRYKHPCMRVAPHRERVGKYSRGPHTFLGPTLLPPPKILGPPTGVLFSPPIKNILVDRTIAHQGPHGCDFGKGASEEFTTWRYLTPFQAPYTTAPQILKVGGLLALLPWIHPKRLTREPTPEHQKIVTPGETPFEHTTMGIITI

SEQ ID NO: 1014871 - protein, 108 aa, Homo sapiens
MVADFPLLTCAVLFPELTRIVFVGLPARYGVSIRPLLGIGRPPVLLCLLSLPLCGTSSSRPLALSLWDGAIHSPPPPCLLDEHSYSFRLPTRSMAHRIYSVYKDRLEQ

SEQ ID NO: 1014872 - protein, 110 aa, Homo sapiens
EGVSLLSPRLECNGAGSAHCNLCLPRVQGILLPQPPEELGLQAPATHPANFLFPVEMGFHHVGQAGFELLTSVDLPASASQSAGITGVSHWHTALSAFSNGPVWMGFTLI

SEQ ID NO: 1014873 - protein, 70 aa, Homo sapiens
MRHAESLRPERLSGDPYKKILGTAPSVGCNVDGPPPHDIIDDIHRGAVDAPPSYSPKGNLSIKDQFDHWW

SEQ ID NO: 1014874 - protein, 31 aa, Homo sapiens
MLVMAPRTVLLLLSGPWLTETWAGSHSMRYF

SEQ ID NO: 1014875 - protein, 69 aa, Homo sapiens
LRLQGAMFTPLHYSQGDNKNLSRREPRGRSCSEPRSCHCTPPAWVTEQDSSQKKVYYSALIISFRFWVK

SEQ ID NO: 1014876 - protein, 597 aa, Homo sapiens [sequence omitted]

SEQ ID NO: 1014877 - protein, 67 aa, Homo sapiens
TWGTEHREPAFPFQPGSITEVCITFDQADLTIKLPDGHEFKFPNRLNMEAINYMAADGDFKIKVRGL

SEQ ID NO: 1014878 - protein, 55 aa, Homo sapiens
IISMRLRLHLKQLRSRASALGDSLRTAKAKAVKMLAESDTNSTSGDPVEKKDETP

SEQ ID NO: 1014879 - protein, 161 aa, Homo sapiens
MLVSPPVRLAICGGLSARVISVGRLCARGCPGDAPQGASLLGRGPRRLPGDPRVLPIPAMLTPLVGASRAAWSSCPCGGGVGVPTPAVPSFCAAFPMGHRRAPFLTPSTHISLPWVFASQVGPKEVFLDPPGPRDFPISSRVGFFLAIVDPPEWETPHLGA

SEQ ID NO: 1014880 - protein, 48 aa, Homo sapiens
ENTKKVIQYLAYVASSPKGRKEPGVPASVSTVSYGELERQLLQANPIL

SEQ ID NO: 1014881 - protein, 67 aa, Homo sapiens
APLLRHWELQVPIPPPDAMETLVCALGLDIGLVGFLVGIVLIIMGTYVSSVPGNDPSERNDLWETPC

SEQ ID NO: 1014882 - protein, 39 aa, Homo sapiens
DDSEEEKAAAPPRRLYLKSKFFPSPRPSESYHPYPECTS

SEQ ID NO: 1014883 - protein, 167 aa, Homo sapiens
TDPNNDTHQHHHHGDPNPNTHWNTDPNPNTHHHHHYGDPNPYTHRHTDPNIDTHQHHHYGDPNTNTHRHTDPNHDTHHHHHYGDPNPNTHRHTDPNPDTHHHHHHGDPNPNTHRHTDPNPDTHHHHHHGDPNPNTHRHTDPNIDTHHHQHYGDPNPNTNRHTEYNPD

SEQ ID NO: 1014884 - protein, 68 aa, Homo sapiens
AEEEKMLLSLEMRQNQTEPRHPATLEGNKSEPANNSIFVLPTSKQHAIQGLPGIGDTLPIPYMPFEML

SEQ ID NO: 1014885 - protein, 86 aa, Homo sapiens
QQYCQLDFFNDHHRDHLTQYSQLDFFNDRHRDHLTQYSQLHFFHHHHRDHLQQYCQLDFFHHHHRDHLQQYCQLDFFNDHHRDHLT

SEQ ID NO: 1014886 - protein, 39 aa, Homo sapiens
ASSKPYRSKSRPRVANSAQCTRGTTRFSPTRARRTPHAH

SEQ ID NO: 1014887 - protein, 255 aa, Homo sapiens
MMLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTLPPDKKLSKIEILRLAICYISYLNHVLDVYGGVRRGGPPVPRPRNATDPDGPRRSGGGGCGGPARRPPRETAGEEARYLFSLVSRATREGFRRRQVGLSGEPGGSQGGFSRPGEPRGDTRDEPLLGLPKGCGFNPLETLSSPTFIRHKS

SEQ ID NO: 1014888 - protein, 38 aa, Homo sapiens
RGNLNTRLRKLDEQQEFSAIILATAGLQRMGWHNRVGQ

SEQ ID NO: 1014889 - protein, 113 aa, Homo sapiens
IRRSGLELYAEWKHVNEDSQEKKILLSPERVHEIFKRISDEECFVLGIEPRYARPESMIVTVLPVPPLSVRPAVVMQGSARNQVSGSRALPLSWRARCLKGGRPVGRDGDDLV

SEQ ID NO: 1014890 - protein, 31 aa, Homo sapiens
NRHLPVIRQNDEHKAKEERTPDICSLGLLGN

SEQ ID NO: 1014891 - protein, 97 aa, Homo sapiens
ANGFIDDRNEHPAVANNRLADSTFNAIRYFCISSSFELLGCFFGRCTTDGIQFDLDQLARRILCIGFFERKLVGRTCFIQLVLRHQDVAFTITDYIS

SEQ ID NO: 1014892 - protein, 69 aa, Homo sapiens
IRHRREVPAVTLPPGPWPGRMIPEPVLVGILTDQPSPIRKPGWAGNFAGLSQDHQQIQPPGLGLLLVLH

SEQ ID NO: 1014893 - protein, 101 aa, Homo sapiens
CKTGPQRGHERVAGLLPQGRACKTQQRLLCTALRRREEAPSSTGPRLRRSLGEGTIGHHLPASSFSISKVIITEKQQKILTPQNHVFPYENLFGQAWCSCL

SEQ ID NO: 1014894 - protein, 104 aa, Homo sapiens
MARGPKNKGMPCPTRGLLQRQVDVRRGVKRRKRFQKAGLCNTGQGGQTFAQTLLWAALPSPPTRGSEQTAVVKRAPRRKHWGAPPLGRRPQGKARVRPRAAPRC

SEQ ID NO: 1014895 - protein, 523 aa, Homo sapiens
VFLLIQLSCYFSSGSCGKVLVWPTEYSHWINMKTILEELVQRGHEVTVLTSSASTLVNASKSSAIKLEVYPTSLTKNYLEDSLLKILDRWIYGVSKNTFWSYFSQLQELCWAYYDYSNKLCKDAVLNKKLMMKLQESRFDVIPGDPVFPCGELLSELLNIPFVYRSRISRGYTIEKNGGGFLFPPSYVPVVMSELIDQMIFMERIKNMIHMLYFDFWFQIYDLKKWDQFYSEVLGRPTTLFETMGKAEMWLIRTYWDFEFPRPFLPNVDFVGGLHCKPAKPLPKELEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQDDNIAHMKAKGAALSVDIRTMSSRDLLNALKSVINDPVYKENAMKLSRIHHDQPMKPLDRAVFWIEFVMRHKGAKHLRVAAHNLTWIQYHSLDVIAFLLAWVATVIFIITKFCLFCFRKLAKKGKKKKRD

SEQ ID NO: 1014896 - protein, 108 aa, Homo sapiens
PQLKPPRRNHLCCQSPEGATQRALLALCQVVKAAPCFLKREEAIFGPPFVTSSLNASSFRTGFSPFRQVRFLRRNPVSKIFKGVSLQPLISLVLMVFNFPFLFLGFGF

SEQ ID NO: 1014897 - protein, 115 aa, Homo sapiens
DGVSLSRPGWSAVAQSQLTATSASQVKTTLMPQAPEQLGPQAHAIMPGQPSVLFSRDGVLLCHTGWSRTPDLRRSAASASQSAGITDVNHHAGPQSFLQRAPHPNPKPEACESLS

SEQ ID NO: 1014898 - protein, 127 aa, Homo sapiens
ARPPTSPPLQRGLAELRTRAALLKVSLSQHPRRPASDAGARVSGHLSVSIPSASQDSATQQLPLRPQPEGTCGQDAGRRRGAQRPRRASPSLRSETRASRPQEPPAASPGVWDLKFLEKGVQLFKVN

SEQ ID NO: 1014899 - protein, 104 aa, Homo sapiens
SLLSPRLECNGTISAHCNLRLPGSSDSPVSAAQVAGITSTYHHAQLIFVFLVEMGFHHVGQASLKLLTSGDPLTSASQSAGITGVSTAPSLFMLDHNMISPDPY

SEQ ID NO: 1014900 - protein, 91 aa, Homo sapiens
KASETRLDTEQKRGPVACFERNTYPGIATRERLAQAIGIPEPRVQIWFQNERSRQLRQHRRESRPWPGICGPQEGRQTRTAVTGSYSDLLL

SEQ ID NO: 1014901 - protein, 104 aa, Homo sapiens
LGRLRQKNGLRPGGGGCSEPRLRHCTPAWATRLKLHLGEKKNELNTRDGNAGNERERSYRMHHQSLLRGEARTLMRMLSAFLPVPRMVGAGLCLLQSMPCHPPC

SEQ ID NO: 1014902 - protein, 36 aa, Homo sapiens
PPPRGPSIPAAPRPAPLLSTPAPEAAVIGWGCETPT

SEQ ID NO: 1014903 - protein, 355 aa, Homo sapiens; identical to SEQ ID NO: 752177

SEQ ID NO: 1014904 - protein, 99 aa, Homo sapiens
AAREDGTALTYWGDSLDDSLTRLFIRRQEEALTVSMFWVVFGVQHVQQLYLLACMLHVSLTSEISTRECVFYYNEQRFSLRTGKIKNVHPLTGEIPYWS

SEQ ID NO: 1014905 - protein, 137 aa, Homo sapiens
LKSSCMQSVDKCFLPGVISAEICHKAPVSRSFDKGYITCLISGNVYHKAPCSKAQTIVTSPGWAVERSVAIPCRQSLEKGYITWVISAEIMSKRSCRLNLDRNYITWVISAEICENSRVGRARQVLHHLGYQCRYKS

SEQ ID NO: 1014906 - protein, 66 aa, Homo sapiens
RELSGANVLAEYYWLRRLLGAPGNSPAPGCAALLPSPLPGHREASKASSITVPGPELTGLPKVLWD

SEQ ID NO: 1014907 - protein, 37 aa, Homo sapiens
TAVYYCAKETLGPKKAYCGGDCYDNDYYYYGMDVWGQ

SEQ ID NO: 1014908 - protein, 47 aa, Homo sapiens
TAVYYCARESTPYYYYGSGSYYNQPFFTVPTLYYYYYMDVWGKGTTV

SEQ ID NO: 1014909 - protein, 47 aa, Homo sapiens
TAVYYCTRDHIVVVPAATTPTYYDYVWGSYRYYYYYYMDVWGKGTTV

SEQ ID NO: 1014910 - protein, 33 aa, Homo sapiens
TAVYYCAVESLVVVAAPQPGSERADNYYYYGMD

SEQ ID NO: 1014911 - protein, 36 aa, Homo sapiens
TAVYYCARRPGAKQRAYCSGGSCPYYYYGMDVWGQG

SEQ ID NO: 1014912 - protein, 64 aa, Homo sapiens
ASLSDTWSVEKIPHHPPGSNGLGERAAGPTIADSLERADMEPDHSALSAARTLFDVEERGPEHC

SEQ ID NO: 1014913 - protein, 107 aa, Homo sapiens
MALAPPMARVRPLFDHLCGTPSRVARGHSCEAPPTGMAHLLRPSGLSSTIYQDRLKKLLFSHHPPTGLKPRGKMWDVVRQGWRGQKGAPAGPGTPAPTEKTPRGPKK

SEQ ID NO: 1014914 - protein, 96 aa, Homo sapiens
ESHFVAQARVRRDLSPQPPSPGFKRFSCLSLLSRWGYRCPPPHPANFFSAETGLRHVGQAGLELTSSDLPTLATQSAGIIGVSTTWPLSLIISRLI

SEQ ID NO: 1014915 - protein, 129 aa, Homo sapiens
TARLFMRQGLILSLRLECSVMIMAHCSLDLSGSSDPCISTSRVATTTGMPHYAWIIVPFFFLVETGSHSVAQASLKLLDSSDPSNSASQSAGITDVSHNQHGLSFSDPDQRTGLICPKTNLGKVEAVLS

SEQ ID NO: 1014916 - protein, 119 aa, Homo sapiens
VGSFSLQLLSHHLAEYGAMGLRGGSVCMVRGQTWAGLEKAPQVPTPVSRISSLTPRLQALPDLKVVLHQGLTHSCPGACPPAAIYGAQAVCKECLWASELPSAPPWPLFCHWCPKSAAG

SEQ ID NO: 1014917 - protein, 164 aa, Homo sapiens
MHPRPPRSAPRRWITFLSTRRLTSLTFTDNPSESSGANTPTGRQGFPTLFSTPPLPAAGDPPRSFLRGETCPRGRTHHPLSCESVAGTPFFPDTLLFVASISLGTTLQWTHRRAANGVHPPADSKGLLFSPFFPTNGGAVSCLSSSTTHAGVHQLRATDETSLG

SEQ ID NO: 1014918 - protein, 116 aa, Homo sapiens
MLVGVGCVGIMMWFELVRDDGVEGMVFVDGASYGEVKGDSLGLGGRARRGGRLVERARTTDASRSCAVSGSGVSWRAALVWRRDRACRGGRVTTVARCRVSLWLLTCASWRAFVVG

SEQ ID NO: 1014919 - protein, 600 aa, Homo sapiens [sequence omitted]

SEQ ID NO: 1014920 - protein, 57 aa, Homo sapiens
RQSRIEMWTHYINYKVHFGEKIGSGFTGARKKTAFLLAPVKPEQGGRLSSFYYHEAG

SEQ ID NO: 1014921 - protein, 112 aa, Homo sapiens
MTFEYRAFWHNDYTIKYPLFGTHSLESSCSRVVHLEVRVPYWFLAVLTGSLHPDLNEGLLVGYGEETPEVFRRCCLEVGFFLGVTGKLVTPIGSLEQVPVFNPKWKTPPSFC

SEQ ID NO: 1014922 - protein, 65 aa, Homo sapiens
MYPESVSHTTHLASVKYDEFVLPQCAECCCVLRGYLCEASYDPPQERSRRNDKKIILQSPNNSRK

SEQ ID NO: 1014923 - protein, 429 aa, Homo sapiens
ERTVTNNPRTQDLTAKLRKAVAEGQQAGHHFLTFILEQPPVICIRLRQTTPTHRSRQGCRYNVHAMLLPNSSHPGLPIVPRLHSGTSMAATHGTSCRTACYPCMHAPTAHAGSKRYPGYDGWHHVTIKHTRRTNDWDYDHTRFVILMLDQGSWHTCQHVKVEREHISVDDRICGICSPAHTPKGQSHIMAVNTLTVHRHSSQLEVAPRQSPHEHQKILAWDTCTAQTRISASRSVATMGPQLHFTVGPPFAWHHAEQQDATLTVHPQNNNPAANSMGEVNHKEHPRPRDENAHYSKDKRTGKLEKRQETPEKERPGVNVEPSDRRPECEHGAPPWNDTMATTGKRKNILPSHTTICGTTTDPNHRMMHKTHGPVSNNPTLHREQPETPGTRAPGLYNRKLGDGARLDTQTTGVNIPTVGGAHSGANNAV

SEQ ID NO: 1014924 - protein, 77 aa, Homo sapiens
APVRAAIYSLVCYCCVLQFLLLPRRLLRFFSPQLFERHILLLTTGIMINADITTNFTAAFEDPTFCNGVIDKLTIVA

SEQ ID NO: 1014925 - protein, 105 aa, Homo sapiens
SAQKLKPVLEKWLMEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 1014926 - protein, 39 aa, Homo sapiens
PGVPGSLRQDARGEAAEARRGEQGARHGHRAQEGGRRGP

SEQ ID NO: 1014927 - protein, 231 aa, Homo sapiens
MKEKNYRNTWKIHEPQGKTNKPESFNASQSSRSRNAGSLTRRWAKRNGQTVSPPPPPPPPPNKTLPSPPPPPPKGLLTPPGPPKPPPPPPPPPTPVNKGPPGKHLAKPVALASPGPAYGSGVAHACPQPPVPGQATTRPLSGRLVVDANLEASRAPIHKLDAALGFDGGNGSIDIFGNHVTTVQQAASHVFTMARVTFHHLVGWLKTSIGDLCYRKLFMVGFLSRNDRGIF

SEQ ID NO: 1014928 - protein, 257 aa, Homo sapiens
CNTRWGRKRGEDPCGKKRPSPSLVENGLPPARALCARETTPGGVWSPPPHREGGKRAPPPLGQNTRRSSPAECNPRGPRGPPNERAPNARPFRPALRIDSAVAPRPPFGGIWGPHPRRPPTGGPFTRCDRPAPPWVRTAGTLCPQRLHQRSSVRSRTCWQYPPAASSPGRRVHLLPWPPELVLPVDVIATRARFVIILELVVRGTVAIRGPFLDGDPSDAQAPALKNESNQGGFGRTIKPGPRQCMGRYDATTTHVA

SEQ ID NO: 1014929 - protein, 54 aa, Homo sapiens
MMSTGSPPKLLAVTRFVTFSKTSPREPPRLSSPPRNPPARGHVWVFLLSGTLSD

SEQ ID NO: 1014930 - protein, 189 aa, Homo sapiens
MREAQLPGSVGEGYEVLCRLASYPTDAKMMSTGSSKLLAATVALSLGPKAAAGSAPGCHDHPGTHQPGATCGCSCYPALCLTSHKGAFPRTSQYYPQPLQVFDGRQGERFLLLKFIPYLIPGCFEVQFHDLLNVISYSFQIFQHILILIAFVISLPSGGITVLDSELHHAAECAGHSCGVFFGQCTSVY

SEQ ID NO: 1014931 - protein, 102 aa, Homo sapiens
VTLEPNKLRPGDTVTITCSSYRGYPEAVWQEGKGVPLTGNRDHVSDGQPSRACLMCTSVLRVVLGAEWHLQLPGAQPRACRMRTALVTITGQAYDIPPGPCG

SEQ ID NO: 1014932 - protein, 127 aa, Homo sapiens
ILHGPWDVRRSAAHKSLLARGYQAAVASACLGVALSRVGDNPGSLARIGNLGKPRGVHRVRAQVLGQLLPETTSGLLASVRKPSWAHSQSQKQLSLGPKAGNVQPPSRIVCLPATIQTVQHSCLSHI

SEQ ID NO: 1014933 - protein, 74 aa, Homo sapiens
MHRDVKPSNILVNSRGEIQSSVTLGSAGSSSNSANSFVGTSYMSPERLQGTHYSQSDISMGTVSGRDGGWEVSH

SEQ ID NO: 1014934 - protein, 30 aa, Homo sapiens
VDKCEEGINRTTRESCRDCRTLNVTPATAV

SEQ ID NO: 1014935 - protein, 52 aa, Homo sapiens
APLILNLNDEADEDEERRRRHFPTHLTKLLNQKTLFSEWRTELSVRKLYQSL

SEQ ID NO: 1014936 - protein, 55 aa, Homo sapiens
MVSELTESRSAGNLPYGQNGCCDTACGGVMVSERTCIPFLPGILKYGKFRAYFAS

SEQ ID NO: 1014937 - protein, 101 aa, Homo sapiens
QYSGTGQQRPERASLQFLRNLHGPGQCPVNDHGLLSTNATDVNNALGYDEPASTAKASFWRCQERRLLLFSEWQLAGRHAAAIEERPCRKPSGQASRIFVV

SEQ ID NO: 1014938 - protein, 116 aa, Homo sapiens
TYWIFVPQETHFLVGYAFQCHRATHPMLSLILSRELPGTDSQGSSPVFWADRWVGNRRGENDRPKLLPWGSPTRTWVLPGKTCAYVKTNGPRPRPPACEASISVKGGWKRPLLPHF

SEQ ID NO: 1014939 - protein, 68 aa, Homo sapiens
ASSGLADHYRTEAVSRLGWAWVASDSLPSLKKGSRVGNGWGQEEFCQVIFTVILNHSLFVPAFETFGS

SEQ ID NO: 1014940 - protein, 89 aa, Homo sapiens
YCHCFLRCDVRPVLQVVVLPLLFCLQIEPGEAVFFTNRLVHRGPSADPLSVVAGSVGPPVSGHVSKDILYGRREPRDPGNVGFPAPGHT

SEQ ID NO: 1014941 - protein, 205 aa, Homo sapiens
MLAFVETLAGKTITPVVGPSGSFVAVLALALALEGPPPAPPRLDFAGLPLAAGPPLSASPLPPPAPLPLVLRPPGGLPRPEPPLPGPARPLAVAPRAPLAPVPTTLPAPAGLPPSTRRCCSLPATPGGRWAPPVFLPPSLTNNLPCHWVLPSPAGGGCRISRCQHPALDAAPIHPSAGGQTQSLTHENHVPGPQHPPASRPGLPS

SEQ ID NO: 1014942 - protein, 218 aa, Homo sapiens
TGLPPRRVDGLDQLGSSRRFASHLSDGAPGAGWTLSEMSVRSQQRVRAMRSSCSSHAKINLCWSGGMPSLFGFFLFSMVLLGSTSSVMVLPVRVFTKICIPPLRRSTRCRVDSFWMLWLERVRAMLPAVFQQRSTSAGQEGCLPCVGSLPCCSQWCDWAPLPESWSYQLGSSEDLHPTSKTEHQVQGGLFLDVVVREGAAIFQLFSSKDQPLLVRRDA

SEQ ID NO: 1014943 - protein, 281 aa, Homo sapiens
VWSQWSTLDIWSLAGVMTVLEGLARGSGWWVAWGQVSECGVVRPMGICADMGDIKLCGPMGLSQWLEENGGARHSSLVTFWLQDVACWLDERELVGQGLIPGPGQRRVYSGSSGGTVDVTPSLARVHALMSLSLPQVPPLSPKLSPGDTNGWVYGGSEGAWAVWQGNAHEHAFSMSRGGIVHLARPRDDVTPKCVDHPSSGGGWPGRTLLASAWPVRYRGPGFPGQMNTAGNDGAIGGCLPMGCCRQRNGVPGTGWGVGYPQGPGSHDHGGPLRFGARQRT

SEQ ID NO: 1014944 - protein, 164 aa, Homo sapiens
MGTTPLSTLSRAERSPKHHTCNGIPARQPPRGVILYELAKTHLESIGSPPVSSTHRTFRVQTFLPFTLVASVLHEVRMHDSFAEDPSQLEDPLTPPEVEAPVTPLRAMSRPKIPTIKERHFPPLIHATTVVSLLGNTLEDGAPPRLRPTHHPEKSPPLHLGPAP

SEQ ID NO: 1014945 - protein, 54 aa, Homo sapiens
GSLLNITELNLPEVEMIKQVDQEVEFLSTSIDQIKVEQTFVEKVPSEDTCHPQV

SEQ ID NO: 1014946 - protein, 110 aa, Homo sapiens
TVTTEQYRSSKTTTRTPITQSCYSAFTQKAKSGYGPRHLHLHIYCSTIHNNQDTESTYMPINLNDLTRDVVHIHHGILCGHKDGNTDTGVYLKVEGRRERARKITIGYWA

SEQ ID NO: 1014947 - protein, 106 aa, Homo sapiens
NAHQVMLRLQKCGLRTGSCKVTPGTCEKCRFLSPSPGLLSQFLVDAQTLWVTPIHIRIENHQWRSKKTSHESRGLLLILVLQLISETDTPASCEGTAFLVDDEESE

SEQ ID NO: 1014948 - protein, 291 aa, Homo sapiens
GPRGRPSSVDSAAPPLTLRRAVPSEPRRDSVDAAHTPEKPEDGACTGHSATPAQHSVHTTSEPRELCLHCRRRPERTLLHAGSAEGEEHLPEGGRAVASRQMDGQTDTGETGSAGVSRAGQMGQDPAPCALHSQDDRTPWNMKNAGRQTPEAQPLTGQGGRQREAHSRPPEPHLIEGIEIKAQQRAAHDGQLKKINPPIRVRVPVTGGGFGCRGGFSVRFLLISEPATPLKPDIGQDSQDGRSEGNTRPVDILRPRACRRVPAWGVSRATLVLLRLCGLPGAWLSLRAQAL

SEQ ID NO: 1014949 - protein, 100 aa, Homo sapiens
RNSAHHPHLPVGQAGSFCGGRGRATAQWRGVARPHTPSTMFYQPRQIKGHRDPGPRDTDPSREGCRPVTVPPVHGHRENCPGPGFGESGSPPSAPASFPS

SEQ ID NO: 1014950 - protein, 119 aa, Homo sapiens
PVCCVVEHYENAIEYDCKEEHAEFVLVRKDMLFNQLIEMALLSLGYSHSSAAQAKGLIQVGKWNPVPLSYVTAPDATVADMLQDVYHVVTLKIQLHSCPKLGRLASRTMVEHHSEECSE

SEQ ID NO: 1014951 - protein, 154 aa, Homo sapiens
MGSHQRVRLYRAVLCIHIPQSSWEETIPVAIDVSLCLFLKSPRHTKRRECLGRTGSGTSCFTQVGGVGAACPELPSPSRARPAHPAQSSQVARGSIDALTRLVKRMWGWGGLWMVFGMSVCGQLGSACPRACSRQCPTGGEATVPRCSMYTWPA

SEQ ID NO: 1014952 - protein, 103 aa, Homo sapiens
GTWPLPASGSSSHWLLVRHQLLLRMRGPRRASRGTMEARCGLVVREQACGASSPGLLALGPGSPSSLWSMRHWQRTASPAPSGAVRPPARGDVAAAWLFCFLP

SEQ ID NO: 1014953 - protein, 98 aa, Homo sapiens
FCYSDMAQSQRRKGPLVSAVCTSSVRRQDRSMKRAGQKTPTLAGRHVPLKIKKEAWEQCSSYVRPGHFLFTGDYKTFVLSSLDVDAILASARLHPGTD

SEQ ID NO: 1014954 - protein, 353 aa, Homo sapiens
MCFSHQVCCLEFFFSQVGSDLCVYMCRVCTCFRERACSPPVGAPEGPSCVAFSLCWWGPHTDGGVVQVLLVMSLCLVGCLCSARWGIVSFYECFSRCGLRHPCGFLPHGVYIVVFWGVLYIVLALPLCLIVGWLLFGAHPTNVGGGYTGGVCDTLWEARVSRSVSPYALAVSPFGREAPTGAALVVFVVCPLAPRGVRTDAGVCAPRVFLLCAQQVSVGCSSLLCSPVVTCAHGTHRGHTCVARVCSTHHISTHPPVCLEPHTWGPHFPALHLTVYEARVSEMTTTHCGDPHHWGHLRVSFVRVSTAVWLLERGDCSENVSLVFCCVFMVHVWSTCPQVCAPLSLSTSTHHAS

SEQ ID NO: 1014955 - protein, 96 aa, Homo sapiens
TRDNPDDASATATWPSPKAQGPLVSAVCTSSVRRQDSRSMKRAGQKTPTLAGRHVPLKIKKEAIWEQCSSYVRPGHFLFTGDYKTFVLSSLDVDAI

SEQ ID NO: 1014956 - protein, 64 aa, Homo sapiens
LSTSRNSGSSWLVAAAETHGTHDVATATTVSGLGRGKAPAAHQQRHPARLAQHVALEDLALRGA

SEQ ID NO: 1014957 - protein, 106 aa, Homo sapiens
MLCVGQGRHPYWRGRASHWLWGTMRQPAPGEHVPPQQRSSREWPGALLLFLVSFVFFSTHGTGDKIGSLVRKNYARKPTAPLVGLALNLPGLYIFCRTHQEAICKV

SEQ ID NO: 1014958 - protein, 89 aa, Homo sapiens
PQAPCPPSSLFSSDNEDSSYSSDDEDPAFCCRPAPTPCPPSCPEPCAPSSALNGMPTLLPVQGHGGWHRALRPQQQQIQKRKEALSFSK

SEQ ID NO: 1014959 - protein, 136 aa, Homo sapiens
SFFQKQNPKLVFIETKKVHGFSGPAMLTGVWISWERVQVDQQSRLGTCPACPAAEVLVAGLAALVAVAEAHRGHGHPSRRCRHRPTLSPRLASASPRPSCVSTSCSRKRSGPAARPGAWPPTAPRGRAGPSGTIGR

SEQ ID NO: 1014960 - protein, 116 aa, Homo sapiens
PDKRARRLIRAHGNIDALKAAGRQTGSGAPHGSARTAQQATADIQQIAHTELTVTVMVQHAAKQAAGDTAMLLHLLLFLPERLAERAGIGLAATEALGKEGHHDRGEDMQQMAGAA

SEQ ID NO: 1014961 - protein, 117 aa, Homo sapiens
MAPKLAAELALAVPPGPIMGPGKVCGNLERAFWWYLAQKVNGILDQGSPKSPSSSQVSSSNSMSSQLQGPDTASSPIPMRVLASARASASAAAASRASKASSAASMNCAVQSRGSLF

SEQ ID NO: 1014962 - protein, 43 aa, Homo sapiens
MHWIGPKEVKTSVSLPKKCPPKLTLYPGCHGTGQRYTRPKERK

SEQ ID NO: 1014963 - protein, 298 aa, Homo sapiens
PCPVALLHLEGSPNPSVARPPEYNLGPPSAASLSSGEHLRWAYGLNKAKTSARPKAPPPSGGSPRGATNAPPSGGKGVTPPPNPVVRPPTRNGAGPHICAVPTIWRQECLFALINPLPRRLTNMGASLHSFPGGSTPSIGLLPLVHSSGAPPRSLCIQGDTPRRFLPPPGRGIDLGLSEPMLPPPAVFIALGAPPPPWSRTQATDQRRTKRQHNSRAYTSERPDPASPGRRERAYRLTRGPLPFTKTTLSMTAGAQNSPTGRQVERHSLTHLLLEQTVMPPPPHERAGPDPSQLPPTM

SEQ ID NO: 1014964 - protein, 224 aa, Homo sapiens
VPNLPAAKPESGGMDRELSALSGIENAISVQQDSVIFIWDWNEPNLPGRDIFLQLLLQPSYFLAKWEMLTPVLLTGLQGSLKVDKVAGSSKGGPRKFGRSGKASTMASRASSIATSSSVRMKCSRKCCPCQEIKPRGLATIKWKILLTWACFHCFLSSCGQSEAPAVQCHPYCDVDAHVNEANLSFSGAHQKPSPPLCVPRRIIAPLSPAAAAVRPLTRGPGRH

SEQ ID NO: 1014965 - protein, 116 aa, Homo sapiens
LVPSLCGPIYPIGTIPPTLVGCPWHLRCGVPTWAALVDGARMPPRGVFPPGGTLVPCLRWLETPVDGNPFSVQGSPWGQLGSQTPQGFLHISISAPPGEVCEGTPRVVTHLFSGTK

SEQ ID NO: 1014966 - protein, 254 aa, Homo sapiens
MPFLRLCSHPSWCSLPGYGYRALVFSPRPVLLTSVAFHLSLAWVSLSSFFVSVVNICRRAEVRIPGGIFERGSPSSRVGGNPLLFAWPTKRAPHWLPSFCKGPCAFNNTSLKRVLFYRATKVSLRRAALMPLFPGCRSLYRAEHLLSGGPHSRECDGPRASLWEKPSPMGLFFLETKGLLRLGFPRPCAALAQWTTLWGTFVGSILVLSRLPLWGVFARPLGAYFFRSRFGDNSRIKNMIAHTLTLVKVELPLL

SEQ ID NO: 1014967 - protein, 320 aa, Homo sapiens
SGIPGISAVLPVHVPWGLCELARLIGFLLLVAKDLFKQCSNSSGRLYRLPSAETMKDTSLRRLSCVTKSAASSFYSIIVSVFISIYIDTTTSTEQLFFPGSDDVVLEACKDFWDGADIYPLSGSDKKKLLDFYQRFFLSGYCSAFAYKPMNCALSSQLNGKCIELVQVPGQSSIFTMCELPSTIPIKQNARRSSWSSDEGIGEVLEKEDCMQALSGQIFMGMVSSQYQARLDIVRLIDGLVNACIRFVYFSLEDELKSKVFAEKMGLETGWNCHISLTPNGDMPGSEIPPSSPSHAGSLHDDLNQVYRDDAEGLLLMEEE

SEQ ID NO: 1014968 - protein, 69 aa, Homo sapiens
MRNRFLLTSWAALVLTMVQTQDYPHVIYEDYGTAAHDIGDTTNRSNAIPSTDVTDTTGRAHLSAYAAGG

SEQ ID NO: 1014969 - protein, 68 aa, Homo sapiens
GYTDSNVKRHTCRFQAQQVLKCHSTRNFEPKRWGRKAKTPSWHFFGVLGHDTSSGLLLLNFYRDKRYP

SEQ ID NO: 1014970 - protein, 77 aa, Homo sapiens
MANMRMAKKRSSPICRSGTMAFMMDLSTTCKPGARTGQVRKQRGQGRARNVGAGTQQEPSRDSKVLSSCFQGQRLEL

SEQ ID NO: 1014971 - protein, 64 aa, Homo sapiens
AKQRTPYGYARLLYRSKTVEKRTNSGNDLEMPFWRDQAEATFNQTGKLRITVRYTVNRHGQVKQ

SEQ ID NO: 1014972 - protein, 49 aa, Homo sapiens
LITCAAGHYSISTRSSKKQPLQTSRSAAQTSLPAHVFTHTIFAVRLEHS

SEQ ID NO: 1014973 - protein, 59 aa, Homo sapiens
KCINIYLVHMVFQALGGYLNCWQYPSPVSQNEENVEGFMMEEVARLTTSNLKTIYCEGP

SEQ ID NO: 1014974 - protein, 50 aa, Homo sapiens
MLSDYSYGNRPLSGGSTHDKVPILTNTQAIIALSGKQPIASSATSVPPIC

SEQ ID NO: 1014975 - protein, 47 aa, Homo sapiens
MTCYDGVASVLLQLSSTELTYGRLLPQSYYLVTPDTYLLDNAIWPRG

SEQ ID NO: 1014976 - protein, 31 aa, Homo sapiens
MSASHIASDDLPESISWMLRVHLRVILDAAL

SEQ ID NO: 1014977 - protein, 51 aa, Homo sapiens
VLIKCHMQVVLLNLNMLSSSSSCNCVGIVNRNGSTTDMAFAYHDIGVYVSW

SEQ ID NO: 1014978 - protein, 53 aa, Homo sapiens
QDTGAYHIIPWSSITTFANFVRGIGSVVDKYDVDRHEDADKANQALKDAEGIN

SEQ ID NO: 1014979 - protein, 131 aa, Homo sapiens
RRSFLVYHAREPARLGEASYARAVAKFVLYQNRQRVGVIAKSLGFVRRSSTSVGSTGWWSVLPSLTVTGSIKGPAWSFQLVPLKTPGGSTKQFTLPTKTRTPRHFSGHHLKPLGTPSRSRTSGYLAPPKAD

SEQ ID NO: 1014980 - protein, 56 aa, Homo sapiens
MRDGQGLGARGMTDEIFEGPFEECMRMPDNWREGLIDSRKAVERLNLLITEKPRPL

SEQ ID NO: 1014981 - protein, 61 aa, Homo sapiens
NEVPESSSMLSNIPEHQSVSAVKEITQPSTLTLLYQSQNGAHLLNFDGVGEVTWNRTRNPT

SEQ ID NO: 1014982 - protein, 53 aa, Homo sapiens
FAALSDTTGPENVDESVSYSSHLLGAESLIVLLTVMTNVGVTLQMMNSDGSTI

SEQ ID NO: 1014983 - protein, 43 aa, Homo sapiens
MPSRFKTLHVVAGRKCDAVIVSDISRNFDVDIDEIRGGQFNAF

SEQ ID NO: 1014984 - protein, 60 aa, Homo sapiens
TRRVLSYLRFHVCVIHTYSYLLDRSLIVLSTAAYTYAHYADEFMTDVNVRRVRFADRLGF

SEQ ID NO: 1014985 - protein, 55 aa, Homo sapiens
HHQVLRNCDNNEGFPQETNYKGSMYASLTFVTIKITRTNKESQTLILPRKAVKGF

SEQ ID NO: 1014986 - protein, 58 aa, Homo sapiens
LFVEDRGASYAEADAEIDEAFYAIAEDEILDVNRIRLMSQPLRVRDFPWLTHSSEKLR

SEQ ID NO: 1014987 - protein, 50 aa, Homo sapiens
TTKLHDGYTVNWQLGLYVAQFSCSSYRGTVNTVYDKFGMTLYWILTLMDS

SEQ ID NO: 1014988 - protein, 60 aa, Homo sapiens
EIKAHKAPLTAPTDKPIAGDTPHLLSCRAVSTFGYAYATSRWQSKCYHYANSTRHYKRQR

SEQ ID NO: 1014989 - protein, 49 aa, Homo sapiens
YSTSVCMFEASIRRQRFFEVQMAAWYDISHVVNVLRSLKVRIYIALVKL

SEQ ID NO: 1014990 - protein, 51 aa, Homo sapiens
VVVRRFTDVVRCWTPRRLVKPVYDPVMIADHRVLCRCSYTCVDIAMLIRCS

SEQ ID NO: 1014991 - protein, 51 aa, Homo sapiens
KGDNLWVDMSGALPGAIRRSVLRDTKLVCNFQELTRIGFRLGSMRHNCPSV

SEQ ID NO: 1014992 - protein, 85 aa, Homo sapiens
GLTSLVNSQYPSNVHAANHFRSFQRFVTWYFTDGRNHWLFRCITPSSALSKAPTLTLIIVHRTAHINQPAQPTLVLCCCIVCVCK

SEQ ID NO: 1014993 - protein, 52 aa, Homo sapiens
GIKAHRCGTLMSGKLYIYPSKFQYVSNIMFARTSCMVGFLLLLCVVDILWMD

SEQ ID NO: 1014994 - protein, 70 aa, Homo sapiens
GACSKAWTLATALAVLTARVYCTCPNHTDEKAETQGQQPGSQRSGTRRHFSTSGGGTTVRGDGCDACAGK

SEQ ID NO: 1014995 - protein, 37 aa, Homo sapiens
RSTYRPRRRRSVPPPELIGPMLEPGDEEPQQEEPPTE

SEQ ID NO: 1014996 - protein, 57 aa, Homo sapiens
FFEVKQTTEPNFPEILLAINKYGVSLINPKTKDILTHPFTKISNWSSGNTYFHITIG

SEQ ID NO: 1014997 - protein, 77 aa, Homo sapiens
PSRLSSGATQICLSLWRKNSAGSFPWPQPPAHKGHGLFKRTLSPAAAPGAGGTAPRACLPPAAPARTGLGEAAGCGA

SEQ ID NO: 1014998 - protein, 39 aa, Homo sapiens
GDLELHLSGRTLPHPQIPWEEMLSLTASEPLLATVPASL

SEQ ID NO: 1014999 - protein, 72 aa, Homo sapiens
EGDVDTGRDAVVGEWTEGLSVKHCLEDSRVNPMLVKAWAIDGKSVASSYREQRLRERGTLFPGLESLCREIK

SEQ ID NO: 1015000 - protein, 66 aa, Homo sapiens
MAPVSAHAARIGGLSGGRRRSSKSPKPSKSARSPLARSRSHSCSRSGDEIGLTHQLGGLSQGSRNQ

SEQ ID NO: 1015001 - protein, 170 aa, Homo sapiens
MGIMTLRMYKNNYWGRRPRAYVSGCSFWNEGWSLHNILWLPDPQKEEIIEKMQGDDETVVTEHLGEDENQAHAHEESGLLGGAPHATFPHDADGKAGCQAAQAHAQAGAQLEEALVEADVVIQGVGDEDCLLQAVDGDDASHDHWELAFLICSGRMTDMAAMPVPLLAVH

SEQ ID NO: 1015002 - protein, 95 aa, Homo sapiens
WCCHVLIANCLVIIDISAFTRASSMLGAGPDAWVLTLAWQSGFAIGIVVVTAGVVGVTAQHAPTISWCMILILICLAEVLGLYGLIVALILSTYM

SEQ ID NO: 1015003 - protein, 175 aa, Homo sapiens
INMELLKVANGYLSVPRLCCHPGYRHTCHRRTPLRKSGPACSHWGIPLLAGEYIIRCSEIPKLPAVSLLIGGVWFNLTAQDYVIQFAQGDVRLCLSGFRALDIASSTCVDPRRRFLGGVCDFDRGDMKSGARVGLARARPERTWVPQAQYPGAAQVDACAPGSIALLSKNPIFPL

SEQ ID NO: 1015004 - protein, 73 aa, Homo sapiens
SGPTASDAAVTSSAYCPSQCLLSAPRPTVAKPLETVMPARTLAWSLAFTGAFSELAQGVSMDSVGALPNLPPF

SEQ ID NO: 1015005 - protein, 83 aa, Homo sapiens
MFLDVAYEAACLEEGVLNPETTVVAIFPSPMMYAGPTEVQWHCRDGWLQGANFYIGRDPAGKPHPETGKDLYEPSHGAKVLTI

SEQ ID NO: 1015006 - protein, 110 aa, Homo sapiens
MGTSLSPNDPWPLNPLSNPADHAPATSVGAGHCACGPAAAEATEAAAPVPGPFAWPLIGKRGGGCAATSRAWRGLRRRFPDPCCPIVVLEMERAIHQALVQAMGFPNRVS

SEQ ID NO: 1015007 - protein, 43 aa, Homo sapiens
GWAWQLVLHCRPPTVPVPRPAGPNVAPSPPPEAPPNRPAHFVN

SEQ ID NO: 1015008 - protein, 65 aa, Homo sapiens
AGLRMAPMLNLVLKPHFHKDWQRRATWFNQPARKIRRRKARQAKARRIRPAPRSVPIRPIVRCPV

SEQ ID NO: 1015009 - protein, 56 aa, Homo sapiens
SSVTDLIVQDGQEAPSNVYSCSMDGMVLVWNVSTLQVTKPFQRDEVPDVHQTARRS

SEQ ID NO: 1015010 - protein, 126 aa, Homo sapiens
MPDPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 1015011 - protein, 126 aa, Homo sapiens; identical to SEQ ID NO: 737452

SEQ ID NO: 1015012 - protein, 106 aa, Homo sapiens
MRIVVLVERNKVVLMKLVSAPNRQQPAPSILSRCVSYDGNYGRMYVVVRSGPPPVSVISRPGWSTPPAWMYCFPPSLSVVFFPSLTRNCLSLHNNCRRTVIPTRDI

SEQ ID NO: 1015013 - protein, 275 aa, Homo sapiens
MLRRAYLNNCLNRATALSRRCCSFPGHTPWATPVVGPRAHLKIQGIPGPHVPVSAPWWGISQPGSFKVPPKVPSNMGTQFGVHNIDPAAKGFPCVRGHTTPLWVIGPSLGCRPLGGIFMALDMTTGLLGGCHFLWCHTNAPLLGHASFQWGPPPQSKAALGVAPPPLARALSDDGNPSECLIALDSEDTAPPLCPPRPGTPPRFSPNRTHRPSALFPPRQRGTPLFSPPSDGKALLLRFTPRRAFYYLGLPPSNWASRFASCEKHPRGGRVEASN

SEQ ID NO: 1015014 - protein, 126 aa, Homo sapiens
MEFAGEPCPFLPLSPFPVPLHLKGKSARGVSQHRHHRCAVSPGACSGALSALGQFLRLSAGLGMRGCRARPPAADARGGAGQRLRTADCEVRVRGREGSEVRGRGRLGGYSLSSTRSALLEHSQAR

SEQ ID NO: 1015015 - protein, 112 aa, Homo sapiens
KSFQRLMKKAQKLLLSPGMIANLVRDGCACIPPSLLVGPIPFFLSSRKPGRNLTIPIPWDGVMPSLETNEPPSGHDSEEPLSYFIGITRKTVTKHIMFATGIYLGFVFYSIS

SEQ ID NO: 1015016 - protein, 56 aa, Homo sapiens
LSSRSFRRLASSALSSPSHGQKSSASSASVDSTPAAAAAPAAQAAPRLPSLRLLVL

SEQ ID NO: 1015017 - protein, 128 aa, Homo sapiens
ALCPSPQPAAQATIGSPLSQGFREHHAHKPSWRDGSTNTSAGVSRSASLPISPAMVTRSCRRCCAIKSCTRRTTAGSRSKLPTYVRHARSVEFASASISTSWTLREVSVATVSRQGGVTRARIRRPPP

SEQ ID NO: 1015018 - protein, 62 aa, Homo sapiens
NQVGEKRSRKAAHNASDTCAAVSFHVGRRAPFSQAASPITPRSGVRQNLAQRMRSASRTHRG

SEQ ID NO: 1015019 - protein, 121 aa, Homo sapiens
RIPPPPYPPPKISHCTQTGSMASIRKSTTPCMRTQVVEQDVPEEEDRAEKGIGTPQDVAKDSWAAELENSSKENEVIEVKSMGESQSKKLQGGYECKYPYSTQNLNEFTEHVDMQHSNVNS

SEQ ID NO: 1015020 - protein, 72 aa, Homo sapiens
MALAAPRSYHPHPGNVCINCPFDLHIIKSGYKYHCRTASELLLWAHTCRAALLCKSASAASQPAASIKVANT

SEQ ID NO: 1015021 - protein, 63 aa, Homo sapiens
YDLPSGQRFCLGQLNLEQRSESVRRTRSKIGFGILLSKEPDGVWAYNRGGTIFVNSPELVPAV

SEQ ID NO: 1015022 - protein, 315 aa, Homo sapiens
STKTPAQRRQHSKVKRRTVPSAPEEKTKGWGGVENDVQDSQIFGYSTCPFSTLTGTSKGFCRRSLYTMPWQTMKLPSSEPDAKSGYRGWKATARRAFLWCLSILYGLVEKSRSNHTTLLSKLPQMTLSPAGCTARLDTHLQLGISFLVSSWRTGGKGGRCAGTPPTGRAGQGGRPLAAPVRGCGGTDSGCGDGSTGESPPGCGLGWPAPRPGSPHARARSPAVTGFPWQMRSAGLLWRSSSEASSQRAGCKGGSSGGTKRSTADLCCPPPAGPPELGSAAAPSPPRLRHQADSGAGVPGTLFIHAPTGTVSHSGS

SEQ ID NO: 1015023 - protein, 72 aa, Homo sapiens
LGRGGGRGGLLRWSPRGPERRDKQSAVWYSRCRAFNLRAGCVFSARGARPRGYRSRVGTNRLFGETTPEPPA

SEQ ID NO: 1015024 - protein, 104 aa, Homo sapiens
GCLKRCSEPERYCLARLMADAYAACVPAFHGVEREYLQLQLLDGFDGPCVLDCKMGVRTYLEEELTKARERKLRKDMYKKMLAVDPEAPTEEEHAQRRSTKPRY

SEQ ID NO: 1015025 - protein, 42 aa, Homo sapiens
IPEAVSDHQHCCPQTCVAEGQCQRGSEIVAGLEKMPARRVSL

SEQ ID NO: 1015026 - protein, 98 aa, Homo sapiens
FLKKIEYIYTVSPHLTSIGRVFETVTLSNVYSRSLNNIGYNIDEGQTSVSLYIVLLKVTVSKNLSMTLNEDFVYIQMDSLSESLDIDYNVNSNHHVIS

SEQ ID NO: 1015027 - protein, 156 aa, Homo sapiens
MPARRFPFIPPQRHRLQPSTPAARWTLLPEPGWLGLLPVAPCCVLRGSQHCAGYTCNVKARSCEKEVVSAQPATFLAPSPHVGVKDVECGEGHFCHDNQTCCRDNRQAWACCPYRQASVVLIGATAVLLASAAQGVPSVCAGRPRAWERPFEGTQP

SEQ ID NO: 1015028 - protein, 104 aa, Homo sapiens
KLKSHDWLSARGARKPVDQSKSQNLKNREADSVAFHLWAKAKEAWQTTGVSLRVRKLKNWEADVQGQEASRRQKDEGQKTQQVCFILAALVSDLDWGPPKIWWV

SEQ ID NO: 1015029 - protein, 193 aa, Homo sapiens
WAWIARENSHAPTESTLAHTFLQRLKFSPKAFPRLVTSLVENLSPRASPQPKWSLPGWRRRLQASELSRNWTLLGLRSGLLPPPRRPASEQGPEGCRAIRSGPLRPPPQGRLRARGCNRGDGSLESTHGLDEVSREHELLEEPMRVVGACPGLGPSALLQAAGGDRVPEPIATPRQRAGRDLRHAVVAGGTRS

SEQ ID NO: 1015030 - protein, 58 aa, Homo sapiens
GHWCGPDGAHSALCRRRPCWLGLPWAHRKFWVEQNRLNKPTALQPRGAHLPPQLWLPP

SEQ ID NO: 1015031 - protein, 50 aa, Homo sapiens
QLKQVEEPSPQLPADRLSPEFVDFTAQCLRKNPAEVSYLELMEHPFFTLH

SEQ ID NO: 1015032 - protein, 131 aa, Homo sapiens
FSSTPAWMFKNVYLGKLGVLVRRKSTCGKPLLEYHVPGLCGCYSVCASPAVGIAPAWSACVSNLICPHSDFPHDSAFTVGSSLVPPLFKAVKEENQRQTLWTVKEKGREFPGNSLTQGCKPVYYIYIFPLN

SEQ ID NO: 1015033 - protein, 47 aa, Homo sapiens
PVGRVQKCSVKATTQGLGQARRLYLAVLEYLTAEILELAGNAARDNK

SEQ ID NO: 1015034 - protein, 49 aa, Homo sapiens
PGLQKEKVQEEPIPQEPQWSLPSKELPASLVGLQPLPAHQENGFSTGPS

SEQ ID NO: 1015035 - protein, 102 aa, Homo sapiens
QEIKQRIPKPTIGSMEGNLRWSKKCLLKPPMGKPPKPCGITAKAVLKRKLYSNKCLHQKKRKISNNNLMMHLKELEKQEHTKHKISRRKLDHLNNKDQRRTK

SEQ ID NO: 1015036 - protein, 119 aa, Homo sapiens
KLGNLWKPKPNWKINDERAVEESPPSLAAPQPQGLEDEGEGQQDADGADQVPGLARAVAGAAAGGAVGLVAHERCAQVATWPSSSKCPPRELRRRVQVEQQVGEPHGRAQVVEEVPTAE

SEQ ID NO: 1015037 - protein, 104 aa, Homo sapiens
PSLCSMIRAAARSLADAAAEGGPGAWGPEPSAHVPDHGGGRAAYAHVLALPPGAVSAPAEPPAAAAAAGATVAAELISCRPQGPPCLAPPPSHVPPSPAPNPRC

SEQ ID NO: 1015038 - protein, 44 aa, Homo sapiens
MCDPKKTPAKEKEAVRAPEKELPSLRVCVGGRGCWFQCIKSWTA

SEQ ID NO: 1015039 - protein, 149 aa, Homo sapiens
HALTPGADGGDASGLPSVDGRSRYDINPLRVYIQGDSNLRTSFGPSPEPSCVLRLLSASGSAWTDGVPASKRDPASWEWPRRRTWTSKSAAPPRRGHEQSQTEAKGSAEGLEPAGRGRRCAVGVHWELTPSHVAGKRRRGRRSGRSSGR

SEQ ID NO: 1015040 - protein, 79 aa, Homo sapiens
AFDVLGFPALVSYQGPHLHSEATKLEAREPCTGSLTPADVAFTVSYSTFEWEADIAKLEDFTFTHTHTIPLEQSEDRVR

SEQ ID NO: 1015041 - protein, 110 aa, Homo sapiens
MASSRCYNCSSVVILCQEQLQRYPEPFPPHWRYAFTGSEPSPVDPSPPGPPILQSPHRTSRAHGQPIFRDIPSSRPHSNASSLQSQFHVSSSYEGICSHWYLLIIICPRT

SEQ ID NO: 1015042 - protein, 154 aa, Homo sapiens
QRTFPILHHVSSQSRALELAQWWLPHHRLGRQAVIWESPRAESGPCGRVGVLRFWSTEFSPAYVFSGKKEKLVPLAFLVGWPGSVSVWPKGGANRTEKGAHTDSTHSSSPLRGWRRRVLCGFGLSWWLNRMAAVLLTVLGSLECTPKEGISSDE

SEQ ID NO: 1015043 - protein, 148 aa, Homo sapiens
FDAEMVPYCGKEFRVRAVIDTMIDEKTGKITETQKSLRIFGGGDLPIEVFQLQNKLPAHDSSLVAVKSGSSESPKMGGPVATAKDANGQGFDAHRRSIDVQRLPVRRTSSQIAKKAPNGAPRIWVSQLYLTAAFAYGEGGIDDAFRQK

SEQ ID NO: 1015044 - protein, 52 aa, Homo sapiens
PDSRLTKLEAEYRGGPHAASLEGRPELPAPGLRMLYPWLQACQMMPEALSLA

SEQ ID NO: 1015045 - protein, 100 aa, Homo sapiens
FGEFPAQRGLKLVSAGFQTAEELLEVKPSELSKEVGISKAEALETLQITGEVSQIQDMLVTSESHKKCALELLEQEHTQGFIITFCSALDDILGGGVPLN

SEQ ID NO: 1015046 - protein, 117 aa, Homo sapiens
MVLVVISDWEELLHLRPLNPGGQTVPRLWQLCRVKNHLVMAEVPGRNNVGNFIYNVCPLQQTSTPTPTTAGFNSALAENLQSSETKQPQSGQAHVSQIPLELLLCWLLLAFLLHDFF

SEQ ID NO: 1015047 - protein, 41 aa, Homo sapiens
VAPITDLKLYASAFSERYLGMPSKEESTYQAASVLHNVHGL

SEQ ID NO: 1015048 - protein, 132 aa, Homo sapiens
PAPVRWGWGPKNLKRPIPVRFEKVLRPLRMVLKAQSCLYYQVLEPHPEALFLWAASKEGSWRGRWMGSLDMGQDKAWKKGFSKTRSLKVTFLQGFAKTCRSLMVPCFHPLAIFYGIRTQMGLLFSFVCSHGV

SEQ ID NO: 1015049 - protein, 57 aa, Homo sapiens
VIVRAERHHVRFLNVPGGGYRGPRKDIWTPLSPTRPLQQASQALSSGVQTVVHSRYH

SEQ ID NO: 1015050 - protein, 36 aa, Homo sapiens
VDYTELGLQKLKESGKQHSFTLSLIIIISVSSDSCN

SEQ ID NO: 1015051 - protein, 64 aa, Homo sapiens
NEFLNGHVKKYAGGVAEYRASEGDSGGPFIGDVDIPSETSRGDRSTVPMWEQLSQELSKEQQSE

SEQ ID NO: 1015052 - protein, 58 aa, Homo sapiens
VTTVGPSRDGTISEDTIRASLISAVSDTWDADEGGHDRAQAELNDLTHRRRPYNGSQT

SEQ ID NO: 1015053 - protein, 46 aa, Homo sapiens
LTFYDIAMTPGWLVLAIAMVRFDMAKDTQRFIYKYSEDTSIFPDIC

SEQ ID NO: 1015054 - protein, 56 aa, Homo sapiens
GQQAHQPSEKQNDAREFVRPVRPAENAPLANRIIRAQGPRIHPDETVAQVDKVTGK

SEQ ID NO: 1015055 - protein, 57 aa, Homo sapiens
DKAASGYRKKLLEHKEIDGRLRSKGQFKDLPSSIKGLKYFRPVRDLADCGKTYSYLE

SEQ ID NO: 1015056 - protein, 36 aa, Homo sapiens
GAETAAARKAKNQPDQEGEVCSTAKLHALRGTDQVM

SEQ ID NO: 1015057 - protein, 75 aa, Homo sapiens
DFAGHDNAVQPVQGLHLPPAALHRRRNEILVLEVPASEMQQVTVLVGITPCHASTLTQALQRRHVVNCPPLTGGT

SEQ ID NO: 1015058 - protein, 51 aa, Homo sapiens
KKERPVHRPGSGQRWPAQQVCPESAEGSSHNTQQALVPSSASWEQFSFQPL

SEQ ID NO: 1015059 - protein, 58 aa, Homo sapiens
CKCKPIRSYTEGPNFRNNYNYVIVAKVKEIKTKCHDVTAVVEVKEIKSSLVTSTDTVT

SEQ ID NO: 1015060 - protein, 99 aa, Homo sapiens
IDEKGQVCLPVIRAENWKPATTTDHVIQCLIALVNDPQPEHPLLADLAEEYSKDRKKFCKNAEEFTKKYGESDLWTKICHDWFQPAVTRDPVQCIQTPR

SEQ ID NO: 1015061 - protein, 54 aa, Homo sapiens
TTSPTSESGPNQQFIQQMVQALAGANAHSCRFQRSDFSTILDQFTALGFLTREA

SEQ ID NO: 1015062 - protein, 48 aa, Homo sapiens
HEQDIVQYNTYMRHTSQQQQQTHQYQQRRQQEAYAAPDRGVPPLPEED

SEQ ID NO: 1015063 - protein, 53 aa, Homo sapiens
DGMDDIISQESSLDMEGNYKKAQRNERESIRQRLALGSFFDDAQEFIPPVAKG

SEQ ID NO: 1015064 - protein, 49 aa, Homo sapiens
GFLAPGARSNIQYRSLPRPAKSSSMSVTGGAGLDLALLAAGFTQGFLEP

SEQ ID NO: 1015065 - protein, 42 aa, Homo sapiens
TVKSLSQCVLRLPRLIRLNNVKLALDADDMHANVMKKKSLSK

SEQ ID NO: 1015066 - protein, 53 aa, Homo sapiens
SCRSWKRGVRELESELEAEQKRNESGEGHEESELRIKELTYQTEEDRKTCCGC

SEQ ID NO: 1015067 - protein, 76 aa, Homo sapiens
MQPVQAPASFGGAQTGKAEGMSRYKQAAGLKNAGETFSEGDDHLVRTDESVRTYRDVQGRGNHVLERPGVRAVTKD

SEQ ID NO: 1015068 - protein, 48 aa, Homo sapiens
MASRKKVPALLPPLQLHAAQGKGKGKGGSGDQAVRSQIDACVLRYQHY

SEQ ID NO: 1015069 - protein, 49 aa, Homo sapiens
RQQEIEEKLIEEETARERRIVAKRVEEELKKEDEFNGSLQVESQTIMKA

SEQ ID NO: 1015070 - protein, 94 aa, Homo sapiens
SWDKDVYPEPPRRHAGSAQSHLHESRPHRGPTRDPRERIYRAGNGKEQGITTTGSTAACQTSLSSREEDIMFMYEEIQWKRGLQSRRNSRFMPG

SEQ ID NO: 1015071 - protein, 48 aa, Homo sapiens
MNKDAQMRAAINQKLIETGERERLKELLRAKLICGWKDQLKAHCKEVI

SEQ ID NO: 1015072 - protein, 146 aa, Homo sapiens
KRNHRHAAPDEGGQSRCRGSAHPTKRPCPASVNRPSQVPPGPSVTSLRNTWRLLPERARVSTEPAEASCLPSCRAGSTTAEAQHLQGPAWGPPMPGLFQLRSAHGSHGAAAKAMVQSKCLPRCQARTLQGATAHAGLLLAPQGGGR

SEQ ID NO: 1015073 - protein, 71 aa, Homo sapiens
EILKCGKGLVAACLKSGMWKTLPMQLTLPYVASSLRDCATALQPGRQIKDPVSKKKKKKNLIGIQNHTTIH

SEQ ID NO: 1015074 - protein, 57 aa, Homo sapiens
HLQCNMVANSGSYQLRDSLSCERYCCFLTENGRNQLPPRCPVQIAYLERLSWVHGSR

SEQ ID NO: 1015075 - protein, 53 aa, Homo sapiens
LCEGVWLFAKGDLALQIESIAVYHTLAAAGSSSEGHGSFSKLALFQWSIICVV

SEQ ID NO: 1015076 - protein, 45 aa, Homo sapiens
QALTCNLGIVTHFLNALGLFTSYHLSVHLSSLLRLRMLVFNSLHF

SEQ ID NO: 1015077 - protein, 37 aa, Homo sapiens
AITIVWSGAGPASRLLPSLGPRTTEPPDPHAVCLSEA

SEQ ID NO: 1015078 - protein, 57 aa, Homo sapiens
AVSGAAQGALSCDQSLKFKDEAWLPCSGFVTYLEGKHNAFTGRVCPFLLGVLTCILC

SEQ ID NO: 1015079 - protein, 34 aa, Homo sapiens
SKQKIVEVLLVCNLGTWLKKLITAKCLCFVPLAV

SEQ ID NO: 1015080 - protein, 47 aa, Homo sapiens
TWYGMCKWFAGDDVPEPCSFLLRAPRHRAAKKAKARGSHWGDEPRAS

SEQ ID NO: 1015081 - protein, 44 aa, Homo sapiens
VTVTRLELGRFCLCAATQASASSRRLQELDSTIGLQRYNHDETQ

SEQ ID NO: 1015082 - protein, 81 aa, Homo sapiens
ATVGYRNKNVRQKTWRPNHPQAFVGSVREGQGFAFRGKLKYSKVTGIATEERGQRHWISFTDRYQISEHLFWLGRKHGGSR

SEQ ID NO: 1015083 - protein, 101 aa, Homo sapiens
PAATSASHQALRYLRLKYLSYFRICPRKPFRLGWSLSLLPLLTELLEVNRRLRLGLPMPSKSKVPIRGLCLGGRPHLGIFLFLHQWSFLAPLRSKRGGGGL

SEQ ID NO: 1015084 - protein, 59 aa, Homo sapiens
SEMSGRGKQGGKRARLSRARRAAAVPRGRVHRLLRKGNYSERVGRRLVYLAAVLEYLTA

SEQ ID NO: 1015085 - protein, 106 aa, Homo sapiens
ERLSPSPSACTAVEPSPGLDVTIMYKGRTVLQKVVGPSCTFLYGPPDPAVRATDPQAPQPLHPSLPAASELLTPPSSTESSSKVSEALAWGAVSRGSLGAPGLPGT

SEQ ID NO: 1015086 - protein, 87 aa, Homo sapiens
LHATCFAALVKGAAQPEKERSRETVACVLSVAIVLLSDKEAPSTPCDLELEVEGLGVLLPEPSALSPSSPFDSLQIGTQNSLELLED

SEQ ID NO: 1015087 - protein, 30 aa, Homo sapiens
MAARNPNKDPENSRAFKVLIAAQYSGGSGT

SEQ ID NO: 1015088 - protein, 65 aa, Homo sapiens
MGKVRVGVTGFGRIGRLATRLAFTSGKVEIFAIKYPSITSTQWLHVPIYSPMANSMAPQGLEREL

SEQ ID NO: 1015089 - protein, 49 aa, Homo sapiens
ATEDPGVAMGAARQLFTDCKNKPYPKSRFCRGVPKAKIRNFDLERKKAK

SEQ ID NO: 1015090 - protein, 73 aa, Homo sapiens
LRRSLAAWRTPGILAPAGGTTRRVLRGSRGLPFPDKLRIPCIGTLLLELDKLADICSCISEMSVTDSDSLGTN

SEQ ID NO: 1015091 - protein, 57 aa, Homo sapiens
LLPLLKLSQSEGFKGQEGSVERCPQPQKRDPHVTHFRAETLRLRDSPISSESVPGEQ

SEQ ID NO: 1015092 - protein, 44 aa, Homo sapiens
QYAYQDLSVSWLVAEGEQRPCLDIEEVVEEYDEVGAGGAAVKEQ

SEQ ID NO: 1015093 - protein, 35 aa, Homo sapiens
ELGHLHCSLLLHKIHEESIDQENFNLQDLSRYTYC

SEQ ID NO: 1015094 - protein, 47 aa, Homo sapiens
MSLVTAKHGRIALQKITEMNQKNCVGVSEAYEDDPNGLLSDELNCQA

SEQ ID NO: 1015095 - protein, 67 aa, Homo sapiens
DWFVSVPIDSLGLITEFFGLSCSRHTVPNVAAGQSTLFRPGHDGGPATGTMSSVVWNKLTRSILLDL

SEQ ID NO: 1015096 - protein, 54 aa, Homo sapiens
MLSFSLTLSEVQGSLYEEIHIYEEIRLEQSPHRSRSRGALNDPFKAYSRSKLVF

SEQ ID NO: 1015097 - protein, 48 aa, Homo sapiens
VNRKGAIVIARHAHEQPEQCSGAFVEVCRVAYVSLTYCRKIGRDCRCY

SEQ ID NO: 1015098 - protein, 34 aa, Homo sapiens
TAKNYFKKALKDMGYGTGLATPGGKTFYLPIIVS

SEQ ID NO: 1015099 - protein, 72 aa, Homo sapiens
EAAAGAMFGREGGKKKPLNSPRSRPRRMDEEVKDFKQKQKEAQKKLEELKAKPAGKAPCTSVLVSAIVALLL

SEQ ID NO: 1015100 - protein, 36 aa, Homo sapiens
MPQLCSHSLRFTSQFGLFIGSYDIKELFQSLRSIWS

SEQ ID NO: 1015101 - protein, 49 aa, Homo sapiens
MLFSIATTTTTTKDSENNSNKDDVGPYEKRDKLYEILRGPHEAEPVASY

SEQ ID NO: 1015102 - protein, 59 aa, Homo sapiens
NRITQAPACWSVLGGTDLGVYRWLTPGNPSTLGKPRLGGSLEGQELKTILGNMARPRLY

SEQ ID NO: 1015103 - protein, 49 aa, Homo sapiens
PSRQVTEAVKVALTSGTHIDCAMCTDEMSGVHQRAQEQCELELLIVTAL

SEQ ID NO: 1015104 - protein, 51 aa, Homo sapiens
RHTRSPCLGYGRRNRMWTMSLDYEDDEGGDSSWGDGLSPAQRMSGLLCLHP

SEQ ID NO: 1015105 - protein, 136 aa, Homo sapiens
PGKHILCGTPGSSDDKAVEGKYNYNDEINTRKFLSGCSYRNKGVQDLSLLQLELSAASQKGWLSYTVLWGGSCLFWFFVLFCFVFSEMESHSCCPGRSAVARSWFTATSTSHVQADSPASASPVDGDYRCPATTPS

SEQ ID NO: 1015106 - protein, 41 aa, Homo sapiens
WYHHTGRMERSAHTFYTELVCSEQHPPAHRAPLSPGQPESS

SEQ ID NO: 1015107 - protein, 45 aa, Homo sapiens
KTAQAIKGYAYTKSHEILKDVTLQKRVYLTSYMVALAVYTDQHGT

SEQ ID NO: 1015108 - protein, 45 aa, Homo sapiens
REAFWLERRYNPRVSGKSQALFQVTQWLTSLETPEEEESEEELTK

SEQ ID NO: 1015109 - protein, 54 aa, Homo sapiens
MGALLLLLLGLAVLVHKHYGPRKCCSGKAPEPQPQGFDNQAFLPDHKANWAPVP

SEQ ID NO: 1015110 - protein, 51 aa, Homo sapiens
RELKTIFQQSDFSTFQKISTLLCKGRTVIVKGPRGTLRRDFNHINVDLSPL

SEQ ID NO: 1015111 - protein, 83 aa, Homo sapiens
TLRLCSQDDQSGETAAPQVSYTRDIMLFGSWSTYDMQINDIALQASITLTLKYTKYLPHSSGRYAAKRFSELSVHCGSSSLTS

SEQ ID NO: 1015112 - protein, 42 aa, Homo sapiens
PIPETMAPMGLEPEGVHSRGNLELDFFTSFIDMNLSESLLPW

SEQ ID NO: 1015113 - protein, 31 aa, Homo sapiens
QAASTSTYNGPSSVGSFIGTTSDAPCPPCYR

SEQ ID NO: 1015114 - protein, 37 aa, Homo sapiens
CPCNLPAGIRHQVNRQSSGRPTAPNPVAAFPPSSSAL

SEQ ID NO: 1015115 - protein, 40 aa, Homo sapiens
DGDCACSSCKGVIDYAVKIRVSLTEPLWSQMVLALQNPFE

SEQ ID NO: 1015116 - protein, 46 aa, Homo sapiens
MNAPYLYALEVNEQTTTSEEKMVIDVLPPGRRKKLSTELGQNVPHV

SEQ ID NO: 1015117 - protein, 62 aa, Homo sapiens
IPARIGRARVPQWKAGLILLPLEEFILRHDFPVKLLSEGVRIRTPQRGSWISLQEIGESTVN

SEQ ID NO: 1015118 - protein, 70 aa, Homo sapiens
KSGPQKSSIFCPNVPIILVGEEEGSSDDEHTRRELAKMKQEPVKLEEGRDMANRICAFGYMSVQQRQRWS

SEQ ID NO: 1015119 - protein, 53 aa, Homo sapiens
MVKETPQAAGKISSYAFSCRLPGEHRGTPDFPSFADFQSFEMSHSQGERFSLQ

SEQ ID NO: 1015120 - protein, 63 aa, Homo sapiens
MTETAFGSAYKTNGHVSYRWATLQGFSHQADGTSPKHHPNFVRCIIPNHERRAGKLDPHLVLD

SEQ ID NO: 1015121 - protein, 64 aa, Homo sapiens
IVSATSPEEKNVPVCRLPAKSCCSLPKDEDYKQEQQKKAEVERKDLTEHADLKMKGTLPTRNSK

SEQ ID NO: 1015122 - protein, 41 aa, Homo sapiens
MNVDLRGQGLRLSLRVHACEGCRGFYRRTIRLKLVYDKCDP

SEQ ID NO: 1015123 - protein, 48 aa, Homo sapiens
STLQPLQVGLQLVRYNNVFHNSNFHRAHTTGSLLAFHLHSFRLLLAEA

SEQ ID NO: 1015124 - protein, 70 aa, Homo sapiens
WCRMAAPAVVTGIVDKPYQSLASAEVSFMPGFAFLTWGGKAKVDEFRFVATWCQMYMRSCSLSPGAPDLS

SEQ ID NO: 1015125 - protein, 42 aa, Homo sapiens
MPSHFYTRHTYTLIPYYVIIEPSAYLFKPIALAVRLTVNITA

SEQ ID NO: 1015126 - protein, 41 aa, Homo sapiens
IPENRNGLKNNLPNFYFFKMISISPPPEMYTSLETPKLHQS

SEQ ID NO: 1015127 - protein, 35 aa, Homo sapiens
EDEDVEGDEDDEKSVRKKKNFDFMKEDLRLGLGCR

SEQ ID NO: 1015128 - protein, 95 aa, Homo sapiens
MTMRLLEIRLTYIYNTDQSKDSLVDVPFPNSYQYIAAVDYNPRDNLLYVWNNYHVVKYSLDFGPLDSRSGKFNLLWYSLGKYLLFVLSKFILCFY

SEQ ID NO: 1015129 - protein, 44 aa, Homo sapiens
ARGEAEAGYPLVINHALPHYLTLLDQGLDPELALLDTLLLLMAI

SEQ ID NO: 1015130 - protein, 357 aa, Homo sapiens
RTGSHRRAHAPERGRENAAQVSSPRARHQRDRPAPPDRSRAGSSRPGTAGASCLRGSDLGLPRGLAPRRRECAAAVAAQWVAGVSSSSSLSASDGSRGDARKGLGGPEAAASPDRLTALGGVHDCNPSAWVIETNEGTLRLYLATSEQASGKQQECDATNHEVAWRLLQRCNKRVVALAKPRFRILTEHTVIGFDKPSLCITIKPLETGDWLSRDGRGESLLFGCPLLTRMCVCPYLEDPSLVTPEVKAMWIVELNSYLFDRTELGSQDGDNQLTALRPVGDEKAVANQYGVGQIPRYNRLEFNAKVDARISKAVARYTTGEPEIGSSIRNENHRKSELRHWYRTRAKGNWGARKRN

SEQ ID NO: 1015131 - protein, 80 aa, Homo sapiens
ERDHLSFEQELTPSPLLEEQEVQLCVSTRLGSFEFFSSRRPSVVIRVALRIIREGSLDSATEVRTMPSHMSTEDKFLLVV

SEQ ID NO: 1015132 - protein, 46 aa, Homo sapiens
DLGQLQSPQNWSLLSRQDLRASGGKPPAPLENAYLSSSLTKRRSLP

SEQ ID NO: 1015133 - protein, 138 aa, Homo sapiens
LQEFGTRLPGAWERWQQGCKEALYRRNLVESELQPPPQVRSHGRGSQESGRPDTGKSRHSHPDKQTISGQSVLDSPSSGPPARQKPWLRVLGTMPSQYVPLTQGLAGPWRILFAQPRGCPGGRPPEQGRVAWGPEGPL

SEQ ID NO: 1015134 - protein, 68 aa, Homo sapiens
RRPSSSSSSSSSTFRSSNSSNNSSNNSSNSSTLKGLHFSASPLTIDCYFFLWQLARFLVPHMRVFTLE

SEQ ID NO: 1015135 - protein, 119 aa, Homo sapiens
LTFLGRFPLGCSSILQDYIFLGFRGPAWAYGSGFSPSFPVRETLLSDKTMPPAQDSFGFRAQEGIPSLDSPLFCYFIGNLEPTWSNNCILLRSWQLVTIQNGLLGTEITQSPWNQPGSQ

SEQ ID NO: 1015136 - protein, 45 aa, Homo sapiens
PRPYLLFSLTSEIESRDEGRLNTKTQKSLSQFNLLMNKQSQSKAY

SEQ ID NO: 1015137 - protein, 83 aa, Homo sapiens
ETHSINGEVRKISLWGQARWLTLYLLMPVSQHFGRRDGLITRSRDRDILANTVNPVSTKTQRLAGRGGVAVVQLLGSLRQEMA

SEQ ID NO: 1015138 - protein, 70 aa, Homo sapiens
QKKRKRRRRKSSRTATAFHPSREEKKKIQIQTAMTFLGDARHIIRIQARFDYYFAFQALHVPQSLSCHLY

SEQ ID NO: 1015139 - protein, 83 aa, Homo sapiens
QDQGERENPMGELRIRKLCLNICIGGEWRQTDASSQGFGAPHRADPCVFQARYTVRSFGIRGMEGFLFTAQCRAQAQNFGEAL

SEQ ID NO: 1015140 - protein, 57 aa, Homo sapiens
ARGEREVEERLQKEQEKFSVYWNEPKLDGGLGGTPKLAKLGTSGPGPSEAKNYFSQI

SEQ ID NO: 1015141 - protein, 71 aa, Homo sapiens
VEQHSTNVISVLKSSAQNLPLHGTGRFILEKDPIAPVNFGNPSSSKILPCFSKEIPIGETPIDPCLGNPQQ

SEQ ID NO: 1015142 - protein, 48 aa, Homo sapiens
IGSKTRRRDCLKAPGIIPRISVREPMQTCIKACGELGAQFVVVTVTYY

SEQ ID NO: 1015143 - protein, 67 aa, Homo sapiens
KVELQELNDHRTHRSAFWQQIDLCELRELKAKESRWGLYEEEMRDCATGGTANTTKPHTLRERDNHA

SEQ ID NO: 1015144 - protein, 55 aa, Homo sapiens
APPQLVRMMCAVLSGITCKESNARAISRLKVIVRSHLMMRHGYICEFESLMTTEL

SEQ ID NO: 1015145 - protein, 48 aa, Homo sapiens
VKVKKFNEARDPAKYFIRDEFLRISTSSGDWRHYFYPHFTSRCGHLEH

SEQ ID NO: 1015146 - protein, 43 aa, Homo sapiens
MTAEEMASDELRKLRNAMTQEAIREHHMAKMATPPLTFQVQQL

SEQ ID NO: 1015147 - protein, 125 aa, Homo sapiens
CVMPPSTVQWLVCDVQSEAHRPFSLDGQFIALTLGSQPCSWELEEHFEILRDHTLSPSLPTEAEGTGKKPGQARSYCATSVVAFLNWESWLAPGRGAISDYTQAAFLLSLYFRFIPLLASPYVKK

SEQ ID NO: 1015148 - protein, 93 aa, Homo sapiens
RICANKYMVKVVARWLPYPGAAPPLHVIRITRCCPVLELTGSKQACGVPLEAQGTVARVHIGQVIMSIRTRSRQGHVIGPRRPSQVSGAKGPI

SEQ ID NO: 1015149 - protein, 49 aa, Homo sapiens
CAEEDHWPCGIGCVQYSYESYEYCTQDSDVLRNPKMQHKKVYRPDTNEM

SEQ ID NO: 1015150 - protein, 60 aa, Homo sapiens
SEAPVFLLRPARRPKNPLRVFKLARKVSPGAILSSQCSPKKQAQAAGSKKADEKKEGEDY

SEQ ID NO: 1015151 - protein, 61 aa, Homo sapiens
QPKALRTKWFLLPLSVGKIRNRRSHSCEEDHATLVNQESEQSDDDLLPLSSPHGNPIGDKP

SEQ ID NO: 1015152 - protein, 41 aa, Homo sapiens
MISNVHCGADMWLQQMQQIRMSLRGKAVCLWQTHMRRHQAL

SEQ ID NO: 1015153 - protein, 66 aa, Homo sapiens
EEKHAVNSMWSKMNVESMEVKHWQHHSCFPWPKRFFDKFENMKDPDAIMGNNKVKAMEEGHDIHLE

SEQ ID NO: 1015154 - protein, 58 aa, Homo sapiens
MSKLKPPCPRKPKGKAVKGRLNLPMCDAETSGLESWEGGKPYQDSCKTLGPLTWLPYL

SEQ ID NO: 1015155 - protein, 69 aa, Homo sapiens
MARGPRSISSGCSSKHWMLDNDRCVCSRPSTVPTGERVSPLIIFWGQTEYALTEMSKKIACAVHKMMAG

SEQ ID NO: 1015156 - protein, 36 aa, Homo sapiens
ISTILFGAAYTCLEAGHQLERKPTQQAPVKIEPGVD

SEQ ID NO: 1015157 - protein, 81 aa, Homo sapiens
PLQSLQQRTWLIHWSLFVSSFTPKVAINIIDLSLYHATISQCNSDNCVTQSSVFDYSSHNNKVVGTSAGLKASKVFTGASN

SEQ ID NO: 1015158 - protein, 68 aa, Homo sapiens
QSHLDQNSDDITIEEYGEFYKSLTTDSRDHSAVSIFQLRTVDSEPFLLSHASPFDLFEQKKDISMYFE

SEQ ID NO: 1015159 - protein, 148 aa, Homo sapiens
MHGVVHTNLGPAQRSSQGPGRKMVCSFPLLLSLSSRALNPWQHKFFNHGNVQASRPWQVSVGCSSQHQKVVSRKKKSPSFPHHHPSVGWFHHLSHPHTSNAAGACWALVLVFEGDHHNISVPCATVKQTSTPLRARPPCSCCQATANE

SEQ ID NO: 1015160 - protein, 30 aa, Homo sapiens
MGLGGRAKDALPNSGDPQEDPLTTVESMRA

SEQ ID NO: 1015161 - protein, 56 aa, Homo sapiens
DSFGEVACACRDCIPETMAEGDNRSTNLLAAETAGWEDQLHEWREVMLIADKVLRW

SEQ ID NO: 1015162 - protein, 86 aa, Homo sapiens
MAVGKTSALTKGGKKGAKKEVGVIHFLERLVLFKHLYVQYRNIGRRSSPGPGTKLHLMSQGRVFSESADLQIDELHLEIQRITRCS

SEQ ID NO: 1015163 - protein, 73 aa, Homo sapiens
IQRIRHEVTPITVVKQGFEPPSFVGWFLGWDDDYWSVDPLDRPWLSWLPEEGQAHPMYPFSAFGLSFLKRPYE

SEQ ID NO: 1015164 - protein, 46 aa, Homo sapiens
MGGQFHPGMLTREPRSPWALLLRPGPAAVARGASAEKRDEAAAIAV

SEQ ID NO: 1015165 - protein, 32 aa, Homo sapiens
MNDGVYGSFASKLSEDLNTIPEVHKKYKEDEP

SEQ ID NO: 1015166 - protein, 50 aa, Homo sapiens
MPKTFPTALAASAGSLTNKVAPSYPYFAGLRAPKHSPRSEEVRGTMSVQL

SEQ ID NO: 1015167 - protein, 115 aa, Homo sapiens
GNHSSTQYPDVNHAKVKLQGKEVGVYEALKDDSWLKGEFVTLCSSVALCPSRLGKLSSAMSAAKAICDHVRDIWFGTPEKFVAMGNPDNSYGGPDDLLHSPGCNPLRPGKFSPPN

SEQ ID NO: 1015168 - protein, 49 aa, Homo sapiens
TVLQTAAPGPSTCCIDSMEVLSSCPCGIDSNGKPADAVYGQKEIHSKVM

SEQ ID NO: 1015169 - protein, 55 aa, Homo sapiens
GAGCGSSLPDGLVLSLYALHVKAARPGTGLPRCTWAPHQLFARLLLQVGQGFRAG

SEQ ID NO: 1015170 - protein, 63 aa, Homo sapiens
DYTVFDRDNNRVGFATAARLYVPKASARTETEESPRAGGPCHAAPTHTHTLARPLSWAPLTRG

SEQ ID NO: 1015171 - protein, 69 aa, Homo sapiens
LLELPTASVPSASLAEWASAPSGHHQIPLFPRPRMGPHGQTCARPMCIPPSYADLGKEIFSTKDLVLGW

SEQ ID NO: 1015172 - protein, 160 aa, Homo sapiens
PNRLNCCLNPAGLERVIITRIFFARHRYFRFVLVINTSMLTMASLTGFSVKLSLTAGVPVNVNSQTHQMPLYRWQSGVTVKVVLRGKAGDLTEIIERDFVICRQYRGGISYRGTDRNVTFVFRVLQNRGLTDSKEIFDIAVSIKSGFVLGVESLGKCQRR

SEQ ID NO: 1015173 - protein, 63 aa, Homo sapiens
VALTVFHPLLDVTPFCIQPIIFLLDLIDLLSVLQLLHADLASLRAGRPFCSGARFRQLLRFRA

SEQ ID NO: 1015174 - protein, 32 aa, Homo sapiens
MWKSRLGSSQQVALDAVRQRVVRWKQRPSTST

SEQ ID NO: 1015175 - protein, 56 aa, Homo sapiens
PASRHSPYGLCSVCTWLTEISLVQPNKGGSALGQPAGKDQGTTQQGDPRCPAPTMH

SEQ ID NO: 1015176 - protein, 156 aa, Homo sapiens
YREFGPRSAHCKREEALTDSNCTHDATTCVVVGDGAVGTCLLICYTTNAFPKDEPVFDNYSAQTVSTGRTVNLNLWDTAGQEEYDRLRTLSYPQTNVFVICFSIASPPSYENVRHKWHPEVCHHIALMLPILLVGHQEGPEKPSLDTLNGGLKEQG

SEQ ID NO: 1015177 - protein, 199 aa, Homo sapiens
MLVVKEVKTISSSDASAQTCTSFLSPKAWDQGERDRNEPSHEEQLEERKYSPRRLEEFQYTSSLPPQKRKKSSIKKTEKKKEFPLRPEIKTKKSSLEGVLRDSELIYPGASINFISRAMAKLGPFSWQPALSRTGDGEIQGEDIRRAPQAQGSPWVPSVLGWDAQGRIHHHPTVLLPWAQEAALNTSEGPSSCDEGREP

SEQ ID NO: 1015178 - protein, 44 aa, Homo sapiens
PAEGDGKPQWRLGRMGRPAGWVNILLCGGPADRGLVRAVQFTET

SEQ ID NO: 1015179 - protein, 30 aa, Homo sapiens
MRAGTRWPAGAARRLLLWGKRAEGEGGGGG

SEQ ID NO: 1015180 - protein, 54 aa, Homo sapiens
RLPSRKPEPAGKDWLAVIFVTQAGWRRSLSCFGNSFREIRESRIKHFDLIEIQS

SEQ ID NO: 1015181 - protein, 129 aa, Homo sapiens
GQRKANAYKPQVPGAPGRTESTINFILLKSRPFCDPEAAPPRPQASPNLLAASMGPANAGCCWCPERLPQEGSGLRTRGASLVWVWIRAACLEEEASKAVRGVLLEEAKAGQNPPSHGDDHVCQRLALV

SEQ ID NO: 1015182 - protein, 80 aa, Homo sapiens
AKPAITFLSINMKKSYNGLHQRVFKELKLLTLCSISSQIGPPELTTDEKSISVVLRAPEKWKRNPEDLPVSNATNLQSEV

SEQ ID NO: 1015183 - protein, 135 aa, Homo sapiens
WLGINHPFARKIPKAPPQVSLSFLGGSGLNFTAHDYVIQITSKISASACPVSRPWMSLRLQGPSGSSVTSSGDVCGLFDRGDMKSSPGWAWRALATERTSDGEYAGSSSPGDAQVHAQRVVAEVLLPSKNPLFPL

SEQ ID NO: 1015184 - protein, 104 aa, Homo sapiens
GAPNQPPYCIFPPICHLVLHILSSCVLSDRSCLRVTAGPTSLDLDVNVQRTLDNNLATEAYERRIKRLEQEKLELSRKLQESTQTVQALQYSTVDGPLTASKDL

SEQ ID NO: 1015185 - protein, 122 aa, Homo sapiens
QPSASLLRAWWLKTVSLAERREKLLEQAGHRCFSASTLSYPLAHWPSSPGLYVSSFPVFLCLMLCVLLFESSLEEELSCMSGGMLVSAVLPVSKFSGGSLIECGKVAPLDGYKCRLLNFPMF

SEQ ID NO: 1015186 - protein, 55 aa, Homo sapiens
MTAPLILLHQRPNGNRPLLSLVILVSQAGLGLVGGVGEVYYILGMTERLPPPNAT

SEQ ID NO: 1015187 - protein, 39 aa, Homo sapiens
LFQPVAKNHESRQWSTATAAAAPAARMKAGKTASGAREV

SEQ ID NO: 1015188 - protein, 56 aa, Homo sapiens
PSAYAQQAAGGPELQGSQLPPGLAFPRGQMKAFSPVSPLEETACITAWASPGAKPL

SEQ ID NO: 1015189 - protein, 92 aa, Homo sapiens
GAFHGTPTFGTNICRVPKSKLEVGRIIELHTLWLSWLLWLEARSTLDSGLRFLVTPPPSWEQRAVPQARVGATVSMGKVAVYVICKNKIFKS

SEQ ID NO: 1015190 - protein, 68 aa, Homo sapiens
AACCEWSLRVIRGVERGAGSSARAQRALVDMPRKIEEIKDFCSQPDEGCQICQDQENEGTWDVNSLTQ

SEQ ID NO: 1015191 - protein, 72 aa, Homo sapiens
IKAAGLNVEPFWLACLQGPRNVKLGAHLHVGAVASPALVLTTGGPPLISLTEEEVTKKSQSLYNGFALLPLI

SEQ ID NO: 1015192 - protein, 103 aa, Homo sapiens
QPPTGPGRTQSQTNGLQPQNDRADRRTDSRTIGGLPNLRTELRIFALGPDLPHPKRPQPLCALAPLSPVAATASPPLSATVRASNDSPHSPHPRPPTDHRCIR

SEQ ID NO: 1015193 - protein, 84 aa, Homo sapiens
SKEFGTRAKVRELELSYDAEQKKHDEALKALANEAPCQGKSYKRQFEEAAAGQHDLAKYSQAQHELDDAEERQNGGTEAKKLRH

SEQ ID NO: 1015194 - protein, 57 aa, Homo sapiens
MESAGIHETTYNSIMKGDIDIRKACMQQCLIWRHHYGPWIADRCRGITALAPSTMRL

SEQ ID NO: 1015195 - protein, 42 aa, Homo sapiens
LLVDYTCSIPFQEFTSKSPRSQGPGIRHAHCSSNARLATLTE

SEQ ID NO: 1015196 - protein, 63 aa, Homo sapiens
MSAMHPIPKGQGFSISKNYSGDALHEIPVKKVKVAELYTYENDVRLDGVKGGMGTDSTCVCLI

SEQ ID NO: 1015197 - protein, 45 aa, Homo sapiens
MISMGFLGFYRVSTPYIYSRYSRGHTSIIALRYHNHRYPTVVKCL

SEQ ID NO: 1015198 - protein, 89 aa, Homo sapiens
ERAAGLGEGPGPAAMALEGRNEMCEGLALRPPAGLLRLVSGTDFRGCGAKLVLSQPISRGSRALCASGHHRVVSPLLCSVSLGPQETML

SEQ ID NO: 1015199 - protein, 66 aa, Homo sapiens
MSGGSADYNSREHSGPEGIGPRWCHREQLDEIVDNLMNDLKESLLVASMLTVLRGLRYSAESYYSL

SEQ ID NO: 1015200 - protein, 50 aa, Homo sapiens
NAAGGGTRARCSTKQAHVVLQRLFMFDKPDQESKRLQLYRQIVMASSAGR

SEQ ID NO: 1015201 - protein, 33 aa, Homo sapiens
MALRSQFWGFSVYRNPRYKVRSPLNQLRAGSKT

SEQ ID NO: 1015202 - protein, 40 aa, Homo sapiens
SELNISPLFEYCDYEYRESMSCYVLVMIWIITQKLSLKTR

SEQ ID NO: 1015203 - protein, 53 aa, Homo sapiens
DSSTSVAETPDIMLFWEVEHHYFQIIDIFLQEFIAVMRVFPGTFLTVQAVFAN

SEQ ID NO: 1015204 - protein, 56 aa, Homo sapiens
MPSCGPNHCLGLPTSPKAKYGALAVFSRFKTLSPPQWVEECKVFQVRWRRRTSCQA

SEQ ID NO: 1015205 - protein, 49 aa, Homo sapiens
IRAEMSRSVALAVLGVTTSFWAWRAIPATPKVQGLLNGIQQGMEGKFPE

SEQ ID NO: 1015206 - protein, 41 aa, Homo sapiens
MRLGDSSRPPRAVHARLTVKRLLYSLIHTDHDSTWVQPSSG

SEQ ID NO: 1015207 - protein, 55 aa, Homo sapiens
MADIQTERPYQKQPTIFQTKKRVLLEKLARELRGTSRHRSWLKQPRAFRTSLQNP

SEQ ID NO: 1015208 - protein, 38 aa, Homo sapiens
KNNPAVKKVLYLQSLPLANPRAFKNNSISSHHRYHQVL

SEQ ID NO: 1015209 - protein, 63 aa, Homo sapiens
VQREWPAGGGDRGKVAATKQAQRVSSNVFSILTSQIQEFKEAFNSIDQNLDASSASKPQETTP

SEQ ID NO: 1015210 - protein, 69 aa, Homo sapiens
ALANISGRLSGMANAFRTVYQLNGLAATEKHPARVIYQMPPPPFLVCYESSSTSHKRMENRAPYYKEGS

SEQ ID NO: 1015211 - protein, 43 aa, Homo sapiens
QNYHQDSEAAINRQSQTVERRTPSVRFTFPGSYYFDRDEVALK

SEQ ID NO: 1015212 - protein, 52 aa, Homo sapiens
EGRRIPNLLEDKAQLLPGQIETCLTQREWCRSNSLQRLSFRKAVARDADSVD

SEQ ID NO: 1015213 - protein, 102 aa, Homo sapiens
SHPHRRSSYPSGKALRPTGPGPGSWCYFLLRPGLMSRAVIPSSFNSGPHPGSNIAAYGEDSSRSAFTFIQQSKAHRFCKKSLHGKVHEGATMANKSSFLALG

SEQ ID NO: 1015214 - protein, 56 aa, Homo sapiens
MTAVEVRGGVHIDSYHVITRTINLPPYTLGAVYEAIFGKAKGEVYAARYKAWEGGE

SEQ ID NO: 1015215 - protein, 72 aa, Homo sapiens
IGNERFAVLRHSTSLLHWYGSAGIHETPYTSIMSVTLISQDLYATTVSSGGTLCTWYADRCRGIMLWLLDHE

SEQ ID NO: 1015216 - protein, 54 aa, Homo sapiens
DLRHDTAVTCAGYTSASCSHAPHEILCGGPASRCSRYCGGGITPVMQHLTQLAE

SEQ ID NO: 1015217 - protein, 87 aa, Homo sapiens
YEHETMPLSKGSPPSLFQKEEKEEPQGGTAWCRAPIPTFMDVKCPRLLLNSHGLLAIHNGSLVCGCSTVSATYRGKQATEMSSEKQH

SEQ ID NO: 1015218 - protein, 98 aa, Homo sapiens
YGVVLDSRRTLRGTLKLSGALNVLQIRREDVLKVLAAGPHLGGTNFDFQNGQYIFKGKVMALFIILRDLVKLFCACQCSIKPSDAVYTQICTLSEFSH

SEQ ID NO: 1015219 - protein, 75 aa, Homo sapiens
DTCDRDQDHPTPQKQMRSRLFFFRGHLQRRSASLTDFSRPTTPQKRDEDLQERKVPFPSNSLFGVFRLVRISILS

SEQ ID NO: 1015220 - protein, 44 aa, Homo sapiens
HLTTDTLPTIYPISIAIEIEPGAIDIVPQGKDEKYTTHNIARLT

SEQ ID NO: 1015221 - protein, 36 aa, Homo sapiens
GPAMVVLRFIMESGAKAARCRVLELRGQRLKCHVGY

SEQ ID NO: 1015222 - protein, 40 aa, Homo sapiens
MSVARSWVCRKTYVTPRRPFEKSRLDQELKKIGEYGLRTN

SEQ ID NO: 1015223 - protein, 58 aa, Homo sapiens
DVNTALQEVLEDCPHPRWPSTWSRDVPKALDRRQAIFVCFIHLYDAIDCKLVRPLSDT

SEQ ID NO: 1015224 - protein, 51 aa, Homo sapiens
DDEGNVIVLKASQEDAHVVRRCCSKAYHLQKSTFGKFGYLSKAKKRFNWIP

SEQ ID NO: 1015225 - protein, 75 aa, Homo sapiens
GPSLATYQVRTEAKNQLLGDIGNKVSEHCRPKCYEEEQTFSYWKVIDKNYQNLLKGTYAGAVQCLSSSDQTLADL

SEQ ID NO: 1015226 - protein, 42 aa, Homo sapiens
ARSLFHRPSHRKSDIYVCIDLLCAHMMHAHGMTFANGRTSVE

SEQ ID NO: 1015227 - protein, 66 aa, Homo sapiens
VDVLLDQADNEGRDVHTCCGPDMRCDQHASVVDGLGQASLKTLASGVSLESLSQPRCISSSAYQHL

SEQ ID NO: 1015228 - protein, 34 aa, Homo sapiens
GTRIAIMNDTVTIRTRKFMTNLLQRKQMVSRCTI

SEQ ID NO: 1015229 - protein, 92 aa, Homo sapiens
KQAEALLTAPRSLRDPAASGAGWTGIGAQSGLAVQLPVLRYSQGGQQAGLGTDSEALSLGLCCIVSLVHECDHPSSCSSVTSTLCYLDKWVM

SEQ ID NO: 1015230 - protein, 65 aa, Homo sapiens
LHEPRRPPDVHSRFLLVQVHYGTLKDQLIYNLYRRTDPQNKITVVGVGLWHGCASVSNEGLADEL

SEQ ID NO: 1015231 - protein, 43 aa, Homo sapiens
GTRETFLPMLQHISKNKDKGTYEDLVEEDEGIRKEGNGNVMGA

SEQ ID NO: 1015232 - protein, 37 aa, Homo sapiens
ERLKVINKLLVPERHGVISQRRDRLTMHSCGAGDCGD

SEQ ID NO: 1015233 - protein, 35 aa, Homo sapiens
ARVHIASIPCFHVSSHLYSHHDHKGTGIMHAAIHA

SEQ ID NO: 1015234 - protein, 44 aa, Homo sapiens
PPYYQTTLAKPCYRNKVYGDRIEPWRNRYSTAVKMKIHYQAYYS

SEQ ID NO: 1015235 - protein, 31 aa, Homo sapiens
ESNKTTMPPRSPSLRRRQPSQRQHQHQPLTT

SEQ ID NO: 1015236 - protein, 54 aa, Homo sapiens
HEKMAGEKVEKPDTKREENPKAKEGGCGWQVKKGNLKAKKPKKGEAPLQRNTCP

SEQ ID NO: 1015237 - protein, 33 aa, Homo sapiens
ARDATLSVPSVGRDTDETYCIDNEGLYDICLPH

SEQ ID NO: 1015238 - protein, 59 aa, Homo sapiens
GCLAQHCMGLITYVDSIRYFGTRRIGGAENLFEDGQGYLKEEGYPGRPNEGFIALVGKG

SEQ ID NO: 1015239 - protein, 40 aa, Homo sapiens
MRVRIHTYDVRMYTYMHMCTAHEYAAIYTLCSVQAFVLLG

SEQ ID NO: 1015240 - protein, 69 aa, Homo sapiens
ERTSRRPPETEMGAEPATPQPPLKKRARADPIRDSDEALKKRREVKVRDLGIKTTAVLGLYPVTRQMHP

SEQ ID NO: 1015241 - protein, 38 aa, Homo sapiens
PPAWMTSTKAAARAVTRRAEKMSFKGKPSTIFVLALRM

SEQ ID NO: 1015242 - protein, 84 aa, Homo sapiens
SGDDVPENGHLEKGKGKRREEQVKASDLRWLKGENVFGVCHIFESFNDTFVHVTDLSGRETIFRVTGGMKERKPRMNPTIAAIL

SEQ ID NO: 1015243 - protein, 48 aa, Homo sapiens
ESHVSVSSAKIVKPNCEKPDEFEIRISQALLSRDELDLKAEAKELKYY

SEQ ID NO: 1015244 - protein, 67 aa, Homo sapiens
HEVMEEVPHDCPGADSAGRQKGLHVRDAQPAAVRFWSGGHCDAGSRARSGDGWRRVKHRGVENFLEK

SEQ ID NO: 1015245 - protein, 48 aa, Homo sapiens
MVSHWFLVPTSLRWRDTISVMIAMWLPFPVHPVTLIVVGPGCYHGIRY

SEQ ID NO: 1015246 - protein, 84 aa, Homo sapiens
IAIMNDTVTIRTRKFMTNRYFRGNKWSLMSFTREATIPETGILGKTKPKMYQNHTDVHLVIWDSDLIWWWQATGFGMIYDSLDY

SEQ ID NO: 1015247 - protein, 58 aa, Homo sapiens
HEAELKVKRLRKKFALKTLRKARRKLIYEKAKHYHKEYRQMYRNENSGMASMKGKAWQ

SEQ ID NO: 1015248 - protein, 67 aa, Homo sapiens
VQNVKLDFFFHCSQNGNLQDLKVGDDVEFEVSSDRRTGVPIAVLVKINKSSLKNEMNGQGVFYLIKP

SEQ ID NO: 1015249 - protein, 30 aa, Homo sapiens
APRLQRMAFQEFFVGELEDERAEGCLGSYG

SEQ ID NO: 1015250 - protein, 51 aa, Homo sapiens
AACQLRISQHEAQIKSLTEYLQNVDKKKDSGGSVDALSEELVQLRAQEKVH

SEQ ID NO: 1015251 - protein, 33 aa, Homo sapiens
EEIAFLEKLTRGNPRAQAQIQGQHVQIDVDVSS

SEQ ID NO: 1015252 - protein, 56 aa, Homo sapiens
MEAYEQGQKGPLKLKGVAELGSDHAEEEKEGQRQSETPGAMGRAKDEEESGRPGKR

SEQ ID NO: 1015253 - protein, 43 aa, Homo sapiens
AEPGVVGQMIEAAGRAPVATWVVYILTIGLPVFLGNPDSCLFS

SEQ ID NO: 1015254 - protein, 43 aa, Homo sapiens
MNDTVTIRTEKLMTNRLLQRKQMVIDVLHPGKATLPYDKKFGK

SEQ ID NO: 1015255 - protein, 52 aa, Homo sapiens
GQQQLQHGHPGGNQTNRLQEALNLFKSILKTDGCDHLCDPVPQQGKICSLRS

SEQ ID NO: 1015256 - protein, 67 aa, Homo sapiens
AAVPPPLWREERREPRRCTNISAAQSEECKMFACAKSPATPSLIRAGSRVGITDQFHASVVISDQTL

SEQ ID NO: 1015257 - protein, 49 aa, Homo sapiens
PGKPRRSLSPGLQRGGRTMPGVTVKDVNQQEFVRTLAAFLKKVPEGESP

SEQ ID NO: 1015258 - protein, 46 aa, Homo sapiens
MEPLRMRAKLRKKRIQAVSAKEERGCRGQGTASCFTGEATGAETRN

SEQ ID NO: 1015259 - protein, 51 aa, Homo sapiens
FKPNQTRTYDREAFKKRAACLILSELSRRTRSFLVSSNRYPDHVDLSQEEE

SEQ ID NO: 1015260 - protein, 38 aa, Homo sapiens
RDPPWCCLCRQDNVKAAWVKVGAHVAIMSGALESSPFL

SEQ ID NO: 1015261 - protein, 86 aa, Homo sapiens
EKKVKKSDFGEWQLSLCVPTSGDCGLGTREGTRTGAEFKQTMKTQRCKIPCNWKKQFCAECKYQFQALGECYLHTALRQNWSLSEP

SEQ ID NO: 1015262 - protein, 49 aa, Homo sapiens
MEIEPGAIDIVPQGKDEIYTHAYYGQAYPLYLLHNDLPGITFEGAQASP

SEQ ID NO: 1015263 - protein, 49 aa, Homo sapiens
MVNSVSTKAQGLPGIVVGASKPDLGGKQSLLSLEEVRSKSRTTYAWSSS

SEQ ID NO: 1015264 - protein, 44 aa, Homo sapiens
SRGGFEDASLGFGGRDNNPFEFWLPVENVSVKGPAKKEGPLLRG

SEQ ID NO: 1015265 - protein, 53 aa, Homo sapiens
VTSSLNPAWQSLTHRRDAQEGKATWKSNYFLDHPLLDDYPKCFMWEQTMWLQA

SEQ ID NO: 1015266 - protein, 34 aa, Homo sapiens
GLWKDKQDQQNIPDWMRLEKDRFSVTGVKALFPE

SEQ ID NO: 1015267 - protein, 89 aa, Homo sapiens
ARKAEALGAVQDSSLTCNQPPWPREGIAAGGVMTLILLTRGLEDCLITMACTWIRECQSLAKRKLSCVLINCMSYVCQVGEALSDTITY

SEQ ID NO: 1015268 - protein, 33 aa, Homo sapiens
MKGKGTWDKGLKVIVSRSEVDMLKVRCEFKREY

SEQ ID NO: 1015269 - protein, 73 aa, Homo sapiens
MTKKRREQWSCQKGPRHVQPYSLHYCSQCVPKDKAIKNFVIEHSGGAAVGTFLKQRLRCLCASKLYVSYILCE

SEQ ID NO: 1015270 - protein, 31 aa, Homo sapiens
VLLHQTLQIWKLVWKEAKPDELMDSKLRYVF

SEQ ID NO: 1015271 - protein, 37 aa, Homo sapiens
DTFPLRKEEMVLKAELSQTCTPDMMVLFLAFLSIVYM

SEQ ID NO: 1015272 - protein, 30 aa, Homo sapiens
MQFACTTIDAMMKTPGHEPNDQTHLWRLDD

SEQ ID NO: 1015273 - protein, 30 aa, Homo sapiens
MVQRVRAQPGHPSQQMQIVPSQSTHRQYIA

SEQ ID NO: 1015274 - protein, 126 aa, Homo sapiens
MGEILRQLHVQDRTFILASKSNIKKVLDGQNRKYHMIRRRQEELMAAFLKDQESYDNRLLMEMTCKEWPYFMYEPTKELNRDTEKRTEGRRITLIAEEPTRNYASCMTSEISLCIQVDCRCITVTL

SEQ ID NO: 1015275 - protein, 43 aa, Homo sapiens
RVLLFDPTERFLPEEEKLTEQERSKRFEKVILITAITQSKLTS

SEQ ID NO: 1015276 - protein, 62 aa, Homo sapiens
VTSSLNPAWQSLTDRRYAQGRQGDLGRSNYFPEDSSNYLMIIRNCSFVGADNFASNRSADPI

SEQ ID NO: 1015277 - protein, 98 aa, Homo sapiens
LRSHYLHFLIPVEDYLSVYYNVIGAVTLWKLRDNHADISTDYPRNIPMNPMCIERFADKKAHDHEGSDLKIPVASNRRFCLGTANFRSATSLYQAGRL

SEQ ID NO: 1015278 - protein, 58 aa, Homo sapiens
FWVNNDIKAEIKKFFETNENKDTTYQNLWDAAKAVLRGKFIALNTTPEVRRLNYTYIT

SEQ ID NO: 1015279 - protein, 43 aa, Homo sapiens
AAPRLNSLSEGHINCTEHRVWLLRDIYLALNITNGEAVAVQLD

SEQ ID NO: 1015280 - protein, 34 aa, Homo sapiens
GGQELALDEALIQDQADDEECRKSEGDGIIMVGG

SEQ ID NO: 1015281 - protein, 71 aa, Homo sapiens
KKGEGEAGTFIHMVEHEEEREEGRCHILLKTSISRELIHYHENSKGQSTYMIQSPPSGPLSMLGSTIHMRI

SEQ ID NO: 1015282 - protein, 34 aa, Homo sapiens
DPPEVPRSLHRWLCPPSSTTREMTPNEIKCAVHV

SEQ ID NO: 1015283 - protein, 36 aa, Homo sapiens
MGISRDNCTSAAKTVVKRKPYHKKRKNSWGRQLSTP

SEQ ID NO: 1015284 - protein, 30 aa, Homo sapiens
GSEEAKVQLPSVVPNPGSSANKPVIQQSSL

SEQ ID NO: 1015285 - protein, 34 aa, Homo sapiens
LQQFADNDVSRFKAVKARFANQYIQDKSTNEMWK

SEQ ID NO: 1015286 - protein, 41 aa, Homo sapiens
MYRTANSTWRGWQAKAGNFYVPPEPTLGVLSSEFRGITGVS

SEQ ID NO: 1015287 - protein, 56 aa, Homo sapiens
TKDAYKKYIKDYMKSVKGKLEDQRPDRVNPFMTGAAEQIKHILLISKTTSLYWRNM

SEQ ID NO: 1015288 - protein, 36 aa, Homo sapiens
AIAEALARLDHKYAPACYAQTCTVAYTWSRLGKVNE

SEQ ID NO: 1015289 - protein, 33 aa, Homo sapiens
PDRANTAGRQNTGVTRGGTIARGEYAQSLVRDY

SEQ ID NO: 1015290 - protein, 31 aa, Homo sapiens
HEEQEQEEEDEDEEEEDEDEDITMAILSLMR

SEQ ID NO: 1015291 - protein, 32 aa, Homo sapiens
EGPRGPPGPRGGARENRVPPPCLGCPGRFRLG

SEQ ID NO: 1015292 - protein, 44 aa, Homo sapiens
GAYTKMQIYVKALTGTDHHPEWVNPLDTIENVKANDPGYGRSSS

SEQ ID NO: 1015293 - protein, 61 aa, Homo sapiens
DKQTLHSEQPLQVARWTQIITADSEDPKYIITVKQFAKFVVDLSDQVALLTLKRYESGRGE

SEQ ID NO: 1015294 - protein, 50 aa, Homo sapiens
AGTSLDYLNGRSSLRRGYLPFVTICWNVKLSVTLKRSCAMSPWILQNEMA

SEQ ID NO: 1015295 - protein, 35 aa, Homo sapiens
LVGQWVQPQRVSQSRAWRRLTRKPKGQGISFPGKG

SEQ ID NO: 1015296 - protein, 96 aa, Homo sapiens
MADIQTERAYQKQPTIFQTGGGSCWENLARRSSRGTTRHRSGLKTPKEAIEGTYIDKKMPFTGNVSFEADLSACDQMRCRDIVSRDYFTTSQYTAR

SEQ ID NO: 1015297 - protein, 31 aa, Homo sapiens
VASITVIPKSGSTHHHHHQLHATIADNHRCK

SEQ ID NO: 1015298 - protein, 38 aa, Homo sapiens
DLPSRKPAKYDDIKEGGEAAVRRAPQRAIPWATISNKV

SEQ ID NO: 1015299 - protein, 50 aa, Homo sapiens
LMKVGQDASSAGSTRTKDPTRRAELEARTSGKKFDNKPLCKTKIQVLAQT

SEQ ID NO: 1015300 - protein, 33 aa, Homo sapiens
GSLVGGNWKMNGRKRSLGELIGTLNAAKVPNDT

SEQ ID NO: 1015301 - protein, 67 aa, Homo sapiens
NGPLQFLHNEQQEPFLVWVNQEDTFRVISMEKGGPHEGGFSPLVSRAEKIEEIFKKAGQPLCGTSPW

SEQ ID NO: 1015302 - protein, 149 aa, Homo sapiens
MAPPAREGETLWSQATCGAPNTAGPKRVSTTTAPYRDKGVSPPVGTAGSNTIGPNLQREHLVTIGHKCCISSGSHSEDTDTSPLRLVHERSWFSEKQGRDGDLLLLGAPQRGFLSTLSGPCGMRGIPADDAFGRIDAGRPVYVNNSGPA

SEQ ID NO: 1015303 - protein, 55 aa, Homo sapiens
MCKNKRTKVSLLPRCPDEDSHFDLGGKGKVDEFRFVAIMVSDEFEQLSLSLELPD

SEQ ID NO: 1015304 - protein, 34 aa, Homo sapiens
MASRKAGPGARCAATKKAQRGSSNVFSMFETSPR

SEQ ID NO: 1015305 - protein, 51 aa, Homo sapiens
GGSISFWASCPPSDPFVKPKIRQKENQKKFIRHQSDPKLSKLKRNWRNPEA

SEQ ID NO: 1015306 - protein, 45 aa, Homo sapiens
HRGTETPALRTLLISGDVACVHKEDLLEIRDMFLGNKVQLLSVLC

SEQ ID NO: 1015307 - protein, 52 aa, Homo sapiens
KGRRDLLGGRRALTKLGELTMQLIRGRSSLRVLKWTETEIEMLRAAVKDFGT

SEQ ID NO: 1015308 - protein, 46 aa, Homo sapiens
GVTVEVRGSNGAFYKGFIKTLRRLPTVFGKQFEQNAGSFNEVRYHT

SEQ ID NO: 1015309 - protein, 51 aa, Homo sapiens
SVASGLQFPGFNPQPVTKDLTTKSPAPKKMLEMETGVIKVVKCHSHHPATY

SEQ ID NO: 1015310 - protein, 43 aa, Homo sapiens
VVPANRETEAGEWLEPGVKAAVSHVHTTVLHVLQPEQQSETLS

SEQ ID NO: 1015311 - protein, 68 aa, Homo sapiens
KQNSARGFGSSGLSPRLSMFLQRLSRFSSVIRSAVSVHLRGTIGVKAVAFIKDLDPLQNSLWQIRDTI

SEQ ID NO: 1015312 - protein, 45 aa, Homo sapiens
MTVGFPRDSFTNILHLIRQRIRVMRAPGASSGSSEYGPSEGQARA

SEQ ID NO: 1015313 - protein, 81 aa, Homo sapiens
LLLVLNLEPYPDMGLEDEQKMLTESGDPEEEEEEEEDLVDPLTTVREPLRALEKCLSPGALELFISFLPLIKKEEISRGAF

SEQ ID NO: 1015314 - protein, 31 aa, Homo sapiens
MAACDPRHGRYLTVAAVFKGPHVHEGGWLGK

SEQ ID NO: 1015315 - protein, 34 aa, Homo sapiens
STQDSASCYYTCPVSTNGGVLLSRRSLPRRLNDR

SEQ ID NO: 1015316 - protein, 44 aa, Homo sapiens
AFLKNALDKEPVLVVSFVVGGLPDNSSPFRPYFKDFHDQQGHAL

SEQ ID NO: 1015317 - protein, 44 aa, Homo sapiens
PKNSARGDSLTLTIEYYSRLKPHSYNNYITRRLALIELSPHSGL

SEQ ID NO: 1015318 - protein, 103 aa, Homo sapiens
GLGHGSWHHSFITMPSLTTPIQHSVGSSGQGNQAGERNKGYPFRKRGSQILPALQINMIVYLGNPIVLSPKSPELIATSASLRIQNQCAKSQHSIHITTVGQY

SEQ ID NO: 1015319 - protein, 79 aa, Homo sapiens
RRASLFSGLPFGLRTQDRVKTFPPPGRKLNTEDGNVLMIITEDKVFKGRNPAPHHQWAIRVVKPSAASTWWTPVLKFWS

SEQ ID NO: 1015320 - protein, 62 aa, Homo sapiens
ASPKTTPPVRLNSFGVYSKKEKLSISNYVDEFFISVIQGFYNESQFKIALKLSNSKILSYTP

SEQ ID NO: 1015321 - protein, 45 aa, Homo sapiens
MLRQNLQCLVDRALGKRGCESASFQAQSTRNMRLHMTSAPARQFS

SEQ ID NO: 1015322 - protein, 54 aa, Homo sapiens
STSCVATPSTKHCFESYSESDADCPTCLPENRKAWVLFRAQGQKRGLHDQFRIS

SEQ ID NO: 1015323 - protein, 40 aa, Homo sapiens
MCRTIVKAKKQAAEANKNASILLKDSILKVKRESRKQALL

SEQ ID NO: 1015324 - protein, 49 aa, Homo sapiens
EPSQHSSSSLCLYEIKQFLECSPEPRVTSSSFEEVSIEGLKQFRLANGL

SEQ ID NO: 1015325 - protein, 95 aa, Homo sapiens
VKTTPKKPKMEKEKELIINIVVIGQRRIRASPPTNWPSDLIKCGGIDKKNHVKKFEKEAAEMGKGSFKYAWVLDKLKAEVNVVHIDISLWEFEPA

SEQ ID NO: 1015326 - protein, 107 aa, Homo sapiens
MKSYFRLDTPIYFYYSDLSVPHCHRRGPGRRGRMIVIQLHVDNCILNAETLVCIKEPRAYTFRDYSAILYLTRDCDGGNFDVTSLDAKTVTSDVQPQFGRPWDSFST

SEQ ID NO: 1015327 - protein, 134 aa, Homo sapiens
QVDIDYQKLHDALFKWQTKPKLDHPMGDLVTHEGEGVPRHDSKEKKPGDAVLDELKDFLWGMPSRSPDAHKGPLPPWLIAIQPILTTPIDPNLKIPGLNSPIPESCSFGYHAGGWGKTPVDETGKTLYGEGLEP

SEQ ID NO: 1015328 - protein, 51 aa, Homo sapiens
PSGGRSESKAEAQKRKDEAEVQVNRQLVAPWGPQGRKHGVPNVGDYLVQIL

SEQ ID NO: 1015329 - protein, 80 aa, Homo sapiens
NSARGWCDSGRGGARRGARILVAVPGLNHHHVEQKNKGPRPKKAPQRATSHVFAMFDPSQIQGFKEAFNMFDQNRDWFHR

SEQ ID NO: 1015330 - protein, 47 aa, Homo sapiens
HEAQDQGEKENPMRNCASARLCLNICVGESGDRLTRAAMVFEQLTGH

SEQ ID NO: 1015331 - protein, 34 aa, Homo sapiens
ENASTKNLTGLSSGTVEKPRLHDSSSECEPKPVP

SEQ ID NO: 1015332 - protein, 75 aa, Homo sapiens
GTSPSEFYRSGKYDLDFKSPDDPSRYITPDQLADLYKSFVQNYPVVSIEILFDQDDWGAWQKFTASAGIQVVGDD

SEQ ID NO: 1015333 - protein, 84 aa, Homo sapiens
LLDRWQEYSFQNVRMYVSWVGRYSPRCLLNSHYHLQILIEKVMTNLRAKNGGSHIYSQQFSRLRTVDNLGRSENQLNKMRTYVQ

SEQ ID NO: 1015334 - protein, 87 aa, Homo sapiens
RYDIEAKCLHNTREIKDLKLKVMDLRGKFKRPPLRGVPFSAEAILRALLGSKKRVSMDLRANLKSFERGDTPRGPLWRWLTWENVPP

SEQ ID NO: 1015335 - protein, 42 aa, Homo sapiens
EVDEQMLNVQNKTSSYFVEMDPNNVKTAACDIHLVAKGGVTY

SEQ ID NO: 1015336 - protein, 59 aa, Homo sapiens
GYEKTIHMQQHKASPAKIQERTMMRNNDKRRATTNALTDVVNNMIQARIRNAIETRFKS

SEQ ID NO: 1015337 - protein, 119 aa, Homo sapiens
SWATVHFLRSSESGSSDTSRLTMPPKFDPNEVKVVYLRCTGARSAHIRLGPKIGTLVCLQKKVGDDIAKATGDWKGLRITVKLTIQNRQAQIEVVPSELSPESSSPQGDTGRQEKQKKI

SEQ ID NO: 1015338 - protein, 119 aa, Homo sapiens
HELVSVTKEGLELPEDEEEKKKMEESKAKFENLCKLMKEILDKKVEKVTISNRLVSSPCCIVTSTYCLDSTALDGSLGPRHFETTLQLGYIIAKKHLEINPYHPIVGPFGRRLRQTKRQ

SEQ ID NO: 1015339 - protein, 54 aa, Homo sapiens
ARDGVETILRDTHIHYKCRVYSCRFYQHIFPEVEDVVMVNVRSIAEMGAYDSLW

SEQ ID NO: 1015340 - protein, 54 aa, Homo sapiens
GTRDFKAKKRELEEIVQPIISKLYGGGGPPPTGEERIHTEKDEFVGHTDSTRAI

SEQ ID NO: 1015341 - protein, 99 aa, Homo sapiens
GRSLVDPKILARAKGDKIGKKKDPNAPKRPPSAFFLFCSENRPKIKIEHPGLSIGDTAKKLGEMWSEQSAKDKQPYEQKAAKLKVEFERVFCIPCQGKL

SEQ ID NO: 1015342 - protein, 69 aa, Homo sapiens
VFLPALCRKRGRPTKRPPVLRAGVNTVTTFGRNKKAQLVVIAHDVEAIRAIYIDRYDEAAVTGVACPGS

SEQ ID NO: 1015343 - protein, 128 aa, Homo sapiens
HLRDSKRPRSLVLYSCLGLQDVPRDPSYFLVLEPLGTSRSCIEEVKLYKNAREREKYDNMAELFAVVKTMQALEKAYIKDCVTPNEYTAACSRLLGPVTKLPSDSSKASEIQLHLIEFCRKFRLGLPT

SEQ ID NO: 1015344 - protein, 44 aa, Homo sapiens
DNLEPNHFTPNKRIGDETFKTSAQIDDSTRKEKIEKIITTHNIA

SEQ ID NO: 1015345 - protein, 104 aa, Homo sapiens
GTSEHPGLSIGDVAKKLGGDVDNTAADDKQPYEKKAAKVKEKYEKDIAAYRAKGKPDAAKKGVVKAEKSKKKKEEEDDEEDEEDEEEEEEEEDEMKKKMMMMNK

SEQ ID NO: 1015346 - protein, 54 aa, Homo sapiens
EIKLLAMRSKPDKVLLMEEDDMALEMSVMQEAQKRLISQVQREGFIENIIPLSS

SEQ ID NO: 1015347 - protein, 37 aa, Homo sapiens
GSTSHVNTAFCLTHQHRHWVHVLQLQPLAVTSSLSDR

SEQ ID NO: 1015348 - protein, 83 aa, Homo sapiens
MKSCGEDGFHIQVRLHPFHVMHINKTSCAGLTGSKQVYEVPLKAQGTLARVHIGHGNPGPIGTKVQDKGHFIWASQAKAKVPG

SEQ ID NO: 1015349 - protein, 31 aa, Homo sapiens
MFIVEQTCGSADAADRMSFAEAVSDGRHMMR

SEQ ID NO: 1015350 - protein, 68 aa, Homo sapiens
DSYVGDEAQSKRGILTLKYPIEHGIITNWDDMEKIWHHTFYNELRVAPEDTPPCSQRPDDPKATGEMT

SEQ ID NO: 1015351 - protein, 129 aa, Homo sapiens
MALRLMDASSSLWPPLKCIGDPSYSGGALLRRKLLTVRHGNLLMRKLLSAIMAWGDHVGLQQGAFQVDVVVTQSLVDSSQHLLGHILAALQVMVPIREDLRLHDGHNAILLAETGITGQNIGIFHEGEG

SEQ ID NO: 1015352 - protein, 71 aa, Homo sapiens
NVKKVKMAEPGPGSREYSRCKVHSWNVMPLGARTADHMTKDIFLGPDAEDQQKNDTAAAKKYNMRLKTTNL

SEQ ID NO: 1015353 - protein, 33 aa, Homo sapiens
ENESGKERERENESENKKRDREEDEEDAYERKK

SEQ ID NO: 1015354 - protein, 33 aa, Homo sapiens
DTNIYGGYHIYDIFATYDDVDKGETHTFGKHDT

SEQ ID NO: 1015355 - protein, 45 aa, Homo sapiens
TFSLRAFFPGRHNAPIPYCYSRVVLTRHVSDSDFSIPDDLRPRLT

SEQ ID NO: 1015356 - protein, 102 aa, Homo sapiens
ARAQWKKTALMTKEKTLIFKPIYNANFHAIQGFLSVGAINVTYAQKPKLLKWYCYNGSICEDVTLMKLTPLCLHSFLLAAEDRLRTISAKDSVAKDGRHKQY

SEQ ID NO: 1015357 - protein, 33 aa, Homo sapiens
HESRLRAGDGHCASASAREKSYERPDGHGITIG

SEQ ID NO: 1015358 - protein, 38 aa, Homo sapiens
DGRTLSDYNIQKESTLHLVSAYEVALLSLLSTSLPRNT

SEQ ID NO: 1015359 - protein, 30 aa, Homo sapiens
KPTPPYYQTTLGQPSTQLTYRREHFETLSA

SEQ ID NO: 1015360 - protein, 88 aa, Homo sapiens
DPAEEILLILRKPGAQWGDDSEWLTLPVDQKCEHRLWKARLSGYEEALRIFQNIKDDRSPQWSTFLGLIKNLVTDSTAVVHLKGLELT

SEQ ID NO: 1015361 - protein, 110 aa, Homo sapiens
PLLPSALSSPLRIATSPPGPKRIAPNQGTKPSGLPQGKAPQPPKQGKGPGPKAPGLPRLPPAPPAPPGQPAPPRPPSGPGSAFPHGHALPLLHPPGGRSKTRYLPLSPTH

SEQ ID NO: 1015362 - protein, 63 aa, Homo sapiens
HEYVAIQECYPCMLLAVPQALFWTLGMCVTHNVPIYEGYVVPHAIMRLDLAGRDITDYIMKIL

SEQ ID NO: 1015363 - protein, 31 aa, Homo sapiens
RGSHIVFKPCVAIPDGPRDAREQGGLEGQII

SEQ ID NO: 1015364 - protein, 38 aa, Homo sapiens
TPATRSPQPTLTLAHSPTHAHSHAHTRRDHTPSHSHSR

SEQ ID NO: 1015365 - protein, 33 aa, Homo sapiens
EKQDGSPAAVLEPPDENSARDLDLVVSIQTGKT

SEQ ID NO: 1015366 - protein, 72 aa, Homo sapiens
NTRTPLITPAIMTLAHEYDFISTLAETNRTPFGPCRRGSALVSGFNIEYAAALRPILHSRIHTHYYITPHHY

SEQ ID NO: 1015367 - protein, 99 aa, Homo sapiens
EALEQLQIQQFHSQIAAQTSASVLAEELHNSDLQTKDKQITQTEDSLASESDRLTSKEEELKDIQNMNFLLQAEVQTLQALQMSRLLLTMNLAIRKGHN

SEQ ID NO: 1015368 - protein, 65 aa, Homo sapiens
DIQEDCHHRLWPVELICGQGAGWGSCNVHAPGAALGFSKVLNDTCVHSLSQCALGRLLGMLDLGQ

SEQ ID NO: 1015369 - protein, 38 aa, Homo sapiens
LEVMNPAENFRVLVKQKKGQLLEDAAIQLINHIGTGFW

SEQ ID NO: 1015370 - protein, 38 aa, Homo sapiens
HCLLVTLAATSPPEFTPPVHASLDRFLASLAPLLTSKY

SEQ ID NO: 1015371 - protein, 60 aa, Homo sapiens
EGGGPGGKGGRPPRQGPTVVLPTVFSMFEQGQIQGFKGGFSCIGQNRDGIICKAGLRETY

SEQ ID NO: 1015372 - protein, 50 aa, Homo sapiens
MARGPKKHLKRVAAPKHWMLDKLTGVFAPRPSTGPHKLRRVPPPNNFPRT

SEQ ID NO: 1015373 - protein, 60 aa, Homo sapiens
QNHNSKKAIINITTSSSTTSSNSSSRHHRQYLQIGNRPPAKIEALIYVEKEPPGQGGPTL

SEQ ID NO: 1015374 - protein, 63 aa, Homo sapiens
MTVAFKDIKLWRKLLKGIPDLYDDAAIFGGKKINFTWAGKTPHSLCRENPCLRLFMNYFLPQM

SEQ ID NO: 1015375 - protein, 96 aa, Homo sapiens
RHENSSHEYRILVLLLMINTLYSAWYTTGLCINSKMAKPAHSSYVLQQLNNQREWGFLCDCCIAIDDIYFQAHKAVLAGCRSYLAVFLDPQPKYAH

SEQ ID NO: 1015376 - protein, 52 aa, Homo sapiens
EERTFVVGERVTLADITVVCTLLELYKQVLEAFFPPALSQYQPKKGHTTERE

SEQ ID NO: 1015377 - protein, 45 aa, Homo sapiens
GSDIVFKPCVAILDGPPCCPGKTGRPRSSNYFLRSSTYWMIIPNV

SEQ ID NO: 1015378 - protein, 80 aa, Homo sapiens
EVRTLVVFLQFFGTRFTTAETCIFRFITEEAVLMSPWIFQNEMATAASFSSLEKSYELPDGQVITIGNERFRCPETLFQP

SEQ ID NO: 1015379 - protein, 59 aa, Homo sapiens
DLALMQDKVRELQNQEQRLSGPGGGLDNALLALQRPTAAQVLQAGVAEVTSGTPPLHDQ

SEQ ID NO: 1015380 - protein, 39 aa, Homo sapiens
VEPPTKMQIFVKPLREDHHLEAEPSDTIENVKARIQDRR

SEQ ID NO: 1015381 - protein, 47 aa, Homo sapiens
LLKLMSTVDPKLNHVAPGLVSPSLKSDTSSKEIEEAMRRVRDAQASF

SEQ ID NO: 1015382 - protein, 50 aa, Homo sapiens
MSRLLNGQDQDQQLLLWNGLPHMSQDTRLVHSHLGPLRSADTLIGNCTPY

SEQ ID NO: 1015383 - protein, 75 aa, Homo sapiens
SRQHGWTSTRLPVEQLNRRRQKNEVQGQAFDIFVLGAEEMAASAPKELGKVIRMLGQTPPLEELQEMIDEVDEDG

SEQ ID NO: 1015384 - protein, 99 aa, Homo sapiens
VTSSLNPAWQSLTHRRDAQGRHADLEVQLFPKIIQTIRMIIRNVSLWEPDNVGSKEMQQIRYVPSGEGLGSLGQEHHVGKASRGTGNTDFGNLGLYPGY

SEQ ID NO: 1015385 - protein, 90 aa, Homo sapiens
SGKGPSFAEAKENPLPQGSVDYNNQKRGKRESQTSIPDYFMTGITNINNELQWYKIENILCNLISDPVEYSSLVSTGSESMRRRLALAAP

SEQ ID NO: 1015386 - protein, 36 aa, Homo sapiens
LPRKLRLRWGEDINFIRRLSTASGSAAPNTRPAHMS

SEQ ID NO: 1015387 - protein, 83 aa, Homo sapiens
NPTGPQAPGLRGQSRPRPQGNCLGPPFYSVKFVFIPPLGFAEGVGAESGAGQRVFFPGQEGRRVTTLGLGTPGILWGAVLGGG

SEQ ID NO: 1015388 - protein, 86 aa, Homo sapiens
NSLPGDILLVPYHEVSSISVIPSSAPEIVPPPTRSRQRLAGSAKGLRVSDLETKEGATRYLRRVCPPVRRSELGWYTDSVERLRDV

SEQ ID NO: 1015389 - protein, 42 aa, Homo sapiens
AEVICEMVRYSLDRRTPRIMQSRGSIFVFTLRTIVKLLRPSR

SEQ ID NO: 1015390 - protein, 42 aa, Homo sapiens
RCRETTLKPNGKERLISTLSSLDTEIRAKPTITGHLIYKCGS

SEQ ID NO: 1015391 - protein, 61 aa, Homo sapiens
LACTLAKTAFDEAIPELDTLNEDSYKDSHPHHAVAESNLTLWASASQGKDVMRPKGLKLNP

SEQ ID NO: 1015392 - protein, 53 aa, Homo sapiens
ELLRWKLKGKAIHRKGYKTAHDKTVSKLVFWFFMLSPGSCYRGGLSHIQDSEK

SEQ ID NO: 1015393 - protein, 57 aa, Homo sapiens
ICKADPEGDLLQLGKVSVPEEELDAMLKRARAHNLTVFLTLFGRRSMAHPRGRTLSA

SEQ ID NO: 1015394 - protein, 82 aa, Homo sapiens
MEFTEAEEQYQDATAEEEGEFEEEAEEEVAYEPSVNWGKQGSSVNSFIHFQAVLLAATVPLAVLPVHILLYRDHALEDFRES

SEQ ID NO: 1015395 - protein, 91 aa, Homo sapiens
IPDPETMDPMGLEPEAFIESNLNEIIDSFDDMNLSESSSGIYGYGMSEAPSIQQQAVLPVSRFTDVIAQAKLGLEAVNISMIGVSRGRRHR

SEQ ID NO: 1015396 - protein, 36 aa, Homo sapiens
SSYNMVIPEDNQTNRLQEALNLFKSILDLTCGLRTI

SEQ ID NO: 1015397 - protein, 102 aa, Homo sapiens
LAPKQQLVLPQFLASPSTMFPLVKSALNRLPSSEAFQQTMPSQTTQNRTPDFHDKYGNPVLASGATFCIVHMQYVDQSGIEWPSPCWRVPKDGGIVLPPWCI

SEQ ID NO: 1015398 - protein, 91 aa, Homo sapiens
SYARQNLKGDLPPSLGKVSVPEEETGTQRLQEGKGPTKLHTVLLTVFGEDGYNGDRPPGAILSHLPIFNPGANGVVNRIAEEVLSTRESTY

SEQ ID NO: 1015399 - protein, 66 aa, Homo sapiens
EPELERPGAAAGRALRDLKCPLRHKEFMTVQALVEEGSDGDQRESVQQDQKRQFSQKRRKISANRF

SEQ ID NO: 1015400 - protein, 176 aa, Homo sapiens
GARWWRTRKLLRRRGSVAWIESERETMNVDKTELCGVSAHLVTKVPRSVSLCQPSRPEQRPCRNLISETKKALLVQRSKAPRHLGKAKSQMETESQQAEDGLKDPNKILPRGPGASCVKKTSPKSEPQWKNSQEPAKLRQAGYSWWLGLWPSSCGEKARHIPENWTLGRIGFRHVG

SEQ ID NO: 1015401 - protein, 69 aa, Homo sapiens
KEGKVLGGALRFIGYPPGLKRHDFIFTSNVKTGLQGCTFLRAQTDNPQCRSEVDSNEYLSIAIQSNHSG

SEQ ID NO: 1015402 - protein, 38 aa, Homo sapiens
KQPPIKKAFKLNNHYLKNPKQLTELLKTNWPSITYSRL

SEQ ID NO: 1015403 - protein, 35 aa, Homo sapiens
QFLVGMVTTLLEPSATMPWLKGWKRTPKDGNHSRP

SEQ ID NO: 1015404 - protein, 59 aa, Homo sapiens
VQREWPAGRRGPGQGGSTTQAQRGSSNVFFHVLNKPRYKEFKEASAVSPDRIASSAGSL

SEQ ID NO: 1015405 - protein, 34 aa, Homo sapiens
MAKSALFTVRNNESCPKCGAELVIRSGNTVRSWM

SEQ ID NO: 1015406 - protein, 46 aa, Homo sapiens
PLTILGGSSSHQSCMVHSWHCGRLSTVAMCAPSGKVSEQGAPWSGL

SEQ ID NO: 1015407 - protein, 45 aa, Homo sapiens
EESLFSPRKGKRREKISLSALSLQLNKASNSLTVLYSAHGIFGHE

SEQ ID NO: 1015408 - protein, 39 aa, Homo sapiens
ATTSISYTSNSDDHLLKTSSCLTSSPAFNRPRALHQMSC

SEQ ID NO: 1015409 - protein, 36 aa, Homo sapiens
APVTLGRRSSGRQEEFMNCLLLDTVVDWYDMMTAGL

SEQ ID NO: 1015410 - protein, 67 aa, Homo sapiens
NLCAMRAKWRKKRIPRLEAQKKEDEAEVQVNRSLLHRGGTRAKHWMSDAWMLVQVVGLHATRLELSQ

SEQ ID NO: 1015411 - protein, 43 aa, Homo sapiens
TKYGKEKKRIEKIGKLEDKNITLEEKDNSNIQVGEAGKRQARN

SEQ ID NO: 1015412 - protein, 74 aa, Homo sapiens
GRILGLLEAYLKTRTFLVGERVTMADNTIVCNLLWLFKQVLEPSFRPAFPHNQRWFLNCNYNSPIPAVLASETV

SEQ ID NO: 1015413 - protein, 66 aa, Homo sapiens
EVPPFSSVLILCASRRAFSSRYCWARASRGSQPSVVRRAHYEEGPGDLPFSVKQSSLLAKMCLYLD

SEQ ID NO: 1015414 - protein, 48 aa, Homo sapiens
AQDQGEKENPMRELRIRILTSQHHVLGRVWDRLTRAAKVLEQLTGADP

SEQ ID NO: 1015415 - protein, 40 aa, Homo sapiens
EEAETVGPGEKKAAGKGRSPKRPLYFERSYTVTPLGDREL

SEQ ID NO: 1015416 - protein, 40 aa, Homo sapiens
EQIALKGAKKQLQKLKRGFGLKKEQDTSAHLERIKKNMTD

SEQ ID NO: 1015417 - protein, 57 aa, Homo sapiens
MAMSFEWPWQYRFPPFSTLQRMLDTRQTQLAAWCSLGLSFCRLAQTVQHDGDGSSGE

SEQ ID NO: 1015418 - protein, 35 aa, Homo sapiens
EKLMLQEMRSQKWDCASSLCVTWGIIPEATFTSGV

SEQ ID NO: 1015419 - protein, 103 aa, Homo sapiens
IDPEDDVRDNILKYDEEGGGEEDPDFDLSQLQQPDTGGLHAIKPVGIRRMDVQPIPAEPSIRSDITVHTMEDIGSPFMRDLMRRPLPHDTTTDLTDQCLAYRA

SEQ ID NO: 1015420 - protein, 105 aa, Homo sapiens
STPPATTNFPAPPTRARLSRPDSGILASRIPLQSYSQVISRGQAPLAPTHTPLFPPTGGLTGKVREDTEGATTVATVGPSVPLRITVTSFLRGGIRSQGQIPYFT

SEQ ID NO: 1015421 - protein, 63 aa, Homo sapiens
LKPRSVLTSQVVVGPNITLPEGSVISLHPPDAEEDEDDAELPDDYRGAQGKEKVKVNVTFSRE

SEQ ID NO: 1015422 - protein, 98 aa, Homo sapiens
LEEELRTMDQALKSLMASEEEKFGDLEEELKIVTTTLNPWRPGGQVFTKEDKYEEEIKLFEETLRERLDPRRCTPTCLWTRLRDITISRVLGRSHGER

SEQ ID NO: 1015423 - protein, 84 aa, Homo sapiens
PTVCCVRQWEVVKSSDYCEYLRPPIDSYSTLDFGKFNEISEVGYQHGRTVFDIWGRSGVLYEDLAAQQGPTKSPRVGLYISTVF

SEQ ID NO: 1015424 - protein, 36 aa, Homo sapiens
KATRRCFLIKLCELIFASLVRKKRKEHEDSGRKMMQ

SEQ ID NO: 1015425 - protein, 50 aa, Homo sapiens
MLEGDKLKVEPGDPWGPGDPPPYSVQRVVQRTLGYRAPVATSPNNSKPRR

SEQ ID NO: 1015426 - protein, 110 aa, Homo sapiens
MADIQTERAYQKQPTIFQNKKRVLLENWQGEAPRYYRYIWSGVHVTQVRLLMAPTFTRKCPFTGNVFHMGADSVCCGTNMSVQSTVLSRVYLTHPQHNLLWSPQDILTHL

SEQ ID NO: 1015427 - protein, 41 aa, Homo sapiens
MAGIDDFYTSARGQQLPPWGNFAKATFDAISKASRYLTPDL

SEQ ID NO: 1015428 - protein, 35 aa, Homo sapiens
VKCDPRHGKYMSSAVSCTVVDVVPKDVNSAIATIK

SEQ ID NO: 1015429 - protein, 932 aa, Homo sapiens
MKQLPAATVRLLSSSQIITSVVSVVKELIENSLDAGATSVDVKLENYGFDKIEVRDNGEGIKAVDAPVMAMKYYTSKINSHEDLENLTTYGFRGEALGSICCIAEVLITTRTAADNFSTQYVLDGSGHILSQKPSHLGQGTTVTALRLFKNLPVRKQFYSTAKKCKDEIKKIQDLLMSFGILKPDLRIVFVHNKAVIWQKSRVSDHKMALMSVLGTAVMNNMESFQYHSEESQIYLSGFLPKCDADHSFTSLSTPERSFIFINSRPVHQKDILKLIRHHYNLKCLKESTRLYPVFFLKIDVPTADVDVNLTPDKSQVLLQNKESVLIALENLMTTCYGPLPSTNSYENNKTDVSAADIVLSKTAETDVLFNKVESSGKNYSNVDTSVIPFQNDMHNDESGKNTDDCLNHQISIGDFGYGHCSSEISNIDKNTKNAFQDISMSNVSWENSQTEYSKTCFISSVKHTQSENGNKDHIDESGENEEEAGLENSSEISADEWSRGNILKNSVGENIEPVKILVPEKSLPCKVSNNNYPIPEQMNLNEDSCNKKSNVIDNKSGKVTAYDLLSNRVIKKPMSASALFVQDHRPQFLIENPKTSLEDATLQIEELWKTLSEEEKLKYEEKATKDLERYNSQMKRAIEQESQMSLKDGRKKIKPTSAWNLAQKHKLKTSLSNQPKLDELLQSQIEKRRSQNIKMVQIPFSMKNLKINFKKQNKVDLEEKDEPCLIHNLRFPDAWLMTSKTEVMLLNPYRVEEALLFKRLLENHKLPAEPLEKPIMLTESLFNGSHYLDVLYKMTADDQRYSGSTYLSDPRLTANGFKIKLIPGVSITENYLEIEGMANCLPFYGVADLKEILNAILNRNAKEVYECRPRKVISYLEGEAVRLSRQLPMYLSKEDIQDIIYRMKHQFGNEIKECVHGRPFFHHLTYLPETT

SEQ ID NO: 1015430 - protein, 189 aa, Homo sapiens; identical to SEQ ID NO: 933832

SEQ ID NO: 1015431 - protein, 374 aa, Homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRTKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 1015432 - protein, 354 aa, Homo sapiens
MSRLLHAEEWAEVKELGDHHRQPQPHHLPQPPPPPQPPATLQAREHPVYPPELSLLDSTDPRAWLAPTLQGICTARAAQYLLHSPELGASEAAAPRDEVDGRGELVRRSSGGASSSKSPGPVKVREQLCKLKGGVVVDELGCSRQRAPSSKQVNGVQKQRRLAANARERRRMHGLNHAFDQLRNVIPSFNNDKKLSKYETLQMAQIYINALSELLQTPSGGEQPPPPPASCKSDHHHLRTAASYEGGAGNATAAGAQQASGGSQRPTPPGSCRTRFSAPASAGGYSVQLDALHFSTFEDSALTAMMAQKNLSPSLPGSILQPVQEENSKTSPRSHRSDGEFSPHSHYSDSDEAS

SEQ ID NO: 1015433 - protein, 150 aa, Homo sapiens
GGRAVPGLTAIHEGVEPACLLGLYKSHWLAFRAGLLAAPAAVNRPAEVHGSPPASLCPCPSVKFQTGLPAMALPKPSDGTLPAEVQGRGQRRRLVWTPSQSKALQACFERNPYPGITTRERLAQAIGIPEPRVQILFQNERSCQLRQHWH

SEQ ID NO: 1015434 - protein, 312 aa, Homo sapiens
MSISNITVYMPSVLTLVGIPGLESVQCWIGIPFCAIYLIAMIGNSLLLSIIKSERSLHEPLYIFLGMLGATDIALASSIMPKMLGIFWFNVPEIYFDSCLLQMWFIHTLQGIESGILVAMALDRYVAICYPLRHANIFTHQLVIQIGTMVVLRAAILVAPCLVLIKCRFQFYHTTVISHSYCEHMAIVKLAAANVQVNKIYGLFVAFTVAGFDLTFITLSYIQIFITVFRLPQKEARFKAFNTCIAHICVFLQFYLLAFFSFFTHRFGSHIPPYIHILFSSIYLLVPPFLNPLVYGAKTTQIRIHVVKMFCS

SEQ ID NO: 1015435 - protein, 189 aa, Homo sapiens; identical to SEQ ID NO: 933833

SEQ ID NO: 1015436 - protein, 125 aa, Homo sapiens [sequence omitted]

SEQ ID NO: 1015437 - protein, 774 aa, Homo sapiens
TPQVIGGVAWSEGLAGVAWSEAPWRGVLRPAEGVDGMRRREGHGTDSEMGQGPVRESQSSDPPALQFRISEYKPLNMAGVEQPPSPELRQEGVTEYEDGGAPAGDGEAGPQQAEDHPQNPPEDPNQDPPEDDSTCQCQACGPHQAAGPDLGSSNDGCPQLFQERSVIVENSSGSTSASELLKPMKKRKRREYQSPSEEESEPEAMEKQEEGKDPEGQPTASTPESEEWSSSQPATGEKKECWSWESYLEEQKAITAPVSLFQDSQAVTHNKNGFKLGMKLEGIDPQHPSMYFILTVAEVCGYRLRLHFDGYSECHDFWVNANSPDIHPAGWFEKTGHKLQLPKGYKEEEFSWSQYMCSTRAQAAPKHMFVSQSHSPPPLGFQVGMKLEAVDRMNPSLVCVASVTDVVDSRFLVHFDNWDDTYDYWCDPSSPYIHPVGWCQKQGKPLTPPQDYPDPDNFCWEKYLEETGASAVPTWAFKVRPPHSFLVNMKLEAVDRRNPALIRVASVEDVEDHRIKIHFDGWSHGYDFWIDADHPDIHPAGWCSKTGHPLQPPLGPREPSSASPGGCPPLSYRSLPHTRTSKYSFHHRKCPTPGCDGSGHVTGKFTAHHCLSGCPLAERNQSRLKAELSDPEASARKKNLSGFSPRKKPRHHGRIGRPPKYRKIPQEDFQTLTPDVVHQSLFMSALSAHPDRSLSVCWEQHCKLLPGVAGISASTVAKWTIDEVFGFVQTLTGCEDQARLFKDEVRCKCRVGDRAGVTVLKTAGSRCPPQRHFC

SEQ ID NO: 1015438 - protein, 310 aa, Homo sapiens
MWYNNSAGPFLLTGFLGSEAVHYRISMSFFVIYFSILFGNGTLLVLIWNDHSLHEPMYYFLAMLADTDLGMTFTTMPTVLGVLLLDQREIAHAACFTQSFIHSLAIVESGILLVLAYDCFIAIRTPLRYNCILTNSRVMNIGLGVLMRGFMSILPIILSLYCYPYCGSRALLHTFCLHQDVIKLACADITFNHIYPIIQTSLTVFLDALIIIFSYILILKTVMGIASGQEEAKSLNTCVSHISCVLVFHITVMGLSFIHRFGKHAPHVVPITMSYVHFLFPPFVNPIIYSIKTKQIQRSIIRLFSGQSRA

SEQ ID NO: 1015439 - protein, 312 aa, Homo sapiens
MWPNITAAPFLLTGFPGLEAAHHWISIPFFAVYVCILLGNGMLLYLIKHDHSLHEPMYYFLTMLAGTDLMVTLTTMPTVMGILWVNHREISSVGCFLQAYFIHSLSVVESGSLLAMAYDRFIAIRNPLRYASIFTNTRVIALGVGVFLRGFVSILPVILRLFSFSYCKSHVITRAFCLHQEIMRLACADITFNRLYPVILISLTIFLDSLIILFSYILILNTVIGIASGEERAKALNTCISHISCVLIFYVTVMGLTFIYRFGKNVPEVVHIIMSDIYFLFPPLMNPVIYSIKTKQIQYGIIRLLSKHRFSR

SEQ ID NO: 1015440 - protein, 83 aa, Homo sapiens
MATTALLPLAKLVSPEGEGSSALIQPPAGSVAEEDKGHKHTHNLSLGFLSEKGGGAEATKAAARAFLKGLSSGPGLGPGSGED

SEQ ID NO: 1015441 - protein, 56 aa, Homo sapiens
GILDGCNGRCVRVPEASPAVLRRLPLDMTRMACVDINECDEAEAASPLCNRCLNTD

SEQ ID NO: 1015442 - protein, 35 aa, Homo sapiens
MLSYFSLSRVFLYNFTSSYSSGLFPGLLFPAWLGS

SEQ ID NO: 1015443 - protein, 69 aa, Homo sapiens
SSHGCTQLLGTLLLEPTLNENACNLRGPTAPQNPARRGKSREGIPSPRQPMLAETNSAPNLHRVSHDPS

SEQ ID NO: 1015444 - protein, 123 aa, Homo sapiens
MVGTRLAGFCKYQHAFHIRRLHVLEYCVRGRTIRGNLGDTRVGLRKKKMFVVAQTHKHGPRDGANRATEGESSTPLATGPGAHFSVREWGHHINTSRRENSYSPDTVGKELLPKKLLVHKPSV

SEQ ID NO: 1015445 - protein, 129 aa, Homo sapiens
KPPTHRAYRTSGEGRWPWQQYSPNPRHPLNGATDRYPCDGVQLRDISGLFLPLQLNPCTLGRQCPTSRESTRVSPQPKRTRRLLGLASGSIHKRGATEPQACTHKGNPRQALKFVTHPRGSPCPLQPGE

SEQ ID NO: 1015446 - protein, 58 aa, Homo sapiens
DQFTSKLHRVKIQTVAAKQGESDPDEERNKAESCRTSGYHQIEASIVRLLNLDRRCRT

SEQ ID NO: 1015447 - protein, 72 aa, Homo sapiens
GIATVRPLRSSMNQGRAGAQRGGGAREQATQEVLEPVHLPAPGLLSGNQCPLCCTISHERLGTPFFQFRPPW

SEQ ID NO: 1015448 - protein, 69 aa, Homo sapiens
PGVAWAPPARCYRYCKNKPVPKSRFCRGVPDATIRIFDLERKKAKWMSFRFVHMVSDDMAVALKFELPI

SEQ ID NO: 1015449 - protein, 71 aa, Homo sapiens
EVPPWTGEVNPAQRDGGASGGALGTPLIDLPPKRQAEGASNCPSEPSKISLFGEDRQDEAKRLAITVPSKD

SEQ ID NO: 1015450 - protein, 62 aa, Homo sapiens
SRATGPSAQTGGREASPQQRQSELGRPAATTSLAPRLHTSVCGQSQHSLPCGWPWGILLGSE

SEQ ID NO: 1015451 - protein, 30 aa, Homo sapiens
MAFAPFLSQFFPFDVGYQNYYKGLLLFGAN

SEQ ID NO: 1015452 - protein, 33 aa, Homo sapiens
FGTGGTWVYPAGAHSISLCSGSSYFWLIRPKGA

SEQ ID NO: 1015453 - protein, 33 aa, Homo sapiens
FGTAQEEITATVKVNLPFGRPRVLQKNVDHCLL

SEQ ID NO: 1015454 - protein, 132 aa, Homo sapiens
NPKTEMLYRRRKGFQQSIVIRVRLNMHAFEIYIDLNANSQLKLCCKVKVHPQKDRAFSGDQQKCGCIYISGDRNYDRSGAAAAFLLTSCMPLFRSDCSLPGNGFSMGNPNPFHRGGIRLLFFKMEHGEGGIM

SEQ ID NO: 1015455 - protein, 108 aa, Homo sapiens
RGKPQGPPEAQNLCVGQWYNHTFILVHSPKFEALLKGPISHWLPLNLNKIYSPVPWLMPAAPALWEAEAGGWLASLRPACATWRDPVSTELKIHAAVIPATWEAEARR

SEQ ID NO: 1015456 - protein, 37 aa, Homo sapiens
MVIKVLLAPLVLLVLGALLVLLALLEKMVALDILVQL

SEQ ID NO: 1015457 - protein, 89 aa, Homo sapiens
FVKRDKQFPPRGKQPMTMITEFKYRLTIGKFGPSPQEFGHEPFEKLPNQDRVQVARGYNPQYFGRPKVEGSLESQEFKTSLGNIVSPCI

SEQ ID NO: 1015458 - protein, 38 aa, Homo sapiens
VWAGAGFFARSDFGSSSGSGNGRDVEKWPKTSTLVERN

SEQ ID NO: 1015459 - protein, 139 aa, Homo sapiens
LLPLTFKSFRVTSLKLANIASCCPKEKPKCPSLRIDVLPNKRPNCYLLIYLTKSCSVAPGCSALARSWFIEALNSLGSSNPPTSVSQVARTTGTSPCLQSQLLKRLRQEKRLNPGGRDCSEPRSCHCTPVWVTGRLRPQ

SEQ ID NO: 1015460 - protein, 66 aa, Homo sapiens
LLKSQELPSPQAEKSLPKLRLEIIDKDSKTRRLDIRDHCPLRCEHHLEPPSLYVPSYPIKHWLWHG

SEQ ID NO: 1015461 - protein, 74 aa, Homo sapiens
MPSSWRQLGPNVLLFLCTTVIGICTHYPAEVSQPGLSGDPRLHPGRLTAAGDRQQERSAVGIAQHVAMEMKRHH

SEQ ID NO: 1015462 - protein, 46 aa, Homo sapiens
MAELQQLRVQEAVESMVKSLERESILQIQGLMFPAAHFCEDSHASM

SEQ ID NO: 1015463 - protein, 88 aa, Homo sapiens
SRNASSRFCRASIPGTLVLDAQGPLNKALELFRRTEASNYKELGFQGWPYRSNPYHLGPGQERRGLISCSHIEFALSVSLSVESAGGS

SEQ ID NO: 1015464 - protein, 33 aa, Homo sapiens
LARLEGGPHFILADEDPRSRRRSPYTLPGAMGL

SEQ ID NO: 1015465 - protein, 53 aa, Homo sapiens
RVTHEEPLWLELPSVLSPEDRCLLPLFPSQSKQEAVLLWEMVLYNWLYFPMAL

SEQ ID NO: 1015466 - protein, 76 aa, Homo sapiens
GNEEGLLGATLAQEKNLPKRQSNLPPNERSSQAETALPYLKAAELASGGGSSPKVRAKKGLLSSWDYGCTPPYIPG

SEQ ID NO: 1015467 - protein, 67 aa, Homo sapiens
QHYPHRGGVHQYRLQPLKGQESRLRRDPRASGFGQTELNEPIAASFQLPLEPEAEHIAEERGVQGAR

SEQ ID NO: 1015468 - protein, 40 aa, Homo sapiens
EQDALPSSEDDDDDDDSSSEKETDNTKPNRMPVAPYWTSP

SEQ ID NO: 1015469 - protein, 117 aa, Homo sapiens
FKIQSQNCFIVTHIFNNKKKCRKWLKYRIEKKSQVVQLVLLTSGRRACSHISTAAAVLQRPFADTPWHTCTPRGSAALLAGGHLHSLHLQEPVQQETPVVQEQLGPFRAAVRLEISS

SEQ ID NO: 1015470 - protein, 62 aa, Homo sapiens
WPKSWSGSTGALDQGTEFEEAQSSGLFGARPQAAGEGAKEEVLLGLGELGQALLLPPALAGF

SEQ ID NO: 1015471 - protein, 97 aa, Homo sapiens
ALGPLGYKNKKQPTGEQGGLRGRSCKREGGDPEEKGEPAQEVPVRKGWCAPNMVRRYTQLPIRDQDQQDRTRLPLDLRTLMRPRPLALLPSPLHLVP

SEQ ID NO: 1015472 - protein, 69 aa, Homo sapiens
RPTPIALNLGGGCQAEIALLHSSLGNRERPCLKKQQQQKVVIAIIGFLEPKNLRGGTIPVKTRIGSWFE

SEQ ID NO: 1015473 - protein, 127 aa, Homo sapiens
ARAGRWPEQPGRVLELPKVGSCAEAGEGSRGSPQGPGWASPKTEKEKGSSWRNPGEAKARQEQESVQPPGPARPQSPQGKGPQPPEPQQAGEASLLLWTMSPRTLDGVEVEIYPEELFLRVFFFFQS

SEQ ID NO: 1015474 - protein, 74 aa, Homo sapiens
ARGHHGQCSWGPVQPCEAPRIPGALPTEVQELLKDRDPKEIEWDDLGPALPDHVRGEPEVTSPSSLSSDAPRAF

SEQ ID NO: 1015475 - protein, 86 aa, Homo sapiens
PFLFNINRAVKGKMKPAITLVFVKVDLKKTVKFLVGPWRLKRWLGTVALCNPQHFGGPRREDHLKIETSLDNTTTQQDPVSTKIKN

SEQ ID NO: 1015476 - protein, 51 aa, Homo sapiens
PPPKSIGSPCRKVAATSNETRGSATLRAASQPALGKSDSSWGLLPPIALRL

SEQ ID NO: 1015477 - protein, 90 aa, Homo sapiens
GEDLTIMSEGKEEQVKSPVEGSRQRGKLVQGDSPFFKTISCETYSLSQEQHEKDPPPGFNYFPQGSSQNMWELWELQDEIWVGTQSQTMS

SEQ ID NO: 1015478 - protein, 59 aa, Homo sapiens
ILNLGGRQHFAQLVASAPRRGDDRVLRLLVHFLQAQGPGPLAEVHRCEAAERASRGERS

SEQ ID NO: 1015479 - protein, 102 aa, Homo sapiens
LGAAARVLGQPQQPQTRQPLQVEELSQAGDRFLRRYSSLRRWHRLTGSRVEMLLTLSVITSRLGISWQMEIICEAVPQQFATLCSSEALARVRTIPRQLHGG

SEQ ID NO: 1015480 - protein, 41 aa, Homo sapiens
MQPRSAELILGLLKSSRNEDSQLNPPYINNQNRKGIKEDKS

SEQ ID NO: 1015481 - protein, 44 aa, Homo sapiens
NGLRTTEEALHASHGFMWYTWPLSGHLDPCPSHWDGINCRPEKK

SEQ ID NO: 1015482 - protein, 55 aa, Homo sapiens
ARFASQPSVWIKGSQHEVPEPAAAFANWELVEKGSVSDPTPDLLNQKLWGWGQHF

SEQ ID NO: 1015483 - protein, 117 aa, Homo sapiens
MSLSMRDPVIPGTSMAYHFLPHRAPDFAMSAVLGHQPPFFLLLPPRRACSRCRAPCQADHGSIGGGETGIPFSSLGPRLHLRPLNTMRPRCATAPTPSRCRSRTAAVCSTALPSAAV

SEQ ID NO: 1015484 - protein, 73 aa, Homo sapiens
CEGQPVTSRLAVICGTSSCHMGISKDPIFVPGVWGPYFSAMVPGFWLNEGGQSVTGKLKTTWYKAMLLFQNYK

SEQ ID NO: 1015485 - protein, 125 aa, Homo sapiens
QPSLQRYFPCSLHVWSPASSFMKGGALCGLVYLFASATSRAARSSGWHPVARAPSGCWAAALGLLAHFLGRCAALLGRLRTLLRGPETKPPGRRSRERRAGASSCPGEGRVPILVSIIKVLVTEK

SEQ ID NO: 1015486 - protein, 135 aa, Homo sapiens
EALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVPEKLSLILQNGSSMENPERVLLLDWQL

SEQ ID NO: 1015487 - protein, 111 aa, Homo sapiens
RKVRSRNSNSLPLKKMSSLSEYAFRMSRLSARLFGEVTRPTNSKSMKVVKLFSELPLAKKKETYDLGYQSEVSFFLGIQIHHTYAGTSWQTLRFLGTLQRMRHQGFYGMSQ

SEQ ID NO: 1015488 - protein, 88 aa, Homo sapiens
PSDFINDATDVNDALDVTRFYREPRPALQEEAAALLQMATRRHALAIEKAVQEASGGHRDLRGGRGPPVNEPTSASWSPARRPEYDVA

SEQ ID NO: 1015489 - protein, 87 aa, Homo sapiens
EKDCGQDRRAPGVQPCRLVTMTSVVKTVYSLQPPSALACHYDTQTRATSKSLLPVRSKEVDVSKQLHSGGPENDVTKITKLETRIAN

SEQ ID NO: 1015490 - protein, 53 aa, Homo sapiens
MRKKRLANESRWSVLVPDRLTYLSPELFSPNLCKAQNATEPLLFSPLPMAGTG

SEQ ID NO: 1015491 - protein, 63 aa, Homo sapiens
SWERPLSARPWQTVYHLSQSWAPKPKGPASSRLGTKASPGALGFTLSFPPPGPRHDPQVTLRC

SEQ ID NO: 1015492 - protein, 105 aa, Homo sapiens
GSYKHLGPDTVLKNTQSTLNSTGNCMRPLILGLPSASAIPKTARPTPPAPQPTRCDDGEYELYFMMHFHLMDSKYIFSSYDFLNTIFFSLAYFIERIQYLIHMTC

SEQ ID NO: 1015493 - protein, 188 aa, Homo sapiens
MWAELELPPQRGQLLETAVMWYDDRYAGESSLEPRSALISKALGLELRGLESTLQASLALAQAKVTIETGSIWANGDSKGRVIGFFVEKQPSLMFKSESASVSGELCDSRQCPRLSAECLYLARGLWEGLDQHLVCSYAVCCFPGEDGTSLPINTLKILSCFFIWSKCLKGKERSPPQLLAWGAAPGV

SEQ ID NO: 1015494 - protein, 317 aa, Homo sapiens
STLDGPFQGCEVAYRPSIDPYFMLTIIVDYYVCFSSLFNGDAVLTLTRIHDRYCTWHPSLISMDVGFLPTHMHAPYTLRTVGIQALIVTSKSGDTLLGWSTPKLCMPSPLAHANRRQSGSLRHMGSEAQLTFKFDMTQAMLTSGVTLHTVHLETRSVSNMLVVLASLSSTDRVRVPSLRREEGAFTPSPPPLSSAYLQSVSEVSALLVPPGMGTWGRGMDFLTGEATQTCGSWSVRGGRNAGPSPPKQPVPCWPHCELDVVSGCGLGLPTEGPLSAATAKGGGFSLQLLCFSAAICHNTQNDSDISHPHLFSVRPCC

SEQ ID NO: 1015495 - protein, 190 aa, Homo sapiens
PVVKIGVYTHASHVLPIGALSLCALNPSVVQRVTKPATVQPYSCDRLLFFRTNQRKSSQWYPHSTSALNALKGMGPFCIRHIASMQGAYIAGVSSPMVLRLEWTTFLGGPTARQHARSVAPRQPHGTGGRPATGSDVGPSYTCAVLTDPMAMRHVQRCNTYINSYISEICLCLVILLCVHGTSTSHYYCR

SEQ ID NO: 1015496 - protein, 96 aa, Homo sapiens
QYVSTKESWMADYKDDKDIESAKSEDMGSSVDPPCFGQTEVKTPKRRQPFVPFALRNHTGCTLWFATLTTTPTRAALSHSGSPGGSSRREREHFLR

SEQ ID NO: 1015497 - protein, 69 aa, Homo sapiens
LLSPALSQAQSSEDGGSVQALYVAGSAWLQHYTCSSLGCRFPPTIPCTMRQSLDFSSERCKVIEDQTLK

SEQ ID NO: 1015498 - protein, 63 aa, Homo sapiens
RPDGQLLLRAARTLEKVGDRRSCNDCQQMIKLGGTALPPPDHQAQPTRTSRFLSLPLSIFPLR

SEQ ID NO: 1015499 - protein, 135 aa, Homo sapiens
VVVCVILICKMEILFTPLWVVVRVRIDCVHDSALYTQQKEKSGCYWLNLFDLYFHHHRPLFDVNLLCCEQTLKLGKPGGMGNHWIRHSYAQDVASPKGTWNRNGLFKFTKPIQGNQDPAFLGLPFSMGLPKVPGT

SEQ ID NO: 1015500 - protein, 105 aa, Homo sapiens
PGSGRSEQARALLEREAEERRQLAALRPSHSQLRPPGRPVDPRRRTPRRRCLYLSFNPPQPSRGTDRLDLPVTTRSVHRNFEDRERKELGSPEERLSSDPDNGSE

SEQ ID NO: 1015501 - protein, 274 aa, Homo sapiens
MEGAGGGGGGSLDGPGRGRPGAKRQSSALDLGSWIPGTFEEAPKESSNGLVESVPCIIMAQVGQSGPVLHPMVLGPHPHAGSRALAMLPAAGQRTASQGQPPRLHTCPELASVCLDTPPMALGLGTPRAALDTWGSRPARASGSAWGRGRGRGRVRPACLVELSRLPSCCMNLGSHTQLGGPSRPSLSLRHHSFWVGDVVRVIGDLDTVKRLQAGHGEWTDDMAPALGRVGKVVKVFGDGNLRVQSLVSGGPQPSCLVATGRGGCNLDVASAPG

SEQ ID NO: 1015502 - protein, 83 aa, Homo sapiens
RKGEERAPLLALVPPPAKVLWKGRAGQTPQDGRDGLVGRRSRGLGSHPAAAGVVFVWLLLSTWSTAPARAIQVTVSNPYHVVI

SEQ ID NO: 1015503 - protein, 98 aa, Homo sapiens
KETQGPKGAAFSSPHVGGKAPGPTALQGWGPLFPSGFPKYRIQAPGTVADACDPQHFGRPRLVESLSSGIQAQPGQHGKTPSLQNIPKKLAGHGGTRL

SEQ ID NO: 1015504 - protein, 42 aa, Homo sapiens
MLEMVPEKRASAGEIARCVEFLANSTNIDSELANVPSTLDLG

SEQ ID NO: 1015505 - protein, 105 aa, Homo sapiens
PQGPAAGTYAGYNNMYHYPGGGHSDIDLMGGTRAGCGACYATNQNAGQHRSVGLDPVFLADADGTRAYPKRRPGRLLLSCGCYVNQRLFRGYQGSLLDQTIGHYI

SEQ ID NO: 1015506 - protein, 168 aa, Homo sapiens
FFGFGGCGGGGEGEGGNWGVRPWVGGGAEDLRRKSYKSATLLREVVGVTLVQGLHQEPQSPWVPSLELSPGEEHVTDLLIQIIPEVVQDALLPVGHPQVQGHGWPVETQTPSHTQQVALASESRSRVPDERVTRRGKPVPRNLEVSVGRKKCIKPWPPPTPPCPGNPW

SEQ ID NO: 1015507 - protein, 33 aa, Homo sapiens
MSNGAPGMQEESLQVSWVELHFSNNGNGGSVSS

SEQ ID NO: 1015508 - protein, 142 aa, Homo sapiens
FHHVGRAGFELLTSSNPPTSASQSAEITDMSHPCLAQRFVLLRKLQINKSLTLGISPNAIPPPLPRPHNRPRCVMFPFLCPSVLVVQPPMSENMRLVFCPCDSLLRNDGFPASSMSLQKDMEIHFLWAGIGISMGVIWPHFS

SEQ ID NO: 1015509 - protein, 136 aa, Homo sapiens
MPMLLPHPHQHFLKGLLRAPFRCYHFIFHSSTHLGSGIPCAQPFNSLGTENATLGCCCQMGLKRKIMVYKQPLKGPHRKGLSGLKEAKVCWGLNFYYLGFNSQGAGVLGQEGHYSLLGPYSRGKGGLARGGFFSGS

SEQ ID NO: 1015510 - protein, 223 aa, Homo sapiens
MVYPLSTRALKAGQGRDRWATRGFPLPALVFEKCELATCTPREPGVAGGDVCSSDSFNEDIAVFAKQVRAEKPLFFLKSRAGQFDDKAIQVLRFHLLELEKVHELCDNFCHRYISCLKGKMPIDLVIDERDGSSNSDHEELSGSSTNLADHNPSSWRDHDDATSTHSAGTPGPSSGGHASQSGENSSEQGDGLHNSVSSLGTVMFDNPDKDKKRQKKRGIFPK

SEQ ID NO: 1015511 - protein, 68 aa, Homo sapiens
LILVASGSLGPGFAWVPAGAGREIHRPRLISSLLRGLSSPDRPSCVQWLLEESVGTVAWRLGSWPFAK

SEQ ID NO: 1015512 - protein, 46 aa, Homo sapiens
MNGYRGRPERQVLRRTARRLARQPFEVAVLAEMDDRVDVIRITQPE

SEQ ID NO: 1015513 - protein, 147 aa, Homo sapiens
LQTLKDRSDHLILKLHRTVLTDKSGRQWKLKSFQTRDNQGILYEAAPTTLTCDSGPQKQKFSLKLDAKDGRFFNEQNFFQLGRKPLQVNKKKLYTPLLAIPTCMGFGVHQGKYRFGVTQPGGGLQSALGFSPKVLSERFVLQVAFLL

SEQ ID NO: 1015514 - protein, 74 aa, Homo sapiens
SVRFVIRVKPAREWQGINHWIANGWFLITRIAALHKPNIKRHIVSDQHRIPNPIAETWDDVTFWIGIGTHRIRN

SEQ ID NO: 1015515 - protein, 32 aa, Homo sapiens
MRVQTEMCATMFRQNEFMYYKMRELPEHQPMT

SEQ ID NO: 1015516 - protein, 62 aa, Homo sapiens
GSVKMRTKSDTVNSSKTVTIGKRPIKFWNQTKLDKVFWLHIFENIVIVHAAAFSLAMRAKAN

SEQ ID NO: 1015517 - protein, 64 aa, Homo sapiens
MTCYDPSVVTFTLFEECKQPPTVAVANTSASTTGRGPSVRRPIRIADTAINQTNRLRTPTFRQA

SEQ ID NO: 1015518 - protein, 57 aa, Homo sapiens
PPLAVPCILVNTMPVSIRMKSLKSLACCKRILTRSLLSKTKQGLQCGCILEFCVELI

SEQ ID NO: 1015519 - protein, 51 aa, Homo sapiens
PPEVDMSDLGISNMLDVNGLFTFIPYHTTCPSHNTLTMVPPNIGELEDLES

SEQ ID NO: 1015520 - protein, 50 aa, Homo sapiens
MGAKEETLYELAGYRDLIVTGMSPISRNYRGDMGTLARQNTCPSHPGHGM

SEQ ID NO: 1015521 - protein, 39 aa, Homo sapiens
MIDTVKKFSRFTWHHISDLPLGIPDPSRRSRLNLMNDWD

SEQ ID NO: 1015522 - protein, 101 aa, Homo sapiens
MSRLTVLIDLRGPPTPWATDRYPEPGHTAGGEQQASKGSFICIYSHPPIDPTAALPPPVRSVAAGDCHRSWNPMVNCACEEVRASFENLMPDLSLLPITSR

SEQ ID NO: 1015523 - protein, 148 aa, Homo sapiens
QKTGPRRSLGPGQGHAEVRPVKGSWSTIPGGTILHLTQQPLRGVTSLRFNQDQSCFCCAETGVRIYNVEPLMEKGHLDHEQVGSMGVEMLHRSNLLALVGGGSSPKFSEIFSDLGTMPGGNSKEKLVLFTFHQASAFLLRIPFEQRSV

SEQ ID NO: 1015524 - protein, 78 aa, Homo sapiens
GNNMTKFTTQKVNELLWVNESFKVPDKLMSIMMNREQREQTFKAFQEVERYTSFDWFHEYFEDEQANEDNQTRFHTRS

SEQ ID NO: 1015525 - protein, 110 aa, Homo sapiens
MPKVTTADNNGDLCAKIVYFFQILRNFRNYGKVDALALSPANASPESFINTRLYLISVMIYLISLSSPLYQIFPQKLVRYMKLPPVYRQLTQLLSNFFGQVSHFLFDTIT

SEQ ID NO: 1015526 - protein, 34 aa, Homo sapiens
MGQVQQRVLNVFQDFKEELLSGLMPARRHSHVGS

SEQ ID NO: 1015527 - protein, 135 aa, Homo sapiens
LLFEPLYHVQNTLIPRFTQGKSLTGSARRTSCGLYDCDLYFLENYIKPPPVNHTTDRSSAAGPAGSSAPGLCATLRASRPGSWEEGDCVRKCGLYFNLTVAAEALPGSAATLAIQDGCALPEVERPCAPLERTRD

SEQ ID NO: 1015528 - protein, 58 aa, Homo sapiens
LKSCNMKAWKSYSAVDVLTLEHCGPGPSGAPEMTAGGNAMTPSVLLRRGCSCACRPLP

SEQ ID NO: 1015529 - protein, 71 aa, Homo sapiens
KLGSPGPGRAHILIPVPIPTLSPTLPQVQAGTTHRNERDMAFPLQPVGGERPGEEPVAFGSEQGHEQHLVL

SEQ ID NO: 1015530 - protein, 101 aa, Homo sapiens
KIESQKLNFKEKAQARWDPSIMWATYLQDSGEDCYYYARLLCVRVPLLGEPAISEAALKAGAPTSASGLQWPTPPCSGGLTKGRPRPDSQIQGDKFETLQG

SEQ ID NO: 1015531 - protein, 111 aa, Homo sapiens
VTLYPSITITIKSNFLALYYSCLPPNNCLADAIISWLSSVTAKSLIIANKSASLCCNVMININEILANSNQINWIFFFEGVHITWDVEVKVVFLNLFKARNVRILVHVFPF

SEQ ID NO: 1015532 - protein, 97 aa, Homo sapiens
LSLAWRGPGWAAVSGGAPQDTHLLKVDSNLGDPGMSLHRGCQAQDPLSPPVPHSLESVPPTPLALGSGDAATSRPGSCMGLGSTCSLRFPQSAEALG

SEQ ID NO: 1015533 - protein, 163 aa, Homo sapiens
MRADACIRCSFQALVTTALTGASKGMQKPLLKYDDSELGPWLHGLARFGSCNKPQLGRSTARHANRGPYAWSLAGTLSSGTPSSLWNTHVSVLCQKMLCAVTVVSEEHDKRNQPARTAAGAWSTSYLRKMHFNQRISLLLNVERHAYVPRRPTLGAWKCCSGD

SEQ ID NO: 1015534 - protein, 33 aa, Homo sapiens
MIVRTISVGLTHGADALLKLVLSCNLTLPLDWY

SEQ ID NO: 1015535 - protein, 94 aa, Homo sapiens
NIKTVARRRNRPQWIRLPKEVYYEANAITYLQDLPSVKRAFIVADPGMVQFGFVGKVLSQLELRQEQVETSIYGSVQPDPTLSQAVELHVNGCF

SEQ ID NO: 1015536 - protein, 42 aa, Homo sapiens
LPALFLVLLVLGFEVQGTKQPQQDEMPSPTFLHPGEGISLPV

SEQ ID NO: 1015537 - protein, 85 aa, Homo sapiens
ALTRGLELTVLSAVAALHRLVVLVGETPLPMALSVAAAMGFTNKGWAVFSEEVWFIGQGQVWPITLTSSLAVLLSTEYTSSTRLS

SEQ ID NO: 1015538 - protein, 80 aa, Homo sapiens
VPSCPFKDLGLSFKSGLHGLVLPPPKAAQQVVIVGGQDHGAPVHQAVVRLQNQQEFRMCCSRSSNTSIRQSWKKLGLASL

SEQ ID NO: 1015539 - protein, 61 aa, Homo sapiens
MVAALCKVSSTVMISKMVSYIIIQTTHHCRINFKWDIKRSQQCLGFFPSVLLHHQKDNPKL

SEQ ID NO: 1015540 - protein, 109 aa, Homo sapiens
PLLDRSHPGLNLINLISMDNKLGPNIMIRFLLVYALTYTDAEDGQKRQISAGQALNMLDGEPNNETRANIMASYEKCGPVPDISPLMTLNHLAGFRLTDQKLMVTSHIL

SEQ ID NO: 1015541 - protein, 117 aa, Homo sapiens
VSCGDGGKPGFVRVRDGRRSGSSCVTGYRFPSPEISGVGQKSHPVTPSLVLVTDSRHWDSVPVICLGDSQMGRRWESEGLWSPEENLGLCDYETAPVDHLTSTSVVILIETFGVFSV

SEQ ID NO: 1015542 - protein, 70 aa, Homo sapiens
ITKANHILAEDAEVVAIANDELWHHAGRAGYAAKTVTTPGAGRKVGISGLGLPDAESLSWVLDLPPYYGG

SEQ ID NO: 1015543 - protein, 98 aa, Homo sapiens
MSFHGACRSTNTLQFSTLLDVHYLADKAGKSPIVEQRLQASVSVVVVIHLLIYLPSVGASFNITSTITRVFWINAALLVLRSKLALQSMLVLVPTTSR

SEQ ID NO: 1015544 - protein, 38 aa, Homo sapiens
WKNSRPRLGKRGPMDDGFVSLDSPSYVLYRDRAEWNID

SEQ ID NO: 1015545 - protein, 31 aa, Homo sapiens
AVLTESVLKEKSADASESEATDSDYEDALPK

SEQ ID NO: 1015546 - protein, 77 aa, Homo sapiens
NTMWVKPLAPALCGCVNVLKAERTEACMAAIVVVFRNSFLWAWLMPCNPSTLGGRGRSLEVQEFETNLANMVKPCLY

SEQ ID NO: 1015547 - protein, 305 aa, Homo sapiens
QEVPLGACTSGLPLFLRPSPLLPPGLRHGVPLGKLVARLFFESRPPPVWVSCGQPLCWTLYRWIRLRCFLAVSLRTGDGETAVSHARSSFRRAVTQLRSSTYACLAPLATPAVFSHMASPAPPGGLGSPPVATELPMCSPGLALSLSIYPAYLTAKRRVPTHGHAWVLPEKAPCLYGTRKTTCVPACVFVDLLPSSLEPLSEARLSHKSVVPTKVAILLLGHTNNAAGIPPLRNHPFSKRYSPAALNLAETLLLHEGHPLPANIDSHAFPSWTDYQMLDPADGPVGRVSMTESISFFSPNKNQNP

SEQ ID NO: 1015548 - protein, 108 aa, Homo sapiens
MGLWAQASERTGASPVPWRLGLSALRKSLGRDLSLPAVRSPSAPRLVVTAALPPATPVMIAMEPRLRWHYYKPKRRGARSNKGKLSILSSMLGSLKYQLGHLSLVRSA

SEQ ID NO: 1015549 - protein, 38 aa, Homo sapiens
GFDLNFHQASLQQVIPLLPLGPLGGSELKGLAQNTGAF

SEQ ID NO: 1015550 - protein, 68 aa, Homo sapiens
HPFSWLTFILVPKPRKGIGSGWASLEDSLSLSPIIPYPANLPFPNLLKTLRISQNSPIVGHLIHHQSL

SEQ ID NO: 1015551 - protein, 121 aa, Homo sapiens
VVAHWRSRERSPAAVSVARWMHLRPPSPWRPRPPSVVAGASPPDPSPPKTSSNVNLEWPQSQFPTPSEAPPSTSYSLHQGGWEPSAWHFPQPSGSSAVGQSKFRGCHRGKDRGSKSNSPPA

SEQ ID NO: 1015552 - protein, 56 aa, Homo sapiens
NALNTYDMAAHTDVPRLTALTIAFTCSRVKPLVTPLRGTSWNPGGKLLPLLPPPGR

SEQ ID NO: 1015553 - protein, 71 aa, Homo sapiens
KVTPRNGDCQWPYWVLGDGERSGCLHPTPDITVPDLGVANADSALSGHTISPGVTSTTTLHQGSVGFNLSY

SEQ ID NO: 1015554 - protein, 109 aa, Homo sapiens
RSYRVIGIRSNAEPRAEVAGDPLRDGIDVRVVLFRQPSSIDSTSLLAPASRIDDRILVRRVADGRQHVGDLQVDRFVRDIVSRGSGLVVHVGVSGGGNRIEAEGVGAPV

SEQ ID NO: 1015555 - protein, 102 aa, Homo sapiens
MVPTGCSCQAVPAGSCRAALSPTSASFLCWSAAKVQRGLSQQGLGMFSAGPGACAHPVGFVEQHGFLFFLWSKWGCQGVGGETRGAGTRAFSGAFKGQRGFL

SEQ ID NO: 1015556 - protein, 121 aa, Homo sapiens
GVATAFNPPGNPAAACLRKQKDVSGSNGTVHAAPTDASKSICGAFSSRGNAPMLLPQFVGKQRRDDDERQHEEYSEYHLLEHDSLLAVAGTLAPILGSEPARVHFLTVRNWVPRGVRTYAG

SEQ ID NO: 1015557 - protein, 70 aa, Homo sapiens
KLLCDLPFQVIYRCPWGSPCCENHECRLLLEESFCITMCRGLLPEMLMCSSLISGRSDSGKSSSFFFLGS

SEQ ID NO: 1015558 - protein, 34 aa, Homo sapiens
KEPGGFSEGLCYLMVPPGARPVVSPGPALLAGGT

SEQ ID NO: 1015559 - protein, 86 aa, Homo sapiens
MADALTDAGAPVTQGDAAGELCRMGACVHDAILGGVTICVEAMSDAHLMPRRRQKNGTMTHLEFLFEELKSLFREHHKGFPVLNRL

SEQ ID NO: 1015560 - protein, 124 aa, Homo sapiens
ARGSACNPACSRSLQPSSRRRHERMPRHIAGIVRCEERNDRCHFVGGCQASGRCRFGKSQSRFVRCPDAAVMERRIDQPGAQRVDERPRLEPFRFDAVFRHPDSPRALLGDIRTDAFFEADGRP

SEQ ID NO: 1015561 - protein, 69 aa, Homo sapiens
MDELAGPGRPSLDFPSPSLGSSDPQMQPHPTELPGPDLLTLRKLGSAERTLCPNDYMWSAEHCRGAGTQ

SEQ ID NO: 1015562 - protein, 108 aa, Homo sapiens
DTFEAPGEAGPNSGLCLGLALSSGPLRGRYLGELLLPAHSSFRFHSQPLLKVPGEVASVGVRKGIFLTPLPSAGRSMPGVSGPGQGRWGAFGDQKGEMLLPRAYAVKT

SEQ ID NO: 1015563 - protein, 34 aa, Homo sapiens
GGSIKPMLVLASGDNQGIPIMSSIKLKEEQQITT

SEQ ID NO: 1015564 - protein, 90 aa, Homo sapiens
FFGGKYFGAGLVLQVSENSASAPCDAKHPAVYGFERELQRGGHQVAHAAFVVVESIAPPVCRLNSELVYSSPKVAAPHAYVPPAPQNARP

SEQ ID NO: 1015565 - protein, 71 aa, Homo sapiens
WYPIKTLVETTVNLLTIQMMLLLQRHDGYQPVSQEYPKNEVFLFPRCPRHPYVTPEVVIEKVVPFPFSITK

SEQ ID NO: 1015566 - protein, 38 aa, Homo sapiens
VDLLRGLPRVSLANLKPNPGSKKPERRPRGRRRGRECG

SEQ ID NO: 1015567 - protein, 122 aa, Homo sapiens
SDVGHGHRSPRLLILVQLKILSGYLLGSRPMGSMDVHFNPCSPISRPVRFLPSSTGPLRQRLGWCVSVLLVVIVCTVALTWAANLWVPTTSQSFAFSCSGHPKGSCGPPDAGDGVLLVHQRF

SEQ ID NO: 1015568 - protein, 55 aa, Homo sapiens
MLLREYRQLQEQQSLLPSLSPQPSPLSSKKQPEDNGAPLLLPIKRLGMLGNKLHQ

SEQ ID NO: 1015569 - protein, 47 aa, Homo sapiens
MVPVTSALGGGGSPGPRSSSCSHSPPSSAGVPPVPSGPPLFWVMLVL

SEQ ID NO: 1015570 - protein, 100 aa, Homo sapiens
SHLDTRLFRNSWAPWLLPSPRPCITLFLHLALGPCLLHLLTQFLQGRVRAFTHGTVQDMMLLREYRQLQGTAVPTYPAFFPPTIRPYSSKKAARGTTGGP

SEQ ID NO: 1015571 - protein, 86 aa, Homo sapiens
FLKSPKPQNPYKEASSVPRSPKPKMGIVEGAPGLCWSEGRDRDYSNPTRKQIASPRGDPESPKDLQPLDDAFSIPGLIPWDVGSGP

SEQ ID NO: 1015572 - protein, 74 aa, Homo sapiens
LTNFKSDLFGLATEDGRCPIASEVPWTITEAELRVTLTVEGKSIPCLIDTGATHSTLPSFQGPVSLAPITVVGY

SEQ ID NO: 1015573 - protein, 35 aa, Homo sapiens
SAGPKPGAELEEESSSRPCPLSSALGPTAQSLHAP

SEQ ID NO: 1015574 - protein, 131 aa, Homo sapiens
GLRTDNIRLNQKCGLLGRTHFFGTCKKKVDKTELLHRRLESLKSHHSLTFSRGHARSGRPKPLSLLQIDEKSLPNHFHPQDVLSCFILPSLLFKKACVHLGTGLIFVFILQNVFRPKSVAGGPNPGFRDFS

SEQ ID NO: 1015575 - protein, 53 aa, Homo sapiens
MAAGQGGGGGICLRTSGSPPTDATTTCPAGRELFDDPSYVNVQNLDKARQAVG

SEQ ID NO: 1015576 - protein, 30 aa, Homo sapiens
DLIKKKFLRSLHVKHDQGMAAFYDKLDDDG

SEQ ID NO: 1015577 - protein, 48 aa, Homo sapiens
MGAIKDKRGKGKPVTVHQRAMGTAGGLGHPVTEFEAVRDLFTVRVPSP

SEQ ID NO: 1015578 - protein, 68 aa, Homo sapiens
IKGKRTGPGDPWNTRPNPPRTPTGPKNLSKNFKWNPDTLHEIPDKEEKNSLLLDLNNQKHNVFHNFPI

SEQ ID NO: 1015579 - protein, 103 aa, Homo sapiens
MESYMSFPQKVENTPRSPSILPDSSVPFPIMPALTLRKTKPKEFLKSGLDVVVPCLVIPSTLGGPEQMDCLSLRSLRPSPGQHGKIPSLQKVQKLARHGSARL

SEQ ID NO: 1015580 - protein, 83 aa, Homo sapiens
QGLPLVPGSLSESASRPEARRLCQPVLLLGLCVLKAACLGLAKMPAGCLREEGGMLQWVPGGGRLRPWSTWLSNHYIAVQLAW

SEQ ID NO: 1015581 - protein, 130 aa, Homo sapiens
TVLLQMFGPCFFNLLVKFVYSQITTVPETMLAQGFQPILSTDTENEIVLPLGSLDQVSRDFYSSSARQGLTSINFRQGSSYGKTDLPPFWQPPLRLREGVSKFSGRGGRVGRWGLQLWGSWGAQGTSGPK

SEQ ID NO: 1015582 - protein, 98 aa, Homo sapiens
MNERCRKYRNGNEYPGPRLGRKRQAPPPSSPALASPLPLQLQLMPPSRSASWFSCLPRAVCWVKGHPHHPRPISVWSAVPLGCQSLAPLGPTAAPSLC

SEQ ID NO: 1015583 - protein, 66 aa, Homo sapiens
GVAAQFALLRTQVRPVFWQPGAIFIERHGRSLRPSALLAPRLAFVSADRGPCLGLGTTLTECCCGM

SEQ ID NO: 1015584 - protein, 66 aa, Homo sapiens
LARPEREQAAREHVAADAVNVRHPECEDVVRAPCLILQGCQIFVVQTFTVTIFAVAALAAFFRRIA

SEQ ID NO: 1015585 - protein, 95 aa, Homo sapiens
DHHRDHFRAVILDAAEVDADVAARAPHHVAGEDEHHDETAGPAKSMNFLIVSIPFQNTNACSTHSSMKPAHPTADSPREAVAVGHSHTAIFGEEF

SEQ ID NO: 1015586 - protein, 33 aa, Homo sapiens
RPQDFQVQSIELSWFQTVGSALSVEPFSYQGEP

SEQ ID NO: 1015587 - protein, 37 aa, Homo sapiens
MDAQGKDVLLTAFAYRQGLQELITGNDKALSSHEAGS

SEQ ID NO: 1015588 - protein, 43 aa, Homo sapiens
GTRRSLKNLQLDYVDLYLIHFPGVCKASEEVIPKDENGKILFN

SEQ ID NO: 1015589 - protein, 58 aa, Homo sapiens
AQVLMLLLLWVSGTCGDIVDPQNIQLVNANGSWHINRTALNCNEILNTGSAFYVTVTV

SEQ ID NO: 1015590 - protein, 30 aa, Homo sapiens
MSPNCSRAAGVSCTCAGSCKCKENLQEELL

SEQ ID NO: 1015591 - protein, 45 aa, Homo sapiens
AERARQTPLPPLSPRPPAPRPFPTPSSASVPGAADHYDHEIRGVQ

SEQ ID NO: 1015592 - protein, 116 aa, Homo sapiens
NCSGGLFVGVDDCVAAQGVGACEHVVRHSEHALVGAERLDAELVIVVRRTERREDRQQMLVGRMHTRVLLPAVVEQCIDVACASFASNQSVNSVTGPHPREIGRAQVVRDLPEPIT

SEQ ID NO: 1015593 - protein, 101 aa, Homo sapiens
ACRREQHGGQRAARDPCPAMNRLAMLLFCFGFWFLGQGFTVLPRLECSGATAHCDLDLLDSSDPPASASQVAGITGMSRHTRPSHLGFSVGRFLVLETSKA

SEQ ID NO: 1015594 - protein, 40 aa, Homo sapiens
SPPCHHLKTPTPNTECHLCLPPRSTVRPVFDSTQLLNAFP

SEQ ID NO: 1015595 - protein, 37 aa, Homo sapiens
RLHNALTLCIRGEALHHLKAHGPKPTFPNASGSVVEL

SEQ ID NO: 1015596 - protein, 32 aa, Homo sapiens
WKIELTHDIITKFLENEDRRSASLHLPKLSIT

SEQ ID NO: 1015597 - protein, 43 aa, Homo sapiens
DKTNVKAAWGKVGAHAGSRCGALERMFLSDHQDLLPHFDLSHG

SEQ ID NO: 1015598 - protein, 48 aa, Homo sapiens
THISKGTLGKFSVPMLKEAWALYGLKSGLKKQELLEALTKHQDCPEAA

SEQ ID NO: 1015599 - protein, 66 aa, Homo sapiens
DVTKFALYTWDSSQPFTSKGNFSGKYSLEFRSMHNPPSSSFPGPSQPCCLLSIHGKYLFLKKKVID

SEQ ID NO: 1015600 - protein, 38 aa, Homo sapiens
TPEKFYQKLLELEKHIRATIQKTDNSQAHSLIPIIPPL

SEQ ID NO: 1015601 - protein, 37 aa, Homo sapiens
ETSPGQTPPRCLRGSYLLAALGENSSPGAKDIKKILD

SEQ ID NO: 1015602 - protein, 35 aa, Homo sapiens
VLQTALSPLLCAALEEGSPPCRANASGIRRPAWYQ

SEQ ID NO: 1015603 - protein, 34 aa, Homo sapiens
GSPGATAWGELKTSGDVEGSAGPTGWPSGRWSGM

SEQ ID NO: 1015604 - protein, 38 aa, Homo sapiens
QIRRCTDDVRPQDCYHGAGEQYRTSARPASPVPALVPE

SEQ ID NO: 1015605 - protein, 49 aa, Homo sapiens
DILAQGFGSLGLMSPSWSALMEDIEAEALMGTVTRHYREHQKGRPPAPT

SEQ ID NO: 1015606 - protein, 49 aa, Homo sapiens
LLQLLRPAELTGAAHGSVGTQAVARRMDGDSRDGGGGKDGSEDYRTCRL

SEQ ID NO: 1015607 - protein, 69 aa, Homo sapiens
REKNECPAKGEAPYKTIRSFKSLTPEQWGNQPHNSVITTDPSHDMWGLWELQFKKDLGGDTAKPYQGTN

SEQ ID NO: 1015608 - protein, 63 aa, Homo sapiens
LCCVLLTFGSVRADDEVDVDGTVEEDLWVKVEKDQGRMISSTERGEAIQLMIKSSQIRELREK

SEQ ID NO: 1015609 - protein, 92 aa, Homo sapiens
LLPGTLGPAGSSANPVPRPWPCQRGTPAHVGTGQGLSRSHLPTEAQECVDAEPSFRAPFLGPSLPASRSALAHPPYPGVSGLRLENIHFFLD

SEQ ID NO: 1015610 - protein, 57 aa, Homo sapiens
ISHPEGPEERELWATLGGASWGYWPRMSSAISPSSPLLGGLRAPFSEGTTVIQPSQY

SEQ ID NO: 1015611 - protein, 30 aa, Homo sapiens
MSGGANQQFFWMFLVMAPTQSYVRFRIKKL

SEQ ID NO: 1015612 - protein, 42 aa, Homo sapiens
MRGSTVLLQVLQVVYVQLVKFGVGTMDVCAIFLGAPLFKFMV

SEQ ID NO: 1015613 - protein, 80 aa, Homo sapiens
MFSSVTSAVVAKFKSAAYNTFGSPIPNDIAASALIASIPEVESSKPIVCSGGNDKISAARTKISGSGLPLAASLDSTIPT

SEQ ID NO: 1015614 - protein, 117 aa, Homo sapiens
IDETLGPCPKRKKPARRNPLNFPKWKLPLGLGKNPFPSVPFFLYFPSQPLPGRLDEAPSGGSHLLLPLGSFPVGLLGPLCLLCLGGEAALSPRSCGRLRGREPWLEPPLLFPGLGFS

SEQ ID NO: 1015615 - protein, 93 aa, Homo sapiens
PGMKNRLGAIEKALRNFSLRPSPDPSFFTPKKMTDYAQEEGGSLGPNYYSFASQQQKPEDTIPSELAKQVIEYARQLMIVLPPGTGWGRARVI

SEQ ID NO: 1015616 - protein, 114 aa, Homo sapiens
LPIQDQRNARHRLTRRRTPTQQHDERVERNLPRAGRAPVRTAPSVRSRNRNAMPIGLMMPIRPVKPNRISEIRRLTIIGRSIGRGWAAARRRSRIVESAGPRRKLAAGPARRRS

SEQ ID NO: 1015617 - protein, 68 aa, Homo sapiens
PVLVSPARARWLAASPGAFVAGRFVPDDVRRKIALRCRDKRTASRHCDATRAPQGPSPINSPPTTAKK

SEQ ID NO: 1015618 - protein, 104 aa, Homo sapiens
PKKSPLKPSTKKNSPQKKTPNGKNTPQSPPVWGNKATIRGNISTRREIPTKWGNEACKLPPPNLGSVFTQPLVLNEIRQKCTHRIPIYIKFKTPAKIPSHAVAK

SEQ ID NO: 1015619 - protein, 30 aa, Homo sapiens
MADDAVQRGGPGWWLGWGTAVAYGGFNSGI

SEQ ID NO: 1015620 - protein, 37 aa, Homo sapiens
SLEIQKDTGEFVDLYMQRKYSISNLIIGTKDHSSIQM

SEQ ID NO: 1015621 - protein, 81 aa, Homo sapiens
VPLPAFSATAAAAFRSRFHRGKGIVSYVRYPELTLSTLCCCSKGDDLLLLALRIISYKITENAETYYCQDRDDYIKELVKA

SEQ ID NO: 1015622 - protein, 61 aa, Homo sapiens
RATSTFKGNFYSEKYPLDVYGDENPPFHLVYLDPLNLVLLSIREILIERTTKTRQFREERQ

SEQ ID NO: 1015623 - protein, 52 aa, Homo sapiens
VAGSHLAAVQNYKVSVQRFEKWQQIESVSIFSSASGCGICRLLFLDLADIKT

SEQ ID NO: 1015624 - protein, 66 aa, Homo sapiens
GEKGPRQSPARLVAMPRKIEEIKDFLLTARRKDAKSVKIKKNKGQVEVLKFDAADTFNPGIPDKER

SEQ ID NO: 1015625 - protein, 44 aa, Homo sapiens
AASQSAGLGLRRRRVARTQFGCWFQQGTRGYRVHNELSQILRVC

SEQ ID NO: 1015626 - protein, 36 aa, Homo sapiens
MAPSGMNGLEAPLHKDWQRLATWFNSGRKIADVRPK

SEQ ID NO: 1015627 - protein, 58 aa, Homo sapiens
KKNALYRRLSIVVLNQLCVLHEKTPVSDRVTNAAQNPCEQATIFQPGVDNILQELYEH

SEQ ID NO: 1015628 - protein, 30 aa, Homo sapiens
ERENMSSAGSGLPFASAGIWHGPDVANGST

SEQ ID NO: 1015629 - protein, 35 aa, Homo sapiens
SYPLEQKEEPSTHIIQNLNGFMKDECLCKGKFFPT

SEQ ID NO: 1015630 - protein, 32 aa, Homo sapiens
DNEEEEYFVAQGQQCPARRNGLEEATPQPCCQ

SEQ ID NO: 1015631 - protein, 72 aa, Homo sapiens
IESFQAQRPKEEYQTHIQHVENNKNADNDWFRLESNKEGTGGLENSGISMIYYYCPEISGPELDRQTAKMYR

SEQ ID NO: 1015632 - protein, 53 aa, Homo sapiens
FKDNFDEMDTSREIVQQLIDEYHAATRQTTSSGAPGSVWSPGQGPSSVLLVGP

SEQ ID NO: 1015633 - protein, 49 aa, Homo sapiens
MEGGRPGPYRRHQGTYMHLMPHPHQEGKCTRGGAGRNAARWQGTINFTV

SEQ ID NO: 1015634 - protein, 50 aa, Homo sapiens
ENLVKAPLMKHMRILHVNGFNGDSEKATKVQDIKYNLIEAIDTIVAAMST

SEQ ID NO: 1015635 - protein, 51 aa, Homo sapiens
MDSKNFDDYMKSLVWVYYQAGSQHDQAYHNHRKEWGILTLIAHSTFKTQRS

SEQ ID NO: 1015636 - protein, 58 aa, Homo sapiens
VAEDGRLTSRRLMGTYVANMLCRSVLEAGILYGQWPVRLDHGARVYVPASTCPYLVDC

SEQ ID NO: 1015637 - protein, 54 aa, Homo sapiens
RENRSPKTKILKMVYYPELFVLVSQEPFPNKDMERSFLREDFLSQKEVNRKMTM

SEQ ID NO: 1015638 - protein, 59 aa, Homo sapiens
VLGTALSLLIRAELGQPGDLLGDDHIYDVIVTAHAFVIVFFIVIPIIIGGFATDYSPNN

SEQ ID NO: 1015639 - protein, 54 aa, Homo sapiens
SKRKEEEEEEDDDDDSKEPKSSAQLLEDWGIGETLTTVLRGGLSTLTNYKAFSS

SEQ ID NO: 1015640 - protein, 61 aa, Homo sapiens
IHSIALTIARVPFIIPWYVHVINPCSTTHTSSSNQHTKSTYFKYTPLMHQSGGGRPRQCAI

SEQ ID NO: 1015641 - protein, 66 aa, Homo sapiens
LARTSTRKSSGQSNHQVAIAVHRAVTGPLLARARERTFELGLGSRAWPGSGNHLQCTCHECNDAGL

SEQ ID NO: 1015642 - protein, 83 aa, Homo sapiens
DCLNECCWIVCKSKVKPHDVSSLYLAIIKVFHLEQSLKYQTFSYSPLAVYETLARVGLRTFISSERFNITSVQVVIVLICRCT

SEQ ID NO: 1015643 - protein, 69 aa, Homo sapiens
SSKKKIFKGLIPYDQSGFVSAIPAGSFTTRKQAVGTLVGCQLKGPVPDSVNNKFLGMELVSLELAGAQA

SEQ ID NO: 1015644 - protein, 124 aa, Homo sapiens
MAILLPYSGAPQWISTWLARIFTATPEFAWLSTLLLIPPSLEKPLTINSNSPLATIMAVLLISPDVLVTVFSCSQPSANPSPLLHCFIGMPNPSVVPTRELWCSPPLYLSNPCLGSHGLSGPVP

SEQ ID NO: 1015645 - protein, 68 aa, Homo sapiens
PGPLEPPCSAGQLSPHKDLQLCGILEITSLSPPTEGLHAQGLQGELTQACGYSSELRHLEEPRVDVGE

SEQ ID NO: 1015646 - protein, 68 aa, Homo sapiens
IAASTGTSKYCRLRTRYSITHTSQTTTQLPVMMRYTFNRSGYTITASTHALIPMSLINITLIFYGLDH

SEQ ID NO: 1015647 - protein, 131 aa, Homo sapiens
QPNMVMSSIRTSGVVAKFEAQPDVDYRGDIHFFNHAIPNTFYSIGVTLAAGDANAWFKSVFGQDIPFAEWVNAAAESSVGANGLIFTLIFLVNDAYPDADIRGSFTGIDRPINAADFIRAVLEGIIFSFKG

SEQ ID NO: 1015648 - protein, 93 aa, Homo sapiens
ARAHDPGNEPQTMADGQRVGIAQCLSVPTEKETQQLPVSQGTSHNQRVQENGSTLSGQLCSKSSFQSPHSPLLQGLDEAGIAGQQQVQKAHAR

SEQ ID NO: 1015649 - protein, 57 aa, Homo sapiens
NPTWLGSTTVTHGQLDGSRHHAHRKCPPRNATTYESIMAYLEGQTVAGFQSEIQGQG

SEQ ID NO: 1015650 - protein, 86 aa, Homo sapiens
DPNVLIQQAYQTLVSINHPLVEYSATVAKVGNLSLGATVLIMHSDRDLSYKTRVFEVKYDLLNPEMTELSLGDTYQHSITAQIIII

SEQ ID NO: 1015651 - protein, 72 aa, Homo sapiens
NPKSPPNDLTLPVASFKTAVARVLIVSTTIFIDSPNVLDILIGFTHNTVIDAHCFKCGLVSYCDITHLFKQG

SEQ ID NO: 1015652 - protein, 106 aa, Homo sapiens
QQFCLYILGCVGCSLFDQTNVRCTVLLQRICKVYGPLSLPPPRDIPGSQQSRGPAPQEQQQSPELPLHGLLALFKVPLHELHEATETPESIHLVLNDVEDRGETTF

SEQ ID NO: 1015653 - protein, 63 aa, Homo sapiens
GQRWRSTLKPGDAPRFKKLKSRQKARSDPVACPTLSSTGCPTVGSPISLWITETSQEGHQGRQ

SEQ ID NO: 1015654 - protein, 54 aa, Homo sapiens
NRGEVARDDYDEPIISNYQFNFIQQSKSGDVGNDDNIVRILVDPAESERLQAGL

SEQ ID NO: 1015655 - protein, 95 aa, Homo sapiens
RQKIGFCLIQSMNQFWMSQIHGSFFGDSPESVARQIQIRVRRETGIYLSVGIGDSPVLAKIALDLEAKKAPILMATWHYEDVSQSFGQYLSHRHM

SEQ ID NO: 1015656 - protein, 64 aa, Homo sapiens
MRFVIRASLDDAAKTVGVDFIGGYSALVQKGFANGDLALIKSLPRGLTETMIYVISSRRILAHP

SEQ ID NO: 1015657 - protein, 64 aa, Homo sapiens
NTAVVLYGDHYGISNTDAKYLAPILGKDESQWSDLDNANLQRVPFMIHVPGMTDGYIDHTFGGK

SEQ ID NO: 1015658 - protein, 89 aa, Homo sapiens
SLDYTINWIFSDNDGRVQQLFHPQRAHNLVLTLNRKQLYLDWDTHLPLVKALLLQILSSIIDDCFDVVASHLRALGWLILLAYFQGNSG

SEQ ID NO: 1015659 - protein, 65 aa, Homo sapiens
GQKIFFRGLDNSLKITSIKASVGFLCRVFYEEAYELKSLDDFNTVEESIRGQLPAGGYYQTSIAF

SEQ ID NO: 1015660 - protein, 61 aa, Homo sapiens
EHVVRRGIGGSVTDDVDEPRPSEIGSVLGPISPSTRCRTRRDGSGEGRVVLFDWAVRDYTL

SEQ ID NO: 1015661 - protein, 106 aa, Homo sapiens
MRNPYPLWIMSRFIINFMNYADDDIHSDVSLDDPNTLIIEYALNVKYVSVPYSLREFVEVHKSNRSFDDLDENPEDFFVSGEPNCYDEGRSRNRTYMIIIGNPQSE

SEQ ID NO: 1015662 - protein, 116 aa, Homo sapiens
VKDATPAVPHSVDDGRTPAQHDSDSRLGPVGERHTAVNRRSKVVDAPIEEGLSHAAPAHGEAPEGVGQHLHSRRPPRPDQADIAYPPARQLAVGDAPPDPPVDAESFGQLDVTRRA

SEQ ID NO: 1015663 - protein, 170 aa, Homo sapiens
PGPWGSICPAAFAHALQSGTVPARSGRTMAGGAALALMIFGMMGVMVAALDGGFDLSDALAENENKKPTAIPKKPSDGDEFELGDDVVDEENEEKRKKKKKKKMKNENAKKDSSSGRFYDAEFEEEFKVEKEKEEVMVEEEKGKKGKRPTPQACIPGIVRARCEWLEVRM

SEQ ID NO: 1015664 - protein, 41 aa, Homo sapiens
GGVSAIPGFRRRSTHRPPGAIGKKVHQAVQGARACRYAPQR

SEQ ID NO: 1015665 - protein, 68 aa, Homo sapiens
PPVSLKGQTSLKFKKRERGPPKRSQFSPGAVASHPVIPNILGNPKVGRSRDQEIKTHSDPNIVKPHLY

SEQ ID NO: 1015666 - protein, 102 aa, Homo sapiens
MAWNPCQSLTTSSFDDVGVLQKKLVPFLTELNMHLAQGIREAERMILGKVEQLQAWLQALTCPHQRGDLGRYMGNVLNLQQRLGAPAKFPSVKNVACFHFPP

SEQ ID NO: 1015667 - protein, 40 aa, Homo sapiens
FLDQKACQSLMCFEYSFGALLLLNYFEESFCFLKYQFSSS

SEQ ID NO: 1015668 - protein, 36 aa, Homo sapiens
LFDTPPFCSNSTNSFRNTVEGYSDPTESMTLLFESS

SEQ ID NO: 1015669 - protein, 30 aa, Homo sapiens
GILWYRGSASGWNPYRRPFGFQHDELNTGM

SEQ ID NO: 1015670 - protein, 32 aa, Homo sapiens
SGRFFSLTESVCHSGWTAVLVATSACRVQILV

SEQ ID NO: 1015671 - protein, 72 aa, Homo sapiens
ALGHLLHLLTQFLQGRVRAFTHGTVQDMMLLREYRQLQEQQSLLPSLSPQPSPLFSKKAARGTTGAPLLFTY

SEQ ID NO: 1015672 - protein, 32 aa, Homo sapiens
MNCLLLPKLVQCVDAFEEKRQHVISEIGRRGV

SEQ ID NO: 1015673 - protein, 78 aa, Homo sapiens
TWPCLLHLLTQFLQGRVRAFTHGTVQDMMLLREYRQLQEQQSLLPSLSPQPSPLFSKKQPEGQRAPLFLFTYLKGWEC

SEQ ID NO: 1015674 - protein, 47 aa, Homo sapiens
RKGLYAYSRPGHHPMTYNEGDSITKYPAISSPDPTYGALPFPTPTTH

SEQ ID NO: 1015675 - protein, 70 aa, Homo sapiens
VIYKRPTIRHHRRNGTLTQFNTQIDQTNGVVIKLVPDTQTGGVLDPKARAELVAAQTQTVDQQDMTPPDI

SEQ ID NO: 1015676 - protein, 57 aa, Homo sapiens
WRHSKRLRDGGIQKGHMTMHYRALALQVGARDDEIATLVTQLQAAEQVDAAVATDLL

SEQ ID NO: 1015677 - protein, 120 aa, Homo sapiens
KRNGTTTVGSKTREQRPLIQVTLMANPTTCIISSTGIHGKENIWLHEINCAMLPTQANFFLYISPIINVFGVVTSCRSSNAPNNVTNPKRLSQAFDITRCCLAVKTVVTSGTIKSPGRTP

SEQ ID NO: 1015678 - protein, 96 aa, Homo sapiens
DYVIFEAFICKVVRNYIVCKAGVDDHTRLPRTSGLARHTDNAEAMWSGLRTFCTLMMIGAWSIASHGDAGANALTLAAISSYSTPPSQHRLSRCHF

SEQ ID NO: 1015679 - protein, 72 aa, Homo sapiens
MQRIIRIESGDGKVSTGETESREERIQQFRKAGRDKRTNVGRFESRDERVTGMAGAVWPRRKSRERRFHRVE

SEQ ID NO: 1015680 - protein, 80 aa, Homo sapiens
LLPNGTLVHHINANYFLDHHLREAQRKSRAILFSFSSTSEDPSTATYMQFLYGGTPSVACPISSPRVPGRDLIKQTPRLR

SEQ ID NO: 1015681 - protein, 133 aa, Homo sapiens
VNGYYDHLWDWLADSVTADFATPTDLAAVRLYQSVDDALRYLATICRYENRGNHMPEYTMLADFIRVYMSSLKHMETMLSQPMREYGLSFEQWLIMAAIARENAVDINRNCGCRDVTKALLPPIKAVVGVGFV

SEQ ID NO: 1015682 - protein, 76 aa, Homo sapiens
EDTGSVLVLRECTSIADNRRSRRRNNHGHSNLRRIRKEGSYLLACSFKGGLRVHMLDNGLQVYKRKLLQDLNHFQA

SEQ ID NO: 1015683 - protein, 49 aa, Homo sapiens
DESEIKLVLLEAAPTIFNMLQDRRLADKALKYMTDNGVDLRLGAMVTGV

SEQ ID NO: 1015684 - protein, 49 aa, Homo sapiens
ILSEGRLVDSQGYGVAGVNYYTNSGRWVTGENGEFSFSWGETISFGIET

SEQ ID NO: 1015685 - protein, 56 aa, Homo sapiens
MSVFCPRLDIVFNVNLLNLSVRCDCLYWNITHSHNRLVVNFRVINHESVFRGRRTM

SEQ ID NO: 1015686 - protein, 86 aa, Homo sapiens
MQLYLIPPNVFQLFDDLTNRRLRVRSVNDLGFTKLPRFSSTFANNSLKSGTQNKSTRLRNTCNVLAKVPLRYPNHHAHSKFNMTLP

SEQ ID NO: 1015687 - protein, 77 aa, Homo sapiens
TGIPLKKRSGELRRLTGWGPIEAHVPSSLRAVRPRAQVLRPKWRLRTSQYGELSDWSLPATAHNEPWFSISWKTKTT

SEQ ID NO: 1015688 - protein, 89 aa, Homo sapiens
SGYQKSASSAMSTVGKVMMGAGAAITAVGVTGVKSFGDFQASLNQAAVIAGGTSKDINGLADVATKWVLTCLYALVLLQKVLVAMARDG

SEQ ID NO: 1015689 - protein, 109 aa, Homo sapiens
PGTLMQDASTPYQPIIPHTKVHGETNILGLFNTYPPYSTLAQLQCQFIVKFKCTYVLIFPCSMLYFCVLYFCNFRSVLFLGNICSIINLLTFSYVFKKIRASSALNAKK

SEQ ID NO: 1015690 - protein, 67 aa, Homo sapiens
IIGDWAIHAGTADLTNPSASPPPQSAGSSAPAYSHDRVLSVHSFSPIRVAFQAWLVADRKRRSLPNA

SEQ ID NO: 1015691 - protein, 81 aa, Homo sapiens
IDTRDTFVVIKSQQATYYSTGSEAFLKRIKGRHLWFGMIYKARERYFYYYQTGHIGNMTYQIYIGLAEVIGMVLTVRPPYL

SEQ ID NO: 1015692 - protein, 80 aa, Homo sapiens
IPKEDHRATLGQFEMRGFPVLCDEVIHRQGVGHRFIYIGHEPLAMDYTGTPPISNYPICALSTKRKKIRQLVVQPLIIEV

SEQ ID NO: 1015693 - protein, 96 aa, Homo sapiens
EWALVDKVRGENCLEMWGATSCGLSGGRYLFGRDSFEIKLLVAGSYGGKPVFVKSASQGVGGVVLSNGNDLLRLPPCDRCNVFMKLCTHVAGFSSH

SEQ ID NO: 1015694 - protein, 98 aa, Homo sapiens
WHIVSAISSFVCLTGYQHFGRPRWADHLKPGDRDQPGQHGKTNSTKNTKISWAWWCMPVIPATWVVETQESFPWKEEVAEPRVSLYSSLQQRERDFYL

SEQ ID NO: 1015695 - protein, 52 aa, Homo sapiens
PTTGAKPFHCVDSCAKLLGTQALTTVTPANRDSSRRRRPLITQVGIKYLNLV

SEQ ID NO: 1015696 - protein, 73 aa, Homo sapiens
MVRPVWTGVDVGVTNHQIQRYWTCLVKRFNYAPSHVSAMAFTRISELRYIALVTRAPDGLTDRCIVRNLNANF

SEQ ID NO: 1015697 - protein, 82 aa, Homo sapiens
KLKLSRKWLNACPMAKPGLFGYKTKTSARNTIQTSCKPRASKYDVITLADDLNPEGPTQDHGFAGQLSLGVGGHPGLTSLFI

SEQ ID NO: 1015698 - protein, 100 aa, Homo sapiens
MGALTCNWGLPINNWPQVPMPQVGPPGCAPPWLPSLGTQGETPGLSQCLPGPSGWGAKPCAPSFCFLALLRDLTWGVSAILWQHIDSDEPTRPQPILRKR

SEQ ID NO: 1015699 - protein, 55 aa, Homo sapiens
AKMTHQQDLTKSLKKASQESNPGSLLILQYYSDNVLPNHGSRWWSALRRSTTMGF

SEQ ID NO: 1015700 - protein, 40 aa, Homo sapiens
NCSSDETSVSFFFVGLLRWVRALPSDGCGPAQAKSPPCAA

SEQ ID NO: 1015701 - protein, 97 aa, Homo sapiens
LKEFLKFEGIREAFNPPCSAPSPYLAGREHWKDCGGANKSCGPGIQSGQESQAVSQLSQGAEDIFLGTSISFSSSWAPLRGRGGYLGRRCAVKGPAD

SEQ ID NO: 1015702 - protein, 100 aa, Homo sapiens
YLGFIEFFFLIASLVKFIHGGYATLIIYAAILLVMVVWYYGNKRREAISKQDDYVSLKDYRKQLINLSKDDGGPIFARICLHCAYASKYMLKRSMIYSIL

SEQ ID NO: 1015703 - protein, 58 aa, Homo sapiens
THSDVTSASSHCDTQQDERELEATTIITANKWMPPTARFQFADYRSLSSSYRQLAIYL

SEQ ID NO: 1015704 - protein, 139 aa, Homo sapiens
ASASGKNLAIGPEIPSAVTFNQAKPFAPKRSIYCASCQYLYVVVRRTTRNGNRFDNSTTIFDRIRKDTKFRILDRFQTNPEVRREYANQAYPSKTRHRFFPSKCLNCISVKIITDDIMHHRLHHSFTKADFISRINDVL

SEQ ID NO: 1015705 - protein, 109 aa, Homo sapiens
INCGNYKAVGGPTGNAKNKNNVLNAAELLRPACVNDVRVRLHGTSGKRKHSRIGSIRYRYASNAHDCGARQPAHPLPAHPLESSRPLPRPPRSVPADHRLDLNLFLDAV

SEQ ID NO: 1015706 - protein, 70 aa, Homo sapiens
PWKMKERERRPCSSRASAAILTPDDDCNSPPLSDTYFNWYIRTVRMQAIRRVEGLAKTRGLGLNENPVLK

SEQ ID NO: 1015707 - protein, 117 aa, Homo sapiens
AARLYLAPDRKTGSSGIWIDLAIVLLPLIRPLRLLRLVVLVGALQKALGKRIRGKVIIYTISGAVLLVYVGALAVYEAERGAPDGHITAFGLAVLGDDHDHRSVTATCIPVNTGPSH

SEQ ID NO: 1015708 - protein, 77 aa, Homo sapiens
MARSRWSLSLHSCWIHLQKGCHFTLGRLHSGQAEALLTSQTGGGQAETLLTSQTGQPGRGAPFLDRVQRRSSPPRRW

SEQ ID NO: 1015709 - protein, 106 aa, Homo sapiens
RTQAGESQIFPLVGSFFQEKYSCHAGLSKESLQLCPNSQAVLVLVNSLGEDDFFSPSFTTADTGGAFPMGAWHGYTYRTTSLETLQGDLHPHREGAFPSAGFALRR

SEQ ID NO: 1015710 - protein, 123 aa, Homo sapiens
DAQHESGRSSSKSSHCDSPPRSQTPQDTNRASETDTHSIGEKNSSQSEEDDIERRKEVESILKKNSDWIWDWSSRPENIPPKEFLFKHPKAHGHPSGMREHGGVHGRKGGLISLARIFLSFPF

SEQ ID NO: 1015711 - protein, 56 aa, Homo sapiens
RGHALKVRSMDLLEGKEGPEFGQSSKAIRLLNVDRRVPETSVCSLVPPPPKSDRLE

SEQ ID NO: 1015712 - protein, 69 aa, Homo sapiens
CNTGLLRVARQQHMSNPVLDLLNNHRSIRAYTNEPVTDDIVTTILSAANAGPNMNNYQPVTFIELRTKH

SEQ ID NO: 1015713 - protein, 51 aa, Homo sapiens
AHLFLAKPEAALPQNVLGTSVAQSFTGTCGEGLIAADVLLCIKTYVCGDTY

SEQ ID NO: 1015714 - protein, 85 aa, Homo sapiens
VNAIDNADIVVALLDAKDQDTGTIWEMVYAYATHKPVVVLTVGDTFEYTINLMPAQGAIHHLGNNTLATIDFYGNNKRFYVGKQS

SEQ ID NO: 1015715 - protein, 109 aa, Homo sapiens
MQKKQQKTGFSVRSVVATGIGAAVFFVLMKFIAIPTGVPNTTINVAEGWLALIASLFGPVVGLLVGIIGHTLNDAVTYGAPWWSWVIADGVFGFLLGLSKSRLPWNMAH

SEQ ID NO: 1015716 - protein, 36 aa, Homo sapiens
MDIRLEEQEKKSTYDIAQAASLSWIDSLKFDDYNIH

SEQ ID NO: 1015717 - protein, 58 aa, Homo sapiens
NIKLSSTKSDVDATYAVSNIFSSRVHSREGKSSPPRGAQLFLGTAKDTHLTDTIVMAN

SEQ ID NO: 1015718 - protein, 50 aa, Homo sapiens
ADFGISAGQFVAVFWDEVIPSGGSERSRWISSSVNRNEGRVSVDNIKQLQ

SEQ ID NO: 1015719 - protein, 49 aa, Homo sapiens
VYRRHTRLAFPGCVYSLTLQKTQRPGSVRCWVLKKFDGGWVKEPGAKAK

SEQ ID NO: 1015720 - protein, 51 aa, Homo sapiens
YVRKEDMTYAVRKLDNTKCRDIMRAKLPTSRVKVDGPRSPSYGGTRYTKPL

SEQ ID NO: 1015721 - protein, 68 aa, Homo sapiens
TIIWSETGDKVPSKTVAAKKGNRLQIQSKAQESPKQRTVVEAVNSDSDSEFGIPKKTTTPKGKGRGQR

SEQ ID NO: 1015722 - protein, 115 aa, Homo sapiens
SKYGVALYHAERDLKRLFQVPQNVVAAQIGYADDEASCDVIHNRSWLLESLSGFAVISRCPLLTAVRSSRSHHFGKSCRPPCIIAAIRSTARSSISLGKIEHNSNWAIRDLTTGP

SEQ ID NO: 1015723 - protein, 51 aa, Homo sapiens
ADTLTGDVLEDARETRGGLAKKTIRESRVGGLTHLWIYEEKSRFGGKAIKV

SEQ ID NO: 1015724 - protein, 31 aa, Homo sapiens
LRLVNQPVRLDVHAARRDKDHHGLLTNTAPE

SEQ ID NO: 1015725 - protein, 71 aa, Homo sapiens
RVTSAQDKQLANFETLRNEVFDSIRAMIISVTDVLMCYTQDGPEQRIYLRLCDLRPQTDMNGLFHSDNLSV

SEQ ID NO: 1015726 - protein, 116 aa, Homo sapiens
GRSCGEGVGAASIPDSAVDSAESGSRAPGTCPPQAARRSLQVGPGPGAGWNLREGGGDRAQGTRGGSRDPDISGQASCRFRAQPPPFDTYFDDETMGGVLLFVPGRGTPGPTPNSK

SEQ ID NO: 1015727 - protein, 50 aa, Homo sapiens
IAKTIENSEELNGRLSDAWLILKLATCHHEFFEINSRLYIMPRQGLQTYQ

SEQ ID NO: 1015728 - protein, 49 aa, Homo sapiens
PVIQRVDLNDISPLGLATVIAYAYLEAHSLLVYNRKHYFCYYYIRSTTL

SEQ ID NO: 1015729 - protein, 51 aa, Homo sapiens
QGTAGVRGLSPSMHPPPGSGFSISTPPEGFCLPLPLRSQEAVLAGVAGTCH

SEQ ID NO: 1015730 - protein, 50 aa, Homo sapiens
SAGPETSSLPHQLWMDVRAYPMRLSRLWHTAVSQILAGLVELIVVSLRKV

SEQ ID NO: 1015731 - protein, 120 aa, Homo sapiens
ALSNSFGFGGTNALLIFGPPPRPDSRGVPDTPVRHLISQGIRPDSHLHIRSLNVSLHAMRTTSFKSMECPTARALDCIGEFWDAPDPGGDCVNRGCYTLSDEFPGAVGDLPPIRLNGADL

SEQ ID NO: 1015732 - protein, 49 aa, Homo sapiens
MRLVVLMALLAHARVMNPAERPGLRPGDPILGAVILRWGRGEQLSPGTR

SEQ ID NO: 1015733 - protein, 128 aa, Homo sapiens
KLKTPGRIRALLERRLTGTDPTRYKYRLSKMGIDLFPLLVVLFDWGSKYLVNDGVAVQQRESGRVLESVVVDRTDCGRFTVDRVLLKAGPVASAAVHERVEQVRCAKVPRAADRSRTVGTRNRPEYRP

SEQ ID NO: 1015734 - protein, 50 aa, Homo sapiens
QLGKILTKTGELPSSTTHPKETEEELTEQQEDFTGEGALTMPRKLPQRVS

SEQ ID NO: 1015735 - protein, 49 aa, Homo sapiens
SLTNYNGTVDSRAESIDKKIFRLVNELVKYKVHIKDERGPAKNMAKQKA

SEQ ID NO: 1015736 - protein, 49 aa, Homo sapiens
TSQNTPKEANQAIQVASTVPPGFHSYIAEATDLGRRLFLLPQLCPAFTL

SEQ ID NO: 1015737 - protein, 48 aa, Homo sapiens
PRCNFLRSSRIRDNPTPAPMRRVRPERDKVVIPEVHRVKSVPFCMYPV

SEQ ID NO: 1015738 - protein, 48 aa, Homo sapiens
AFRKAAKSRQREHRERTQPGFRKHLGLLEKKKYKLRADDYRKKQEYLK

SEQ ID NO: 1015739 - protein, 49 aa, Homo sapiens
RGGGKMEDHQQRYQIDIQTQQALRLDWRTEGMQPEMAELYEDEKINDDI

SEQ ID NO: 1015740 - protein, 50 aa, Homo sapiens
KSVDAGEMNRGLGGAGSLADKRTAAAAAAAAGGPFADVLLSLNISPFEKA

SEQ ID NO: 1015741 - protein, 50 aa, Homo sapiens
SVGATLQKNRLRVTTKMPVRAHSAAVVPAFPRRATWFQNALGQRHCCKDF

SEQ ID NO: 1015742 - protein, 111 aa, Homo sapiens
PGMAGNCRPVLVVQGPSSLWSNWGAACPSLPWSPKPLWAQGHQPGSVLTLLVAPSPGLSSDHPCLPPICMFHLTPGGWQVEVSHVAPARAEHLTLTVAGHWVSAPNKSNSN

SEQ ID NO: 1015743 - protein, 50 aa, Homo sapiens
RPAQLHDDGTRFCHTATRPEVERKPKITASRKLKLKSLMLAKARNAGSRS

SEQ ID NO: 1015744 - protein, 58 aa, Homo sapiens
QLHRLLCEMHQRSWLLTLAGYAQTDWIRVETASTQEQHGPSMEKYEIDQMEMFVLEGS

SEQ ID NO: 1015745 - protein, 48 aa, Homo sapiens
MVRVSTNLCPGKDKANWPNCPGVINPGECKIGIMPGHIHKKVVLAICP

SEQ ID NO: 1015746 - protein, 53 aa, Homo sapiens
KFPCYWLQSNTTPKNGPGPTKPNTAGPDSTDLTIDGFQPQWSMWLVSMLRIQA

SEQ ID NO: 1015747 - protein, 53 aa, Homo sapiens
GRQYPSQSRNMAQAHQHQRVPAPDHICRLCLASLNPKKCYAPEKRVALKHLAN

SEQ ID NO: 1015748 - protein, 76 aa, Homo sapiens
FSRLPFLKAKVIQKRTGKTKGTGFVSFKDPDYVRAMREMNGKFVSRPIQTSQEHVEGPESDVVRKKQKEKKKLGLR

SEQ ID NO: 1015749 - protein, 107 aa, Homo sapiens
TKAVAHVDEMPNALSALSDLHAKLVDPVNFKLLSHCLLVTLAAHLPAEFHPCGARLPGVPGFCEHRADLQIPLSWSLGGHASLGLPPAPPPLPAPVPPWSLNKKSGR

SEQ ID NO: 1015750 - protein, 63 aa, Homo sapiens
YYPGPPNSGGQYGSGLTPGGGYGGSLEVLWTPAVRAYGHPCWDVPSGLRRTIWRFTPGFLWSV

SEQ ID NO: 1015751 - protein, 70 aa, Homo sapiens
TLERQVAGQTRSRRHTRQSSEPRTAPGPTTAVFYMSVKFLDAVRTITDKWLVLGPSCDRSRHESIQELSM

SEQ ID NO: 1015752 - protein, 53 aa, Homo sapiens
MGIQGLANYLLMWPQCIRENDIRSYFGRKWAIDAIYEHLSVLIAVRRVGMCCR

SEQ ID NO: 1015753 - protein, 62 aa, Homo sapiens
ELGRDTGRFDRQAASEACFYNSDYVAARGPRQLQEQEEELLESLDVYELFLHFSSLHVLRAV

SEQ ID NO: 1015754 - protein, 55 aa, Homo sapiens
ERPPTPAERRRDQDQGDRRRCSARLCMPSPPVESAESPGAESMLVPLARVSCLAY

SEQ ID NO: 1015755 - protein, 223 aa, Homo sapiens
MDPPRPLLLSILLLFLTEAALANAAQEPTENNPKICLLPLDYKPFLALLLRYYYHTYTQTFHHFLYLAFHPNPNNFYTSQAFHNASFTIQKLPKLSPLQLTLYHHSHPSTQNYFFNLTSITSQKFFSPPSHPNPIHNTFPHQPTSYRAFSPHQTKNSHAFFPTTPKTSTPLLALTKSSTPLIYFLIPTMKRTLIDLFSTLMTPARPTPMRQMNFSLTHTTDFA

SEQ ID NO: 1015756 - protein, 83 aa, Homo sapiens
GSKKVLLLPERPPPLGMEVSLSWASGPFAPNVLPQDGLLLGGGGVPGHLQRKLLNSAAAPQNLYACTCPRIYSAYLRISNFLP

SEQ ID NO: 1015757 - protein, 50 aa, Homo sapiens
CQERHVIRISQATGTAAVPLISTQISRCCDEQYRLARRDVRDESPRWLSS

SEQ ID NO: 1015758 - protein, 50 aa, Homo sapiens
HLPKLSLSAFTLCLDVIGGTSGHCYVVDFSLSIYGQLSPNCVTRMLTALK

SEQ ID NO: 1015759 - protein, 49 aa, Homo sapiens
RNHHGGWNPGHEPENWRAFKVSTLLSTVGLRSACLRTTPLPFRADQPIP

SEQ ID NO: 1015760 - protein, 75 aa, Homo sapiens
PGVTQVDNKSGFLQKRPHPKAAARRHTALANGAQLLLLGSAGPSTWLYLPCPHELPCTQLTNLACSFSQAYHPIP

SEQ ID NO: 1015761 - protein, 54 aa, Homo sapiens
ARDILFDTFMVQAEWGALTSSQLSGGVQHLLAETCPVELPPGQGGRDLTIRWED

SEQ ID NO: 1015762 - protein, 70 aa, Homo sapiens
RLGVAVAVLGGFLYAVGGSDGTSPLNTVERYNPQENRWPLQPYGPGETLGCQFIGLIYAVGGRVTLRASV

SEQ ID NO: 1015763 - protein, 50 aa, Homo sapiens
KNRAPSKMDPPPGMTLNEKSVQNPITQWMVDMEGPPGPIYEGEKFQLLFK

SEQ ID NO: 1015764 - protein, 63 aa, Homo sapiens
LASSIPRLPSGVRVHIFLQPETEPSAWKALCQHQAEGKTERAEKNLHLYLTWSLNLDMVFPEV

SEQ ID NO: 1015765 - protein, 52 aa, Homo sapiens
QKEKSTKSEGKHEGFYRELVDEKALKHITEIGFRMDASRQAFMENGIILDAA

SEQ ID NO: 1015766 - protein, 48 aa, Homo sapiens
MARYRLLYSERDIVAIMPFIANYMVTCPYDATVQSMHVSERSNEPTFG

SEQ ID NO: 1015767 - protein, 51 aa, Homo sapiens
IKELTTRRGGQKTSAAADLVDKLQLKVKAYSSQAEERRSKPTPPVQFPVQQ

SEQ ID NO: 1015768 - protein, 49 aa, Homo sapiens
RTTTFKDPRNGKPPVTKGGPQMAYERGLRGSFLTAFIGASLMHTESWKI

SEQ ID NO: 1015769 - protein, 54 aa, Homo sapiens
GEDRSVRKVCKSAETMLPKMYVVVKVKTRMRDKGKGKQEACYVGSRRSLLGCVE

SEQ ID NO: 1015770 - protein, 52 aa, Homo sapiens
SRISPGLESIRLEENLLYRLLKSVIVPPFSFVSSKFSKKACVDHILLVIVYL

SEQ ID NO: 1015771 - protein, 133 aa, Homo sapiens
AFRYGKKMQEPACRFIVQVRLKIHLAPCTCRRDGNPGRGAWGLWRLGGVDSSSEGRTRLGRRGGRCTHASESSPHESHQAGQSSSCPRSHRHERRVTRRIVLTAQAGCVAPWMGSWGGMGQGTGSQKINLYWN

SEQ ID NO: 1015772 - protein, 77 aa, Homo sapiens
EEILYGLTRVFRREETEDVVTSDKEGKCDSYESSNSCSDSMKAGTDLLKIVGRTTQSKLEMASCVALLKLVADVAIR

SEQ ID NO: 1015773 - protein, 51 aa, Homo sapiens
MWLFIPMNGIMKDGKRVGIDCVQNGVQWTGGSGHRKEVSENRTQGLCVCVC

SEQ ID NO: 1015774 - protein, 48 aa, Homo sapiens
MVDIGHVDSGKSPLLAILIYKCGESTKEPLKIKKKEADWDGKGSSGLP

SEQ ID NO: 1015775 - protein, 50 aa, Homo sapiens
EYVVEITGDYTTMRRLGLICRGSKRVIISDTLLMPHVRMGVNEKVDTAQV

SEQ ID NO: 1015776 - protein, 56 aa, Homo sapiens
DIERINLHLSLSRLILGRIFSISYGQIVNFYVDEVSWYRYEILAPNRLSHHPGTLL

SEQ ID NO: 1015777 - protein, 51 aa, Homo sapiens
MCELLARYPGPWHLPRGCGRHWAAQWHVAVLVVGGQTWCRETQGLGLMGIK

SEQ ID NO: 1015778 - protein, 51 aa, Homo sapiens
TVLIPACVDRYVRTGEVRHLYEEEDASEGVRLGGPGGTKSGRVTGDGEIGE

SEQ ID NO: 1015779 - protein, 82 aa, Homo sapiens
EELTSRNKPENYSFFKLKKTFLNDEIYCPPETAVPLASHAVQAQVMEDYHKEITKAGTRQMMGPYPGCIGPPTTRTGEKTCL

SEQ ID NO: 1015780 - protein, 49 aa, Homo sapiens
ILYVHVVNVLCPVPAAFFSLLFHVALVLLVFCPCLLLTIQSFRALGFLS

SEQ ID NO: 1015781 - protein, 56 aa, Homo sapiens
SVTFVKVFTAAVKNEKVKNPHNHPPAVSSSALVHPLQAERKYKPGITIMVFISSVP

SEQ ID NO: 1015782 - protein, 49 aa, Homo sapiens
RLVPLLLVLMPPGASSLGTRGFWSGPTLLPPGTPGEGVSYGPVGGLSVF

SEQ ID NO: 1015783 - protein, 51 aa, Homo sapiens
DLMRDRQDLKFEEARDEGTQFRICNEAATVPDSQELAQTLHLMRHETIKLY

SEQ ID NO: 1015784 - protein, 49 aa, Homo sapiens
ARFSLGRVFCGGEPSRVSCAFRPPGGFAPCSPAAFCGRLVGLPAVALGH

SEQ ID NO: 1015785 - protein, 50 aa, Homo sapiens
PGLSWRTWERTSQPYSGQAGRRNPPGNHPPYHHYCSAPSFNNTYHLLITP

SEQ ID NO: 1015786 - protein, 61 aa, Homo sapiens
GKCSLESRGGDSAFQCIADSCLLLRYLSIPQGSFFGVSSRMLSSGPVPLGLLPLSDVKANR

SEQ ID NO: 1015787 - protein, 49 aa, Homo sapiens
TATTQAASGEPTPAEDSSHRDTGVSERDDTSLSRFPFVSLSCRMVYGGP

SEQ ID NO: 1015788 - protein, 51 aa, Homo sapiens
EHTDTASETRKETRQTDPERHTPARKPHEHIGNRNSAPRTNPGVPLRRGTR

SEQ ID NO: 1015789 - protein, 70 aa, Homo sapiens
MKSCEEYRRRSGRSANEEQEETTKRILSEAKTEEPGQKKIKKKRKPRRLKMPMEETNPSPVNLPLVHQYH

SEQ ID NO: 1015790 - protein, 48 aa, Homo sapiens
MSGCPGEDEQEMVSVKRPPRGALEEDQGEGFLSEMDNEPPVSEGDDGF

SEQ ID NO: 1015791 - protein, 50 aa, Homo sapiens
VEPAAPLFRLDCTATLSRHCRSLLPFTSPARTGIAVLSVVCFRVNSAYLH

SEQ ID NO: 1015792 - protein, 90 aa, Homo sapiens
FLLSASLWSPAILSFVHRPMIQIAALRSLEIVVPSARSIESGRSRSLSAPEGVAAESEVPRAWTLYRLPLKQLGLPASSSSQLLGAVTVE

SEQ ID NO: 1015793 - protein, 52 aa, Homo sapiens
SLRKRDWASGRVTQGEHAGGGISEPEGVNAPVGGLRVWVRGGSWGSQPVPVG

SEQ ID NO: 1015794 - protein, 49 aa, Homo sapiens
PKSQNGEKDSYQPCASLDTWIRASPPLLAICFCKCGGSDKKPLKNLGGG

SEQ ID NO: 1015795 - protein, 50 aa, Homo sapiens
FWSSAFALVQVSDRDQGENGVVPAPWWRRAFELKRASDTGVPDQEKVLLD

SEQ ID NO: 1015796 - protein, 50 aa, Homo sapiens
SASTYGKSIDLSTITLDQNVMNINHQGRDGHTGYTLLATTVTFDWYGQLD

SEQ ID NO: 1015797 - protein, 52 aa, Homo sapiens
RSTQQDIYAGSVQPILRHLLEGQNPLCLPMDPQELGRRTHCLAAQSNLGDPA

SEQ ID NO: 1015798 - protein, 59 aa, Homo sapiens
HRSQMSGSRSKPEPPKAPPRPSMSTDMFEPSPDSGDHDERPLIDQNPDGSLTRRTARLA

SEQ ID NO: 1015799 - protein, 62 aa, Homo sapiens
LKPMEGKTLHMSSWTRDSAVTTTGHLIYKCGGFDKELENFRRRLLSWERAPPSLPGSGKPKA

SEQ ID NO: 1015800 - protein, 103 aa, Homo sapiens
CWWQVKKGNLKLKSPEGEAPCAEPCPCQRNWRYSRSTMYSERPCTGGRYPAVKSQVEKKKEEKVLSNCYKPVGGNKNGVPGVNFRNCLVFSPEVSLEAVGPEN

SEQ ID NO: 1015801 - protein, 100 aa, Homo sapiens
ALCCPGLECNGISARYSLCLLGSGNSPASASRVAGITSVHHHVQLVFVFLVEIGFCPIGQAGLELLTSSDPPASAFQSAVIIDMSHCAWSWMRFKWEDLE

SEQ ID NO: 1015802 - protein, 56 aa, Homo sapiens
RGPPMSEGPSWGYLAPRPTGETLFDPVFLNSDLTSGTLHLGIVHRGGIRSGLPRYT

SEQ ID NO: 1015803 - protein, 49 aa, Homo sapiens
MTARQLHSTPGKVRIEITEFDHFGYLITGTTLTSVSDFWPHAPSDLHLE

SEQ ID NO: 1015804 - protein, 48 aa, Homo sapiens
MGVLQHSRSPVADHHLPMSSEQDRYDVTESHLDPLLPPPKFHHDRGSD

SEQ ID NO: 1015805 - protein, 50 aa, Homo sapiens
LLVNESRHGVDTGVRELDSYTWLNVHLFGANTVYGGLAVRAWMSERGPSP

SEQ ID NO: 1015806 - protein, 56 aa, Homo sapiens
AYLDDCHRGLAVPLPPHLANHTPLLQVIRAVRGYSLFTRGKLDAGRKGRSSHLSFF

SEQ ID NO: 1015807 - protein, 129 aa, Homo sapiens
LCTPRYFQNGVALLQNQKMCIPNRKMKPLPYDLLPSGFFPYSRLSSPHDVERVNLLINPLPVKTANRIALVEVRIKKVTGRLLIRSPVCRGVPERDSSPRLLPTKSPWCLTPPSVCECVRERLDVVKRF

SEQ ID NO: 1015808 - protein, 536 aa, Homo sapiens
RVGLTVVVRCVVARGLGWARLRSTSPLRCRLLTRRLSVSRGLAGGALSLEPGPSVVWRCCVLLSLFGTSSAVVYGMVSLALSSLLFASFCRPAGYVVDLPLASVSEFAPPPRSRCPVSSLRPPLGVRRPSMVGGACVASRSSLCLPPSRGVGSAPPSRVRRPVGGVALAWGVACLPRPAGRWAPPPAGVCVVGVLSCSLPRCLVRRLCLVVGRVSCALSRSLRVSLSRSPLPRLPPRPRALRRRCAVVEVMPPAALVGGSLVPRCPGSAGSLWSVLSPRSPPSLSSLALLALARAARALVCLRARPPRRSCCGASFSLSRLSWCFSCLSCCWCRGCVWWLVARRAWLAVASCCVVCVCVCFWVLFVCWLSECGASVRGARALALSSSAVGGVVGCCSSLSLRRRGARAPAWCVCGVCCVCVWRARRPRRGAVSRSRRVCVCVAAPARFVVVGRAARPPLLRSPLSLPPLVLPVLCWGRAPCASLLFLPPPRRCVVLSRSLPLARWGWLSPSSCCCCVLCVCCCCVKNNRIYKLRCK

SEQ ID NO: 1015809 - protein, 66 aa, Homo sapiens
QSAASSFASPAEPHRSDTMAKVKVGINRFCPIWRLVTKLSFNSCKIDIFSINYPFIYLNYKVYNSI

SEQ ID NO: 1015810 - protein, 107 aa, Homo sapiens
PLVVAESISKSLAKKSVSAKLDGAYVGMHDVIPASGDFQLITTADDEALDLLRAFCLTLIGTSLKRLPKFANMHFGVGPFIENSFYYDTDNGAGNQVTGEDFAEIEP

SEQ ID NO: 1015811 - protein, 120 aa, Homo sapiens
KVRFYRQGAVMEEKVKDALVIYTKGGNDTLAVGEYPDDQEQKELFDEGILAPKAADKIIDLNPQIKRLQQLAGDDFSQMPRSEKEQVEFAVTATKLTLHVHQLVHKVCLGDSVVDQRTLN

SEQ ID NO: 1015812 - protein, 69 aa, Homo sapiens
SELLVVGDGNREPKNCSCRLRLLIPSHYAVSSISIHSEPAWLSTICKSAGLYLPEHGISQFHNSITKPF

SEQ ID NO: 1015813 - protein, 72 aa, Homo sapiens
MGVGTLMGMNPAIVAGIVLSGAIFGDKSSPLSESTNLASAFQGRIFLPHQKFDVALCRLGVTFIECDLSVGT

SEQ ID NO: 1015814 - protein, 51 aa, Homo sapiens
YYLDIRPLIRIHTSTLTPQFLQQGSVLILNSGSRSIISLKFLSHTDLNMLN

SEQ ID NO: 1015815 - protein, 142 aa, Homo sapiens
YNKALTPMTMRLTVTLLMKVNSKAMTIITPNFISGFMMRHLEKLVAGLQTLSGSQTNPLLRVIDGYIITTVWFCLVVMSAMTANSCACDALSKPAKGSSNNKTGVPVMSMSNTCSFFCCHQIIGNDVLNDMTQIKLYQDVIE

SEQ ID NO: 1015816 - protein, 49 aa, Homo sapiens
MKAKTVEPENQRRGVFCTIILHNLVTFETYLFIATYRTKLFIVLVLDPT

SEQ ID NO: 1015817 - protein, 51 aa, Homo sapiens
VKRHIRMIILTRQYLGYAIFQSLSQGDTHLIDIHVRKKNIQQKYTICDGNG

SEQ ID NO: 1015818 - protein, 69 aa, Homo sapiens
MTLASRSLLAACTAHVRRELSRWPEKCGAGLCCSRGGVSALGLLASGLCQTAYRGVGTRNVCSTISVQQ

SEQ ID NO: 1015819 - protein, 60 aa, Homo sapiens
PAGIIEKVQYLTGSAKEERGPLKCLNKHVEKLQNAMYQLSTVLMCGGADRGLIWMLSAEV

SEQ ID NO: 1015820 - protein, 136 aa, Homo sapiens
RQNLALSPRLECSGVIWAHCNLRLPSSSDSHASAFQVAGITGTHHHAWLIFVFLVEKGFCHVGQAGLEPLASSDLPASASKIVGITGMRYCAQPRIMFLIVQNQSLWETMLEMRVLSLETLIGSVFHSVRQVCGAF

SEQ ID NO: 1015821 - protein, 71 aa, Homo sapiens
EPEMAFMHQEESLELQERYISFLISKVLERNEQELDILGRDKALLASYTELPYPRISYDYSEGLLQDTGFD

SEQ ID NO: 1015822 - protein, 69 aa, Homo sapiens
FKPSYPIIYQSFNLETLKTIRRLRQQLISQRYGYWGGYKVYWLKWRGVFDYVHVDMRILKHKPEIFLAL

SEQ ID NO: 1015823 - protein, 102 aa, Homo sapiens
SQIEDFEARIGWLPLLQAETDRRGTAGQRLGGHWPDAGCKADLHPRGGQNARGGHRCAVSCILRRGDLVETQGARPEASWRRRQHWVWGKRKARSSLARKET

SEQ ID NO: 1015824 - protein, 61 aa, Homo sapiens
EVNRVVRNPNLGCHLGNVFIVFRRGTNPVLIGVVPVLHKNPDNIVNPAALTTRRSRRIYAP

SEQ ID NO: 1015825 - protein, 77 aa, Homo sapiens
YDDSFTWPLIKFERVAHIHLANENNPFPPQLRQFSRTIDVRIWYIVRGLFDEQAWLLIAILKPEPHKLARDNNQMHK

SEQ ID NO: 1015826 - protein, 49 aa, Homo sapiens
ASTSALSIDKTLLTIVLPSECAIEPTLRCLKLGTPPSTARRHVLHSFKQ

SEQ ID NO: 1015827 - protein, 98 aa, Homo sapiens
LTRPWLQATTPPPPAWTQGAGAGGSEPVTVTVQCAFTVALREEEPTCPACGHCWAKPSLTRAQLGKLQVGQKAPGWRLEGTARIGSLEEGVGRGSFSP

SEQ ID NO: 1015828 - protein, 124 aa, Homo sapiens
LKACHPGVFPLPIKTLVSHNPLIHNPRHSFPSDNNSFNQLPNKKILNLPITLEPPRSTFELSYLSGQKQCGSCMYLIDVSCLPKMYTIRLAQITLGTCSQALLRSLSRAIGHSDSAQNKSLQIL

SEQ ID NO: 1015829 - protein, 108 aa, Homo sapiens
QDSFTETPAPRRLERRGRGGTGKAALSGAGTFFGPGLGHLGAPGPRQNRRRTEIQRLVGAAGARKAGAACISNGALSPSPAAAFGTSSPNGGLPGCWASWAMFFGHDH

SEQ ID NO: 1015830 - protein, 141 aa, Homo sapiens
ALPLGSARLAPGSFLKERQWGERSKMNALWGGPLKMPQFGGLKKWNPRCGVGWGLQSTQPPDVKDRRGLASPSPPLCLVVCWGAIAALPTVKALAFPPSCPRGQHPHLLQLTSRGYSLLPGPPSRGYSVTMNKVIKFLFQK

SEQ ID NO: 1015831 - protein, 51 aa, Homo sapiens
GSIEDLFGNDNDKLGTVAIPESRHFGRRRRADHFRSEFKTSLANLRNHFST

SEQ ID NO: 1015832 - protein, 112 aa, Homo sapiens
PQVNAVFPESKADLILIVVAVEHALLALKFILAFAIPDKPRHIQMKLARLEFESLEALKQQQMKLVTEEPEGGTNGKAGRRRQPECPALPSCPVGQKACVCGHTCHGGQVGP

SEQ ID NO: 1015833 - protein, 51 aa, Homo sapiens
ESTTTGHLIDELRCIDERTIGKFEKEATEIGKAPSSYLVWITEADCTVSID

SEQ ID NO: 1015834 - protein, 43 aa, Homo sapiens
MTRDEYNALPAWRQVNLEEAKACTEWEDAGGVSRLTSNNTLNR

SEQ ID NO: 1015835 - protein, 66 aa, Homo sapiens
RHGAKTTTTVVDRSHWLVALIQNVMLKRILLYIDHDKSEEWTTKKGNQGLQPVREFFQILFNGGFA

SEQ ID NO: 1015836 - protein, 50 aa, Homo sapiens
LHVLLRSWGDPMPPSLDGEGGRQTIEILDEHLERDRCSCQDDALVIIATT

SEQ ID NO: 1015837 - protein, 49 aa, Homo sapiens
MPAIAASAGLALTREARFLLPDRIWRCSLPSRLLSSDSRSSKVLLRTCS

SEQ ID NO: 1015838 - protein, 58 aa, Homo sapiens
SDLRKEFTEAMEAKQVAQQEAGSYRGHRIPALTLSDHHLPASEQSVLLQLTQGGPPCL

SEQ ID NO: 1015839 - protein, 55 aa, Homo sapiens
ANTKIGPRDSTQSFAGGNKKYRPLRLDVGNFYWGQECCTRKQGSSMFLQCIYNEL

SEQ ID NO: 1015840 - protein, 49 aa, Homo sapiens
CNLSCNSIFWGIIGILVPWFFPRGPTRKVIFTLVGNLYGLLHSLLAVAS

SEQ ID NO: 1015841 - protein, 58 aa, Homo sapiens
VDDLVELQGNYCRGVRDSRMTRHQGVCSDMYNTLRLAEHKAREIARCYLTAYPVIKDN

SEQ ID NO: 1015842 - protein, 60 aa, Homo sapiens
CSLEALALIEGFATCWKAPSREKSSRPSVWVSSLPGSSFRHVFDYVVHLPFWTQRKGRLL

SEQ ID NO: 1015843 - protein, 55 aa, Homo sapiens
LKLQTSCPAGIMEKVQYLTRKPKKSSTIECSTSEKPRSDYNFCLILICLLLICII

SEQ ID NO: 1015844 - protein, 50 aa, Homo sapiens
TDGYSQYRESMSWWWSLLIDHTMENTYHWKTDTSKKATEPRHPTTCPPSV

SEQ ID NO: 1015845 - protein, 50 aa, Homo sapiens
DEEGRRSHECIIDEDCGPSMYCQFNSYQYHLPAMPEKEDDSAPGTVSDCR

SEQ ID NO: 1015846 - protein, 49 aa, Homo sapiens
TIKRDNQLVSQKQMSDRRENDMSPSNNVVTIMSTTTETSKGAVLSDIEG

SEQ ID NO: 1015847 - protein, 49 aa, Homo sapiens
EEKRRSMRDDTMWQLYEWQRLQFYTNRAPSLDTDFESPNHGKYFDQTMT

SEQ ID NO: 1015848 - protein, 51 aa, Homo sapiens
TPTSRHWRPLQRYDLPEVDVSGPEHSVQGNSFILTTGLSCWADGTCVSLVS

SEQ ID NO: 1015849 - protein, 30 aa, Homo sapiens
MGDRLTWEATPRSILEGIATAIMNSDCLVF

SEQ ID NO: 1015850 - protein, 49 aa, Homo sapiens
QGDRGPCVSCRRTEEMTEVEEGVGVVAKIMTQPQRSEDMDSEEDGEDVF

SEQ ID NO: 1015851 - protein, 49 aa, Homo sapiens
LRWLQVGAGCANSNLLDMCEFSLLTQVLSTADGQLGSQQMAASHRDESS

SEQ ID NO: 1015852 - protein, 50 aa, Homo sapiens
QGIVEVKSFLDDPPAGHLTASWIQAGMTHIVGSRQADQVNKKKVVRLTME

SEQ ID NO: 1015853 - protein, 50 aa, Homo sapiens
MRLLTIVVKALFSKSLKQRKEPGLKAYQITAEQIRRRRDEYPTLTVTNYY

SEQ ID NO: 1015854 - protein, 54 aa, Homo sapiens
IWHLRQSLPRFRRPSLSLAFKVNCDFREDPDPEGNLGSGSNRTDDAIPGVLPVV

SEQ ID NO: 1015855 - protein, 52 aa, Homo sapiens
MLKVLSSSTLIPCQGWMDWQPQLTGSPLPFEMILDIFQPVELSGMLSDTKVQ

SEQ ID NO: 1015856 - protein, 50 aa, Homo sapiens
FDHPWKLLHSCNAKYQTYEPSVVGVMCWQHIDPLEVAQPQLLSTEWDCFI

SEQ ID NO: 1015857 - protein, 51 aa, Homo sapiens
LVVEGPGYWQPGWGLSEVVIDTMEEELMEGRNYHDHPNYNRSLLTTSPESG

SEQ ID NO: 1015858 - protein, 49 aa, Homo sapiens
CSMRIGYPKYGVSFMSTDILDIAEPSNKSRRSKYHLELRTIGKGIYHYK

SEQ ID NO: 1015859 - protein, 50 aa, Homo sapiens
KQYEHNIINYEDTDKLEGDHQLIQEALSWTQAHDYTMEHIRVCGAYCRHL

SEQ ID NO: 1015860 - protein, 102 aa, Homo sapiens
REFFSGGSARSFPPWHLRKQGESRGSNSNVYSMFEQTQIQEFKEAITIMDQNRDGYIDKNDLRDTFAALWKVNVKNEEIDELIREATGPINLAVYLTCLGRT

SEQ ID NO: 1015861 - protein, 57 aa, Homo sapiens
QGSIPEREPEIPAFDEAIAELDTLSEESYKDSTLNNAFLRDNLTLWTSDTQGDELKQ

SEQ ID NO: 1015862 - protein, 49 aa, Homo sapiens
GWVEEEIGEKVSKVTSQQFEAEATDEKDVVDKMKGLASSFKRGKNSSLK

SEQ ID NO: 1015863 - protein, 49 aa, Homo sapiens
NDWISMGGHMASLAVSNRPKPMLLIPSRCGHSIWGLHYGSVRKSINWRS

SEQ ID NO: 1015864 - protein, 52 aa, Homo sapiens
QWHNDCFDCKKYTHSLVGRRNLTERDDILCPDCGKDYWIQHREDTACDLTHG

SEQ ID NO: 1015865 - protein, 50 aa, Homo sapiens
RLKRLEPGRGRTSRPRSRDPLRADAWETLRCSPPPTVACHDHHEQLEPVQ

SEQ ID NO: 1015866 - protein, 49 aa, Homo sapiens
VDNGGVRRTGYRFGLFVVMYDMIRVYTGLAYCEDCVAHFPHVYPEIGHC

SEQ ID NO: 1015867 - protein, 50 aa, Homo sapiens
RKKRRQSNNKITVVGVGQVGMACAISILDSLWLMNLLLRSFGDKLKGKMM

SEQ ID NO: 1015868 - protein, 50 aa, Homo sapiens
EAETEETRQKKMKKKRSKEAEDAHEESNQARRQPLVLQIRMRESDLMHHR

SEQ ID NO: 1015869 - protein, 50 aa, Homo sapiens
ASRTGAQLVTHSNEYRLDKSEKLPNSGNHNMYHMNYGEGGDLITEYHIYT

SEQ ID NO: 1015870 - protein, 49 aa, Homo sapiens
MADASDRPWGGDDYYTPNTVRRAMARRATGYVCRLGPRHDELRLTYALY

SEQ ID NO: 1015871 - protein, 40 aa, Homo sapiens
MRGIDKDHENFRGALRWKALRYAGLDELKLTDGSHDILEL

SEQ ID NO: 1015872 - protein, 38 aa, Homo sapiens
MAQWGVIDLAAIAESGVERQVLLETSTQLRVHLPPADT

SEQ ID NO: 1015873 - protein, 66 aa, Homo sapiens
AGPGGAAVPKAKLATHGSPLHEQQVQVGEWTCLKQDLTAALQDIRAQYETIAAKNISKAEEWYKSK

SEQ ID NO: 1015874 - protein, 50 aa, Homo sapiens
MCHSDWKSGEYWIDPNQGCNLDAIKVYCTELVSLRVPHSAECGRENCTQQ

SEQ ID NO: 1015875 - protein, 50 aa, Homo sapiens
AQLQEQQVQVEMDMSKPDLTAALRDIRAQYEANRGYEHFLRLRGGQDEGV

SEQ ID NO: 1015876 - protein, 49 aa, Homo sapiens
YCCTGYWFDELFVPVTSAAENMKGVIVLNMTTENHWPRREPTQREHWHD

SEQ ID NO: 1015877 - protein, 51 aa, Homo sapiens
LSQDDPVLPEISRSQNENCSQRITTWYTVWSYSCPGGSKENFDDSQRNRRG

SEQ ID NO: 1015878 - protein, 52 aa, Homo sapiens
SLSRSGPSLQLQHNALAADMHCADATFRCTLKSHNGWVTQIATTRVTRHDLS

SEQ ID NO: 1015879 - protein, 51 aa, Homo sapiens
DHRTSIRIRHCLMRNHDTLSYTAYHHWRDYEPVELDVTRCDEPFRHWEVED

SEQ ID NO: 1015880 - protein, 50 aa, Homo sapiens
VESRVTELASAFRNCYTSSALQRYAADARKAKYIQYPIFYLRFAISRACP

SEQ ID NO: 1015881 - protein, 50 aa, Homo sapiens
VKPSGKYGLGYKQTLKLIRQGKAKSVILANNCPALRKSDIEHYAKEAKTG

SEQ ID NO: 1015882 - protein, 154 aa, Homo sapiens
GGNRIKVQNNPGSVKRKAPNDEEIRSGKPGNQNALNGPGSEFASPEFVECRMPSRPTMGKRRVAPLAITLNPVAHTSTSISYATSVVNHRRRCDLGDALGHQVYVRQVIGLEDIRCASTALAAELILRRELLTGLRSLTWVRIHSRRFGATDAV

SEQ ID NO: 1015883 - protein, 56 aa, Homo sapiens
LTLAVSYYVAKTIQLYSVISEQLGNIQHSNQLRIRRREGGVGYERNEEKLSTQGDA

SEQ ID NO: 1015884 - protein, 122 aa, Homo sapiens
MVGRLATRSWVSALPRRRILDDAVQVTPIPGIAPRVEPVHEWMHDAARALDDSPQHQVDDDYCAAVKGRLHARHASIVLSQGGTRKSGLGIDHTGGAEKTVSVPTSGAMDGMICTALAPVAD

SEQ ID NO: 1015885 - protein, 49 aa, Homo sapiens
LDAYMAQQIRIPMSEACPYSHERLLLSQHSVNKPEITAEKKSDVMLDGP

SEQ ID NO: 1015886 - protein, 67 aa, Homo sapiens
EKNPTIGNFPITNVELRGYLSDEVQAVHKNTTYDLITNIVHDGMPSEVRYRIHVASSWLQANGYELQ

SEQ ID NO: 1015887 - protein, 67 aa, Homo sapiens
QYVKEAKMERSLEPPHLHSSKPSIYHRTNVNPLKAFSTEENLSSSITKQPIHQRENIIPLLVTSNSD

SEQ ID NO: 1015888 - protein, 49 aa, Homo sapiens
SRQERTTMATHHKDLQHVARNEETYEVIVTLLTDYQTETNALDPGDEPR

SEQ ID NO: 1015889 - protein, 80 aa, Homo sapiens
GRQHDVRRYRVVAVSLVGVLGDHQFGRLASMTVCRLATVATGLVQMIHTALMSPVPSCRNISMVPGPTSVRMVPGSSSQC

SEQ ID NO: 1015890 - protein, 38 aa, Homo sapiens
VAGPQLGKPAVQGLGVRMKFSYARSPIPSTEYRTPLRS

SEQ ID NO: 1015891 - protein, 50 aa, Homo sapiens
SYFVMKRKNQIHSMGNLLKSALKKERRYQLRNHHCIKEGNGSDNGCNAQK

SEQ ID NO: 1015892 - protein, 54 aa, Homo sapiens
LSTNKLHTQHRVVGLTFVMRRTCPALIIPLKPRTACVCVSESHILLTHTAFADD

SEQ ID NO: 1015893 - protein, 110 aa, Homo sapiens
PFWRMKTGRDASGFMSHCIAILKICHTLTEKLVDMTLALGQDEDFTSVSYIIVVAKRISPRVDDVVKSMYLRWTQTPGRRDDCPAPVCQYLVLVTRNACHLSGGLDWIYQ

SEQ ID NO: 1015894 - protein, 104 aa, Homo sapiens
GAGTCNPSYSEVEFAVSLDCTTALQPGQQSETLSQKKVTARLFFLRQGLALLPSLECGGMIIAPCTFNLLGSRDPPTSASPVAGTNFFFVVMGSRYCPAWVSNF

SEQ ID NO: 1015895 - protein, 51 aa, Homo sapiens
ERDRAVNDYPSPATSLAFRWLKAAALIGLPGLRGLLGGLKVLSIGKEWVGD

SEQ ID NO: 1015896 - protein, 49 aa, Homo sapiens
STIDGVCVRLPVKGTYNNISGPFRDVCTLLGAQHSGRGWVQGSFSSPRV

SEQ ID NO: 1015897 - protein, 49 aa, Homo sapiens
GKQQYLQSIEEREKLDGLYECFSDPAVAPAAPATGGRRQISRALQFLCS

SEQ ID NO: 1015898 - protein, 39 aa, Homo sapiens
MRVTLAKEEEAYLKDVATDTAKRGGPEPLRHRIKYIDLD

SEQ ID NO: 1015899 - protein, 49 aa, Homo sapiens
KAKAKAARESSREAVQIDGLVVLENSHIIKKRDTDLKLYKECFGLVERR

SEQ ID NO: 1015900 - protein, 69 aa, Homo sapiens
FHYHPRANECGSLGSWAKALGPPVLPRGDGNPQATAEGSSAVLGCPWREQGIGDKCLVSFRGWVHRAPS

SEQ ID NO: 1015901 - protein, 51 aa, Homo sapiens
KIAHCTQPGNKGDSIAPLNNKKVPITGLPKTHYNLSKQSRPRGAFMFNKNP

SEQ ID NO: 1015902 - protein, 50 aa, Homo sapiens
VTCTAYGLIQKERVYDDVISRHVCQSAVNGRVRRFQRNETAATVDAKRVK

SEQ ID NO: 1015903 - protein, 55 aa, Homo sapiens
DPQSANHMNSSLLTIYGKGNADSVSNTPEVGAKRNHLFNTTNKIKTGYIPLKTLP

SEQ ID NO: 1015904 - protein, 52 aa, Homo sapiens
GWAWWCMPVVLAAWQYEVEPRSQRLHGAMITALYSRLGDKVRPCLTEKIIII

SEQ ID NO: 1015905 - protein, 48 aa, Homo sapiens
AGTLYTFPENWRAFKALIASSGAQVRVLSAPPTSIFGKPTAPLIFFRK

SEQ ID NO: 1015906 - protein, 56 aa, Homo sapiens
EQVSGAKSSSGLKRKMWRHIGIVGSSDRIALLPAVGIKYIGMRMSKRLVMLPPRLD

SEQ ID NO: 1015907 - protein, 80 aa, Homo sapiens
EKVRIAAKFITHAPPGNLMKYSMTVGYYLIMTIFSGEGQHMPLPSITWSSVTRVKIEGYVDQVLITERGDLVIADFRSKK

SEQ ID NO: 1015908 - protein, 52 aa, Homo sapiens
DQKARADGYAKKAALCKTEVLKASRAHPLEALPTRTLLLLLSTHSLKDVRTQ

SEQ ID NO: 1015909 - protein, 46 aa, Homo sapiens
PVPKEAAALLPSNSSGQTFLISQHFYRTDLCQNVMECSTYTCHRAT

SEQ ID NO: 1015910 - protein, 73 aa, Homo sapiens
DSLPSQPCNEVTPPMYVGNGSVAQDIPKLQSLGINTVLNAAEGRSFMHVNTNANFFKDSGITYLGIKANDTQR

SEQ ID NO: 1015911 - protein, 49 aa, Homo sapiens
SITYLVPARHGSFTQRKAQGYYHKPSGTKVNVGKLGGRRNPGEGYLGCL

SEQ ID NO: 1015912 - protein, 61 aa, Homo sapiens
THTLLGCKPAEALRTASSQEDGSLLREDYINLFSTSPLLRLPVKLRQVNRALATLARHLLN

SEQ ID NO: 1015913 - protein, 78 aa, Homo sapiens
PARYLRIAEEEDLHGRHCGSLVLNAIFETHRTSCHPLSSGAEPWPHNSTAHTLRHQGLPRFQKLQKQSPADLHRMSCG

SEQ ID NO: 1015914 - protein, 49 aa, Homo sapiens
VIREDNQTNQPAGGSKPSSRASGTTEWLQTISVSLFLNNARICIAEKSL

SEQ ID NO: 1015915 - protein, 52 aa, Homo sapiens
DRQPPQATRQLRASAHWHAETSRGKVGQLCRCPSVITPRPLSVAPERPYLKY

SEQ ID NO: 1015916 - protein, 57 aa, Homo sapiens
SAAKAICDPVRTIWFGTPKEVFSVPRVLSLMANSLGVPDEYCSLTLVVIQDKNSELV

SEQ ID NO: 1015917 - protein, 50 aa, Homo sapiens
RRLSPCRVYLCKHARTGWNEDEHRELRGKDKPCELVGRRSHRCSRHSTHP

SEQ ID NO: 1015918 - protein, 50 aa, Homo sapiens
EYDLTTRIALFGSSIYLSAFLNVLSCKGAYIMKKELLQGEIRTFFSRYQQ

SEQ ID NO: 1015919 - protein, 48 aa, Homo sapiens
MAAVSWGLLKGCTSLADLPHVLILFYTVETGRAPQRMKGVGIASALLS

SEQ ID NO: 1015920 - protein, 49 aa, Homo sapiens
LGIRFMQEHEASVAYSRSGKCTDRSHRSTTVHYCHTNVNMILEFTDERL

SEQ ID NO: 1015921 - protein, 56 aa, Homo sapiens
YRLNAPQGFPTACTAPVVIGPNTPLDEALPIAAIQIAELLLSHRARRYDSADGVPS

SEQ ID NO: 1015922 - protein, 51 aa, Homo sapiens
GTTITTNMLLYSKGNNIIKWQPMDWDTQFASHISDKVLMSNRYKEHIHLIV

SEQ ID NO: 1015923 - protein, 50 aa, Homo sapiens
GRPFLSSGPGVKNTHIPEGLGTEEAWGDDTFGLLTIALLRRSVVHTGIPG

SEQ ID NO: 1015924 - protein, 49 aa, Homo sapiens
NGLSDGKWQLVLNVWEKVEADIPGHGRKYSSGSLRVTRDSWRSLQSQST

SEQ ID NO: 1015925 - protein, 56 aa, Homo sapiens
MDNEAAYSTSRIRVEIRRNKARLDPVGPLEGSIAGVDVAIAVSGSKRVLEEVSLWV

SEQ ID NO: 1015926 - protein, 49 aa, Homo sapiens
SVKDPKMAGRKLALITIDWVAFAEIIPPNQKAIASSLKSWKETLTSRLV

SEQ ID NO: 1015927 - protein, 56 aa, Homo sapiens
SGPWSRPAAFMSTLLINQPQYAWLLSWAPRVNEGVYNGAGSRVEVLRPIACYTSQQ

SEQ ID NO: 1015928 - protein, 54 aa, Homo sapiens
LTVDATAPCMMAGNLPFLQNQSRLTCSPPRDAVVQCRKRMSEQSHLGQPSFFKT

SEQ ID NO: 1015929 - protein, 57 aa, Homo sapiens
MLYKPQRHWNTIPMMRRMSWSPRHSSEASLCEPSWANQATFYVNDHIYDVDRHSPCI

SEQ ID NO: 1015930 - protein, 81 aa, Homo sapiens
QAADEEEEIVYCHKGYYTLMVINKTESSRKRFVEPYFKGDERETSLQNFSHIEVVRIIEERRKLLGHTCKDVNLLCRYASR

SEQ ID NO: 1015931 - protein, 58 aa, Homo sapiens
ESHVSAREPCWKFIQDLDNCSVMAVECESRRYCFQITTPMENLGIILQAESRKENEEW

SEQ ID NO: 1015932 - protein, 53 aa, Homo sapiens
PKSVKQPEDTHAAIVECPKVKPGTAFIQTQQLHAAIGDTFLRAHVPPWTFDSP

SEQ ID NO: 1015933 - protein, 51 aa, Homo sapiens
PGDPDEQQMYIFLVIGAKRTLTISQCSLADDAAYQCVVGLQKCSTELFMKE

SEQ ID NO: 1015934 - protein, 66 aa, Homo sapiens
LPKFKYDLTREIWPLEAQEGTEGNPGDPKPTTLPRNPRMAYSCSKVSFLAPNPKHWGRLLQFIFDE

SEQ ID NO: 1015935 - protein, 58 aa, Homo sapiens
PHEFIAADIGYCGGTLSGQPLGTRLEFRGFLTRGFPKLLGKLELAEIPEGYGPEHLGI

SEQ ID NO: 1015936 - protein, 53 aa, Homo sapiens
DLCTTIHVGCKVGVPDTYPSRVFPPQLFTQRASPVCEEFPYTKNQWLLTLAGN

SEQ ID NO: 1015937 - protein, 48 aa, Homo sapiens
DLNFVKCRGVNLKSPFPKKWTFSLEMLDGNLMKQPKCTQGEGTFPNFD

SEQ ID NO: 1015938 - protein, 47 aa, Homo sapiens
VGYQVGPGYPFGLFVGHVQNMIKGVTLGFRYMMRSVYAHCPINVAHP

SEQ ID NO: 1015939 - protein, 56 aa, Homo sapiens
SGAQVRVLSAPPHFHFATPALRVMMDLCVWIAYYESYEELREKYYRGSSQVVQWVS

SEQ ID NO: 1015940 - protein, 41 aa, Homo sapiens
MGTLGFTPRKRTSRHRGKVKSFPKDDPIQSRVHPHKPSLEY

SEQ ID NO: 1015941 - protein, 67 aa, Homo sapiens
KLRYIEAIFQRLERLFYILSDRDRGRTEGFVMRGSRTGLIWKEVWNPGEKLVKKRWNLDELPKFEKI

SEQ ID NO: 1015942 - protein, 54 aa, Homo sapiens
DLDLLHCSNQWHYSHLPTQDPAAQSLMIMNKMKNFKRRYYLSSDPHETIEESLA

SEQ ID NO: 1015943 - protein, 49 aa, Homo sapiens
IETSLEKEMTLSHLNTVITWHDIGQANPAGATYIASQQAFKASFQHAPS

SEQ ID NO: 1015944 - protein, 34 aa, Homo sapiens
PTAVPERAKLINGHARNEDRALRYPIKNGNAAFI

SEQ ID NO: 1015945 - protein, 58 aa, Homo sapiens
LETKVQKGSIGGMVFQEQPGEKGVPGIPGPQHLAYLETKVQKERKGRQATWHRHPKGS

SEQ ID NO: 1015946 - protein, 60 aa, Homo sapiens
SGSFLPQNISILQEPSAMPGHAHFQLESWGLGTGEFFQQPAALTVCSARMLRRFPAHPAA

SEQ ID NO: 1015947 - protein, 55 aa, Homo sapiens
MTPGLVANQAALKWHELAAESSRVEYRAVQEIVYQSVLDRSPYTASEQPICESVW

SEQ ID NO: 1015948 - protein, 59 aa, Homo sapiens
MHYWTMWTPTRALRGAGSSGLKPCRLAVCFAGANARPRCYRLTLRTSKEPVSVTCVSCW

SEQ ID NO: 1015949 - protein, 49 aa, Homo sapiens
LVYCIVLLTIGAQAIVAILDDVGIHVIRSSPLVIKPSHCHCRHAAMLAT

SEQ ID NO: 1015950 - protein, 97 aa, Homo sapiens
QFWSSWHLVVPAGKHGNRGDNWFFLCPVGPAGAVWPKRYLVGPQGIRGDKGEPGEKGPRGFPGLKGHNGLQGLPGIACHHGIKVLLILGPAGPRALL

SEQ ID NO: 1015951 - protein, 94 aa, Homo sapiens
IGGIRRPTRPAEAQVDRVGELPGGREGGGGEGEPEVKKRRLLCVEVFLGRKPSVSAVGVMVFLPRNDVENERAFNVVVEPPSGGAPLNADRNQL

SEQ ID NO: 1015952 - protein, 69 aa, Homo sapiens
SAEIRHTAEYQEHWFYFEAKLAILRWRRGNPVKDPEIKPVSPTFWEQKRGKRLYRNVESRKYEGEDEAT

SEQ ID NO: 1015953 - protein, 41 aa, Homo sapiens
MEDLGDSQSFEASSVQPTTIQFCSKSMTHSEQRSVHRLSKI

SEQ ID NO: 1015954 - protein, 34 aa, Homo sapiens
TLLCRFQARNGPRESIMIMTCPITLDSLPVGVFL

SEQ ID NO: 1015955 - protein, 35 aa, Homo sapiens
LAANAVAHVRSAYYCNYTNTSAELQQCGSAHCCRR

SEQ ID NO: 1015956 - protein, 53 aa, Homo sapiens
QNDSEHQRMFNPVSSLVKGHLSPNCRPPTEEKGPICPATSEPISRTTLKGRTA

SEQ ID NO: 1015957 - protein, 45 aa, Homo sapiens
YPISSWPKRYLPPAIPRTHATYHPATGTTYPLLLRHEGDHPDNTY

SEQ ID NO: 1015958 - protein, 49 aa, Homo sapiens
NTGVVKTTPKRPKLGKERTHINIVVIGHVDSGSHHYSTIENLEEAAEMG

SEQ ID NO: 1015959 - protein, 36 aa, Homo sapiens
MPATTLEDYTNRRRNSLPNDNLHAEDIGRRNAFAYF

SEQ ID NO: 1015960 - protein, 38 aa, Homo sapiens
SHATSKPAGHYSRILQTTDPQPQPHRKLISPHFPPQHG

SEQ ID NO: 1015961 - protein, 66 aa, Homo sapiens
GDKRAGSGAPRYALFTFDLTKPLYTLAPSLLLLCRLTINICTGAIWGLLLPTRLKDYLEDYKFQEE

SEQ ID NO: 1015962 - protein, 82 aa, Homo sapiens
MSTRCRIVPRPEATAPGFSCMDWEILGTDGRSFCRYQRCTYQIYLPHALVRPVTLNMNVAILHGLIYGLSQITEDNLDEQQQ

SEQ ID NO: 1015963 - protein, 100 aa, Homo sapiens
AARVVRPTRSGLQLDLGSPPDFEGVIAAPVGVKRRGCSMPTQEEKAFMREEESCVFYTWSPSQRDPLAADERHPRGVYCPHKIETMKKGEQTEEYEVLDD

SEQ ID NO: 1015964 - protein, 57 aa, Homo sapiens
RHCLHDYDPDYARNDLNIDLQDMACMREKTSRSNEGRKNKIEEVGDSKAMFVCKRIG

SEQ ID NO: 1015965 - protein, 76 aa, Homo sapiens
NKKKPEEEGSSHQDTAEKNAPSPEKAKGRHTVPCMPPPKEVFLKSPEGPELEKSMKMPQEVVEIRKKIEVFKKLSW

SEQ ID NO: 1015966 - protein, 48 aa, Homo sapiens
MYNAVSNADLMGFKNFLDHLGEKVPLEDEVVPPQVLSEPYEEAGASLS

SEQ ID NO: 1015967 - protein, 42 aa, Homo sapiens
QAVFREGFKVGLPGFRQLPAFSYASLPHFGGAGFNQFGIGKR

SEQ ID NO: 1015968 - protein, 46 aa, Homo sapiens
CAVSPRHSSTASLIRCRCLAMPLNRFYGHRAALYTGYSTQAHCILK

SEQ ID NO: 1015969 - protein, 51 aa, Homo sapiens
IYHYGLSRQLISSEILMIMVSLDSERSLVRSSEVFAMNGKPHCDRDLADVE

SEQ ID NO: 1015970 - protein, 39 aa, Homo sapiens
PEQRPCIPGPGEASQQLLQLNGSGYSVVTNVSSTYHPSY

SEQ ID NO: 1015971 - protein, 73 aa, Homo sapiens
MINAARYLPCALCGILRRCLKENAMSAQKPGLHPRNRHHSRYDLATLCQVNPELRQFLTLTPAGSKADFANPL

SEQ ID NO: 1015972 - protein, 104 aa, Homo sapiens
RGAVSGQSARAAWELGAWRWGRAVIVPRLLYAPDPGMLFGRIPLRYAILMQMRFDGRLGFPGGFVDTQDRSLEDGLNRELRRELGKGLAVSALSQLDYRFPRSG

SEQ ID NO: 1015973 - protein, 270 aa, Homo sapiens
MVLATMRSCCRSLPFLVLLLFLVCVFLWVAFRSVVYVACRCAYVVSRLSCEVSPSLVLVFGSYSRWLPLWLCLFPVGAIWCCPLCVSFSICRCVVVHSVASGLCVVCRPSTSLRGRSAPMIVLCQRVGASLWYLEIPGPLPPGDPLCGLPGRVGSVVLMSSVWSHGGSCLGRCRSLLQACIVDVSCATSCPSVNYEGTCPQLDPLPARTSWLRPSLRTHEGLGLCMEIRDCLIEDSDDEAGLELSVMIVLAGTCMAVATCTPHNDAGMAR

SEQ ID NO: 1015974 - protein, 107 aa, Homo sapiens
EPGTSGVAAGKREVSGFSASRSARTRKPLLPGSAPSSVLESHEAAAALAVKGELRVGLGSFQNGGASEPFEEESEEEPECLEIDFKSRTLSVRRFGLQVTFACGRPF

SEQ ID NO: 1015975 - protein, 57 aa, Homo sapiens
LLGLRDAPVHAPQRVPGLLASWAFRMLCPPWLRQARVSALRSRFALVVQVYCPLEGS

SEQ ID NO: 1015976 - protein, 108 aa, Homo sapiens
RHRDSPPGIVRAAFDQRMKTWQRGRISHTAEEAGGRGSLWANKPDKLQQAKDEILEWESRVTQYERDFERISTVVRKEVIRFEKEKSKDFKNHVIKYLETLLSQQQAK

SEQ ID NO: 1015977 - protein, 66 aa, Homo sapiens
HPIATTQTAPSNPTHKIHQEDTPRRHQAFSSCPILFSRFRNKIKPLGEQESRPASAAPGPKDMYNH

SEQ ID NO: 1015978 - protein, 122 aa, Homo sapiens
VLITGPQEAFPVISYHGPPSLGSPSQALSPAPPAPAHPLALVLSSHREQVGSTLEARAGGAVLLFDFVSIGVALLLISVFLILPFCKVYITKFRPYIYIIYIYKLYSFCLCTFRQEEKINLE

SEQ ID NO: 1015979 - protein, 128 aa, Homo sapiens
RHDGCEVDNANISHRCDTAASRGTVMNRKQYRIALATLSVFIALRSLAGIVHGMLFDERVFRYSIVTLILSILSFVVLLNLAPGTVRKRNTGRTICLAHVKRGFTRNRAAAVGQIQGSARNWGEFISG

SEQ ID NO: 1015980 - protein, 81 aa, Homo sapiens
MRLSPFQHLKGAVDMGKLILERVVAIHMVLRPRLMIRQTGPTRLIALNRSMYRQAVAREAPEFVLLIQINRARSRHAHDAR

SEQ ID NO: 1015981 - protein, 127 aa, Homo sapiens
GLECIRALSSMNPDIEAAETAAYPALTSTEMDIDSNDRIEMLDGEQRHDFSPPRSAPATQRRDLSAERVTPPVLLPNCDTIHSTTIGRLLFARIGSSTINPASSALNPASNAMLLPCAFPAHGTHPP

SEQ ID NO: 1015982 - protein, 124 aa, Homo sapiens
HFTRRYVDRLRFNTLHRKNPDFKCSLSASAFAHFDPRNALNNPFAAAVMFMIGGPPPAPALPKSERFTELGIDWISPIRMRAVMRRRLHPDRPATRLQRHVTTSDHCWASTVFAGPNDPVRFEG

SEQ ID NO: 1015983 - protein, 142 aa, Homo sapiens
VSPYWGWRTSKAQVIRLPWPKSAGITGVTPAPGHAYIFNPTIYYFCDMMGSKAPQVNFSPIWARKRGFLGEIFTRANVGKTAAWPTPFLTTRSATLHTLRDFILKLFKILVCKQRNWGVHIRQVTCHSLRRNPVTPRDKHNI

SEQ ID NO: 1015984 - protein, 58 aa, Homo sapiens
KEQAKTNRRPLGRALQPGRREPASCPSPSPRTLGPQGVFLQPMRTWSSRSSRVSDGSR

SEQ ID NO: 1015985 - protein, 80 aa, Homo sapiens
SPPAVDGDGERLRGLVVLNVPPPTGGIPPGHHRRQLFPLLVAGAPDRYWRGRTEVFWAPEGDPHCRLSTELKTSHTPLEI

SEQ ID NO: 1015986 - protein, 107 aa, Homo sapiens
RQKWKRKRTIKGRLERNGYDKNRNKTDYQNKRQTTGTDRKTFVKCTLTSRPQDTDGKRDPDCVTLTPSLDKQDQRCLPHDASVLISLKGPAGALKSHPVENTTSAIS

SEQ ID NO: 1015987 - protein, 76 aa, Homo sapiens
MVMLLLLLSALVWTSSDDGQRDKTFHWSDPNPPVQENFDVNKYLGKGTKLRIPTTFENGRCIQNYFTNWKTGKIQV

SEQ ID NO: 1015988 - protein, 74 aa, Homo sapiens
AVPVSSLVMTRTSSWRAVNITEPEARTESRTSASPSSRFRPAAPTHPIFESCPPCPPVWFPSCNKNGLEPSPVQ

SEQ ID NO: 1015989 - protein, 30 aa, Homo sapiens
MGLWARRLLILLHNLTLFPKEYIPQPWRQL

SEQ ID NO: 1015990 - protein, 116 aa, Homo sapiens
RWSLALSPRLECSGVNSAHCNLHLPSSSNSPASASRIARITVTHHHATLIFMFLAEMGFHHVGQPGLELLTSGDPPASASQSAEIKGVTAGVQPIDTFKSWTIFTLGVLFLGCLEK

SEQ ID NO: 1015991 - protein, 222 aa, Homo sapiens
SALCFGVALSVFRSLRCRAPVFGPSVPSLVLLLQLSVFREPLSSWAFYDRLASDWVSGPQFEPSSCRTPNPWAYVCRSLGAGAHFLPGEYLLPWMPTTTEHPKSPVWPFVVRLSTAGLPEERLARTGVVVLRSSPSPLLFQWFEGHPTAPPCRDPLMDAFSSPSHQTHPTCDGVTSGGNAVGHLIHLVESTNTRLSIGFVSKGPDLKGKFYLVRSCLSGYSC

SEQ ID NO: 1015992 - protein, 213 aa, Homo sapiens
MAALGRSGPRAAVPAWKRDTVERNRAKPAALGGGAGPGEEDKSSGCWQKAWARCAKKCAASSSPSGGGGGGTVGARLQKLEIRVPGVRALSADSVPKKKTVPGLTPTQPAAEETEKEATKGPKDTQLKENKSLLERFHPPAAPRRRGEAEPLPTAPPPREKGEEGKGLEKKKIRKEKKKEGRKKEKRRRREKEKRKEEKQREKKRGKREKKGG

SEQ ID NO: 1015993 - protein, 52 aa, Homo sapiens
RRTLTVQTHCAAGVLACARSRPGAINWGEYSKCDLPLRTWESLLSGGRTFLI

SEQ ID NO: 1015994 - protein, 108 aa, Homo sapiens
VSAATSTNDSFEIRPAPKPVMETIPLGDLQARALASLRANSRNSFMVIPKSKASGAPPPEGRQSVELPKGDLGPASPSQDSDPSRAEGKWGAPASGKSPGGGSSTWGS

SEQ ID NO: 1015995 - protein, 115 aa, Homo sapiens
PHSTGNNTESGLGPQGPVRPEPPNPICQRCFQVEGSGEQPFLLPPTLSSSKGFLYPVHVRIKLFTWSEKPITTDSYCRYGKLTTKKGEKYTKQLAWLNTSKDSYSHWCELLIINV

SEQ ID NO: 1015996 - protein, 45 aa, Homo sapiens
FSGVWLGLPPEMAGELQGTQAPSLLTGLTSQSGVNPNNSRGREAM

SEQ ID NO: 1015997 - protein, 73 aa, Homo sapiens
QLDQMYRKQLSLRHPRVDGGNVVSSESLEMPGSAEPPKRVLQRVTALAGGALRSGLPVGPQLFFLSRHLQCGE

SEQ ID NO: 1015998 - protein, 63 aa, Homo sapiens
SAQGCVLIGFRRLQLMSNEANSKLDAHYDPMANIHTFSACLALADLHGDGEYKLVGRGPWPWC

SEQ ID NO: 1015999 - protein, 75 aa, Homo sapiens
DRSGQGSSVPLTQAPGVKGTFEVHLEDGPFPAAPQLLEHSLETQQVFSIVHGVTDVSAKKAQLRDRLQEAFPTCH

SEQ ID NO: 1016000 - protein, 86 aa, Homo sapiens
RTRADRKQIGVAADHEIALGLAEHFMRVDKSLAHPAEQLATQRLAAGENTAQLDPGMPDIGLAHQLQRRRAGRRYGCSETSVPSSP

SEQ ID NO: 1016001 - protein, 118 aa, Homo sapiens
MPTSSAPSEHLRIPTGPSYVERSMPSSARTAADSLDANTEIGRVCGTSASIAEEDDHSDVFGEGGIQISAVKLRCVRLRAEQEEDIARVAGDIEFGVRASAFPDAPGSRGTHSFTGRR

SEQ ID NO: 1016002 - protein, 125 aa, Homo sapiens
EHRKSAGFARSAKHRPEEDDHSDVFGEGIHDLCGERQLRDGSVPSSEEDIARVVAGDIEVAGERIPRSARVARDPFIQATARPAASAVLVGDDRAVELEVEVQLRVHFGDRDDVELLLECPPRLG

SEQ ID NO: 1016003 - protein, 103 aa, Homo sapiens
KLRTFTFSFKRKHFVASLWHIRITSITLLLSGATVKQSEDYLGTGTVMLEIVDLITKTATKSLSRVGGLYSVDVLDQGMTHIPGRLEPTRRGDFIHVTKGTPI

SEQ ID NO: 1016004 - protein, 108 aa, Homo sapiens
RHSLETSGQRQAGSGGGRGLGWSLLALLSLEDRREPGGVGGEPAAVTQRALPVGVDSAMKEEVQRLQSRVLLEEKLQLVLAPLHLASGTWSMGSRDPGSLLVALLSSS

SEQ ID NO: 1016005 - protein, 111 aa, Homo sapiens
SGTMDTNPSLKNTPKIKFFFFQGAHATTYVTPEVVIEKVVPFPFSITKETGMEDSPRGLKACMNNSSSSGPVPRYKLAPAGKIGRGRKRAGLGRTRYPLEGSRGEVALGTT

SEQ ID NO: 1016006 - protein, 95 aa, Homo sapiens
MKKMYKALKYPEWKQKHLPHFKPWLHPEQSPLPLALSELSVQHADSLENIDESAVAESREERMGGAGGEGSDDDTLLTERRTAKGTETGRRALGR

SEQ ID NO: 1016007 - protein, 53 aa, Homo sapiens
MVRDIRFPELAVITVLPLFSVVAASKYTKVEQLTLRERLARIQHTHPLPRRPP

SEQ ID NO: 1016008 - protein, 113 aa, Homo sapiens
GKLNQTCRQRARRQPVLAQGHYEVDLEHLFLALLEKPASDFSIVARRSAFEASVLEALNAEIRGFKNGNTRTPVFSPHLPRLFEHAWIASLDTQTTRIRSGSPVAGRCFTEPD

SEQ ID NO: 1016009 - protein, 30 aa, Homo sapiens
LCSPSLLQAILDKLSFPAARWLCTVRQRLL

SEQ ID NO: 1016010 - protein, 148 aa, Homo sapiens
ELINETHGYSPFSYDRRRIESLYFIGIAAPELLNGRERENASVSSIFAMIHMDQNPVVGFGHVLFQQSDTDDPAYALTSTFAKVVFSISYLDDLTRNSKAHFLHTTFFSRYVGSGFADEHVPDGGLPRKAFPHHGPFAAGFLAILTIL

SEQ ID NO: 1016011 - protein, 92 aa, Homo sapiens
ARTSDISFRVPRSSPCFPAWWRVSNLWYQASASARLHLAISSYCALTSAMMPSRSRERLLYMDTTDVLIWDCSSVNSVSLRVLRKLIFRGFN

SEQ ID NO: 1016012 - protein, 140 aa, Homo sapiens
IRNEEQVAPQQLLGRLRAVLHAFQRQIQRDDDQRVEDHRRQIADVGLCSPITFSAPSAGYVATNAAGMIAKYFARSFATLNVVSAPVQWIICLPTSTTCISFVGLLSRSTMLAASFRRLRCRCCIRERPSGPCAKPGRIR

SEQ ID NO: 1016013 - protein, 71 aa, Homo sapiens
MLNPDGVVRGHYRDSRNLNRQYLKPDAVLHPAIYGAKAVLMYHHVQYRLNQSSEDQPSYCFPPDATVFGGK

SEQ ID NO: 1016014 - protein, 80 aa, Homo sapiens
PTKGPPGNTKPPDNLQGSIPTGPRTFQFNEQADTLHESKTKKKNTSMLDLNNQKDNDFIFLFENVPESWNVSSRFMNIFS

SEQ ID NO: 1016015 - protein, 119 aa, Homo sapiens
ATEFPCLAFKIQLWSQGHLLAVKTLGVPGAPHACGPSTLGGRGGRIASSGVRTTLGRHGEAPCLLMQEIARRGGRLWSRLLGRLRQENRWNPGGGGCSGPRWRHCAPALGDRARLGLKK

SEQ ID NO: 1016016 - protein, 73 aa, Homo sapiens
YWLLTPGPAGWVLRGPVYPRRATGVEPTASEDFLSSVPTEWSQPAVQCPLLGSCLPSSACHPSLHLPAKKVLL

SEQ ID NO: 1016017 - protein, 137 aa, Homo sapiens
DPRNQALAVFADERTHHRHYDGKRCLGLTAYIFPLDSRSAPKVVGSVATFDNAGRTGTLGCIHRIEPDCTNLVNAHPDVTTTRCSASAITGHCSHPLFSALCRARIFTVDTFSQANWKPNVVIEVIVIAAVVPGGQR

SEQ ID NO: 1016018 - protein, 132 aa, Homo sapiens
MTGKLFLTPLSALQRARNITVNTRFRSKIKTERCTEVLTVCRKPCSHRAAERCSRLTVVASAPKRMQRRRGSRQAIFPTNRSFVEGSGPLRTFEANYLVSPEGRCGVRFREGPGEEPLRNDGENEYEDPVFL

SEQ ID NO: 1016019 - protein, 104 aa, Homo sapiens
KFDRRRNRDFSARISAAAPSSSLAQEHDSPATMYGRILFKDGSAQMIETLNQSAASEGLRDGPGRRLSPQLLRRHSVGIGHIDDDLARPGGQLRDISVGLETDS

SEQ ID NO: 1016020 - protein, 128 aa, Homo sapiens
LTAAPSLQSNCGCPLSTRRDRIETCDHGRSVELHQILKDQLTPAISARVHKQSTFRKPAKFDRRETEIFRKRANLRCGTVIVARQEHDSPATMYGRILFKDGSAQMIETLTSPVKASAKAQEEGFSPS

SEQ ID NO: 1016021 - protein, 123 aa, Homo sapiens
RGIQWRTDRWRLDDIQQHRLGAHPALITSFLRCGHAVDQDPTNGVHGGERDVANDSQLFVGLTHRLTQRRELLHHNEIRTGPSEPIVQDRFARQSIAPWWAMNIDPGCIRQSAFQTTADWVSI

SEQ ID NO: 1016022 - protein, 118 aa, Homo sapiens
GTNLHSCPCIRTRPVCTGAPRGLAQEDVHHHCNQHEHQAPLGHLTPSSRDPNCRPPLLCSLSHALPVWTSAGCWERGGPAPVLVLLLPLWSFLLVLQALFTCSSPVAHSHICGFPGGP

SEQ ID NO: 1016023 - protein, 121 aa, Homo sapiens
FLKNQVLFDTCSKVFLFFLLLSCSFSPLGHFPPTLGPHAWFRQAHCYFCGNLTLGPAQPLALVGGELAESQAAFSQDELLLKQAGLRAVGRLQQGLGMPQTRAGGFTSDLQTVRLSRQVLP

SEQ ID NO: 1016024 - protein, 31 aa, Homo sapiens
MGFQHVAQGLELLGKQNFPLFQSIWGFTGVT

SEQ ID NO: 1016025 - protein, 105 aa, Homo sapiens
GFSLSLSYHPLPSQPPLPEPAKDPKDLPKFSHCWPPHPPSKPLRGFLQGRVRAFTHGTVQDMMLLREYRQLQGTAVPTTQPLPPTIAPIQQEAARGQRRPSSITY

SEQ ID NO: 1016026 - protein, 46 aa, Homo sapiens
MRLSRSLRSFSSRDSTSSVLLVRGAFSSFFSSSEWSAADVEDSSSF

SEQ ID NO: 1016027 - protein, 65 aa, Homo sapiens
SQVLPPRLDFPRGMTASMSSQKHDKDFPALLEIRGGNGSRSRSSAGLRSVAQILNSSKRAIAQPV

SEQ ID NO: 1016028 - protein, 78 aa, Homo sapiens
RQCRAGFHAVVISQPARDPALGLDPRPFDREAMRVEAERVDERDILVDVVKRRTRSPRAGRRSSAYARPPTGRSHHSR

SEQ ID NO: 1016029 - protein, 108 aa, Homo sapiens
MVNSCPNKHTRVDCLALLYVVGTTDDPLVTPSLPNIQSWYVRPCREEELPGATGTGPSFPLGIPGRSCRSQRSILTLRWEGCSFYVPILLSFDIKKKYMFIVENLETV

SEQ ID NO: 1016030 - protein, 95 aa, Homo sapiens
PCCWPAAASAPQVLQKQSIVTFSLWRDTYTTSQVSKGCVAQAPNAILEVHVLFLGVPNGPVTAGADSPGHPSKMGTWAPRGASGPQCKQQCLASS

SEQ ID NO: 1016031 - protein, 94 aa, Homo sapiens
LRCRRSCRARTSMRPAKSRCNVELRLLGDDVDHAARIHQPVQQRRRPLQHLDAVRRVERTALHERHALHDRAVAAPKPRFMIVSCVPASVLPCV

SEQ ID NO: 1016032 - protein, 73 aa, Homo sapiens
MGRDQHSTESIRSNSKLFIMNTECGQTHDCACPRRFAEGNCFLDAKLLEVIFGDIQRMQFLQALLDRAADPFS

SEQ ID NO: 1016033 - protein, 130 aa, Homo sapiens
NFLPFQMESLFKNILLKTHKYLVQMKPLKWSTQSLNGQLEIPLEPPALPSFPYCSSPVHILLAHKAPPGPNPPPTTTIVLITYRENYVWLSWPNPRQKRGRKRLEQFFKCEYHLGVMHDGLPVLSLKFSN

SEQ ID NO: 1016034 - protein, 67 aa, Homo sapiens
SAGASAGLGWGVKSRAVLGLPGTPGPCPCCGLHREPPAGVPAPAPATAAFGLSWEARKAIFVQKLSG

SEQ ID NO: 1016035 - protein, 110 aa, Homo sapiens
MNIPSGPSIWSRLSPIGRFQFFLDFRVERACGCDSEWKARKPWRGGRQPCRCVPCRQSRGACPRCAVRASRSETSLAIVRALAQHIGTFHQTSRHGKQKCQGHIRRVFGQ

SEQ ID NO: 1016036 - protein, 76 aa, Homo sapiens
KAVAGDVATAADPNVLQQVTQRNPAGAQKWKLLVTLAEPGDSVDDAHEGLPQRTTIDAGTLVLDRVEAQDSGPCRD

SEQ ID NO: 1016037 - protein, 144 aa, Homo sapiens
QESTRSQSNPESCYKSNSGNESRCSPVFEFCPVVSRARSAGMLIAAKAERVRHPWLNAVRDAACEQRRHRNELDGGSGDTSSNRFMHGTDPQRMVSILPVGSFRHLDIGQASVNVGRFCAGSVAQPVSSRSSRTPRIARRGTSR

SEQ ID NO: 1016038 - protein, 109 aa, Homo sapiens
LLHVDVHEHLLRHLHVHAELQCGAEAALVDRHALPADVEPVVVEVRVVQPGADVRAHLARMVEVILQQQRARRPRRRGLPRLRRHLVPRRAEDQLRRQGSQRIMYVKFE

SEQ ID NO: 1016039 - protein, 133 aa, Homo sapiens
SLLINPRAFCLRFDLPVAQPPHDAPRHAREQAARHVVTGLHKTRRRDRRRTDRRTVHHHRIHPDHRVGFERRAMHDRAVADVAVDTEPARLADPDMQHAAVLHVAAVLDDRTEVAAQVRMRADVAARADRHVD

SEQ ID NO: 1016040 - protein, 118 aa, Homo sapiens
NDRGDDGDPQAHALFHWCWTRVVNSCHLKPMGLRHAIDRVSSRLTGTRERGAPRSPVDRLHRPQAIRRQLLINPRAFRLRFDLRVAQPPHDAPRHAREQHAARTFVNRPFTNAAGGRF

SEQ ID NO: 1016041 - protein, 120 aa, Homo sapiens
MGRPFRNALGAPLKPCSLSFRMKVEANTPKCKSKPRKARPDEWLQITDVFIAARAAMPYLPHHHTRAETRAFFKSVMETQEVWTAEATLDGEQRIAGFAAIRDTQGETWLDHLYIHPASQ

SEQ ID NO: 1016042 - protein, 138 aa, Homo sapiens
VPKFDQNPCRPRPLANGAPFLGPSSGTMNRGEQAVLGFQRVSFSDLVLDFFAGLLILRYQGAEVGEYFRVPHRLPVRRKQFGVPLDIEQLLAHQDEFLGEDERPSRPNAVSCRPIVPEEILPNEVPMGRVTFRSDSAR

SEQ ID NO: 1016043 - protein, 96 aa, Homo sapiens
AGFISACLIACDEANQVTATSDGVAWLPWLAPYRAEIHHRLVVPPVGELAFDRTAVRRIARKRPIRINLGRRRALIVETLPPCPFEKIDALETVPR

SEQ ID NO: 1016044 - protein, 76 aa, Homo sapiens
PVSPLWYPIKTLVETTVNLLTIQMMLLLQRHDGYQPVSQEYPKNEVFLFPRCPRHPYVTPEVVIEKVVPFPFSITK

SEQ ID NO: 1016045 - protein, 130 aa, Homo sapiens
KKDLEGPQIVSHRRNAFDCLGNDPTFLLEAHMRECTQSLNLSVPYYAAGKQSPTQNSSAQAGPSKRALECSLSLLCKHCGPVVNPSQIKWPLHEPCAKKGYVHPLCVESSCFSKSFGLSQILYVSLLIQS

SEQ ID NO: 1016046 - protein, 34 aa, Homo sapiens
SEQERCGPERSRYHLQQNVQFSEDTVRLYICEMA

SEQ ID NO: 1016047 - protein, 29 aa, Homo sapiens
TNPQCRRRGQKASTIPALRLLCSIYSIWF

SEQ ID NO: 1016048 - protein, 34 aa, Homo sapiens
KPPPGFSGLLPRALPACVPSPATTTTTKAPGVCP

SEQ ID NO: 1016049 - protein, 33 aa, Homo sapiens
LGVRNTQTQTLTCSGAREEPGAERAGGYFASGS

SEQ ID NO: 1016050 - protein, 47 aa, Homo sapiens
MTLASISDEHIQVERFEKVFSSERLFSWKGINFVMVNSVDLNGMLWH

SEQ ID NO: 1016051 - protein, 63 aa, Homo sapiens
IRHRFVTMADRAAKRACKDPNPIIDGRNPLNLAYLGAKRGPPDGLCIVQQLHHLDPADLRAYP

SEQ ID NO: 1016052 - protein, 126 aa, Homo sapiens
QFLAWNFEALTQAEAGPVSPQTSNCCCPGGPGGASELALLKAVDTWSGERSHEVEGVEKIRFPMMLPEDSLVQFNLLYWSHEALFQKKTLQALEFHTVPFQLLALYKGNLTEDNLTSPGFYNVHWE

SEQ ID NO: 1016053 - protein, 37 aa, Homo sapiens
CDVEYVLSVKTVFPGALTDGDASHVVGSSAAVMAVVF

SEQ ID NO: 1016054 - protein, 114 aa, Homo sapiens
RLVGFKNIILLPTKIPVLSTYQGVTAADSRVAIRAVELGLICATGAQPGRDTWPENGNGSTKISRMSLSHALARYLKRVISNYTDDTVSTVWFTTLSTLQFTTFQPCREFSTLA

SEQ ID NO: 1016055 - protein, 82 aa, Homo sapiens
SAQAPADPALPGASEPWQCPFTASLSIGGVSKDPFPGMASPGVSFKSLVSSYETRVVGMAPGLPKRVLFPLLPGSPHPRIWG

SEQ ID NO: 1016056 - protein, 91 aa, Homo sapiens
PNALSALDLHAKLRVDPVNFKLLSHCLLVTLAAHLPAEFTPAVHASLDKLASVSPVLTSKYLKLEPRWPCFALGPPPSPSSPSCTRSPVVF

SEQ ID NO: 1016057 - protein, 103 aa, Homo sapiens
IRLEGATAHAGRAPGRRASARTLYTGFSILVLLLAGQATTAYFLYQQQGRLDKLTVTSQNLQLENLRMKLPKPPKPVSKMRMATPLLMQALMGALAPGGPLQN

SEQ ID NO: 1016058 - protein, 43 aa, Homo sapiens
HALEAPERAAAPRSQEDQGLTKDYGNPLHRFKKAGLQELPEHI

SEQ ID NO: 1016059 - protein, 121 aa, Homo sapiens
MGALSCKTQRRSAALLPEPSETEPHPEGRNRRAHLKSCNTARVRGFILEVSETKNPPNPDTTPFLPIPSPWQPLICFLSLWIYLSWVFHAMKLLMERSPDPEPKRGFLDLVQKRIQGKSIK

SEQ ID NO: 1016060 - protein, 46 aa, Homo sapiens
TEARTAVIKTGAALRLLLLMHKGRKKTEHRPWENGQHHQVLQDLEI

SEQ ID NO: 1016061 - protein, 40 aa, Homo sapiens
MVSLAHGPVFHMEQQGVSLQWEGSSCQFRILQTLASSWRK

SEQ ID NO: 1016062 - protein, 101 aa, Homo sapiens
WKSRAQNPQGFGAGNFNSLFKAFEEEQNLRGNLTMENGVVPGMYSPAHPEAAQPRPLILELAQLPYWLLPLGPAHQRTRPPKSAHTDPNWRGRPLLQPSRL

SEQ ID NO: 1016063 - protein, 101 aa, Homo sapiens
GRDGFLLCCPGLELLASSIPPALASQSPWIIGMSTPSQEKIFFIFKTGSHSLIQARTHWHNHGSLQPQPAGLKQSSHLSRLSHWDYRCTTPGLIFKLFCRD

SEQ ID NO: 1016064 - protein, 66 aa, Homo sapiens
VGSAGEDNPAGQMNPGWKPSSDGAVVAPAPKSEEKDAAEIQKRKRLEQAGIKVMPAAQRFARSALG

SEQ ID NO: 1016065 - protein, 137 aa, Homo sapiens
LKGLQIPEGWGPWGMGFSKPPVCPLGGEAEAPREKICASSRPYLLSPSYTLEPRVCKPDTLYVFHVSTYTHAPAAASVSSSSHPFSCCCLPSQAGAGSFLGDGGSCAGLPGNKIGHGPGSERCGPTPIYDIKISTPK

SEQ ID NO: 1016066 - protein, 31 aa, Homo sapiens
GRATWKGVRTERAKRGAFDPYTLVGSRHDLD

SEQ ID NO: 1016067 - protein, 50 aa, Homo sapiens
PASAPRVAGNNGVRHHAQLIFGRVGFLHVIPAGLNYRSSDPPAWFQCPGL

SEQ ID NO: 1016068 - protein, 35 aa, Homo sapiens
SVLSAPLAALCCLDDDLAERYYGSRAWRRDEQQLI

SEQ ID NO: 1016069 - protein, 42 aa, Homo sapiens
AKPTLERLLERTNLQSNHVHATPVDVERQQLTTVTSDRKSCM

SEQ ID NO: 1016070 - protein, 37 aa, Homo sapiens
AASSVVDSAGLREMQAWGSLQLDREEKNGDASSISAF

SEQ ID NO: 1016071 - protein, 30 aa, Homo sapiens
MALNRMDLTTAALSARRDSGKNEPNHASRR

SEQ ID NO: 1016072 - protein, 130 aa, Homo sapiens
EDIYIATCLATGMFNYCFLLNWKITDGGFGLLYVCILNTYPRSACHIKDALGPGTVAHSCNPSTLAGRGGRITGAQEFETNLANMVRTHLYKKINKISWVWLRAPVVLAIWEAEVGGLLEAILDRRSRQQ

SEQ ID NO: 1016073 - protein, 109 aa, Homo sapiens
RQGLILSPRLECSGTITAHCSLDLLGSSNPPTSAGTGIHRRTQPHPANFVFFVEMGFCLVAQAGLELLSSSDLRQLPKVLGRTGLNHRAQLKKVKIYQNYGTFNIYRTT

SEQ ID NO: 1016074 - protein, 343 aa, Homo sapiens
EFTPHDRVARWLDEHAFDAEDTVMLRRVIDANGRSRAFINGTSATLAQLRELGEMLVDIHGQHAHQLLMRPDAQRELFDTHAGLVAEAANVARAWRVWRDATQAIDAAKAHERELQLEREKLAWQLAELDKLAPQPGEWEEVSAEHKRLSHSANLIEGVRGALDALSESDEAMLTQLGAIVSKLRSLADYDAALGDALASLEPAEIQLQEAVYSLSHYAQRLDLDPDRLAQVEMRLDALHSTARKFRLPPDTLHEEHAARRAQLAALDAAADLGALEAAQAKAWDAYLADAKRLSKARAQAAKALGTAVTAGMQELSMAGGSFEVALVPLADGGPHGLEQIEF

SEQ ID NO: 1016075 - protein, 162 aa, Homo sapiens
MLRPSAPDSPCQSETDVAGPNRPACPKDLPPKMSIHTPCGYDARPKPQEVGPTQIVILPPKSCVPPLLKNMVAQDPFEPIPAGIFIGHCHCCQNNLGIIPWPHKFGSDDIEDCQGETGETPCNRCCKNTGTRPRFRDPPACRTDLRAAMDLHPPDSQPASLA

SEQ ID NO: 1016076 - protein, 87 aa, Homo sapiens
MALWEKGYLTQNKYICHELALCGNECGYWSCVIWATWMKNGKDPVHLQKGKNGPSCTKGQGNTLELVITNPLDATLEERGACTLESM

SEQ ID NO: 1016077 - protein, 84 aa, Homo sapiens
MTRHINGKLFLPKYALSQDVCTYRDFIYRTVEIPGCPHHVAPYFSYPVALSCKCGKCNTDYSDCTHEAVKTNYCTKPQKSYLVG

SEQ ID NO: 1016078 - protein, 30 aa, Homo sapiens
CARVPPPSTYYRSGSYIDYWGQGTLVTVSS

SEQ ID NO: 1016079 - protein, 98 aa, Homo sapiens
PVLAGLRASTSDWILRVNGTGYLPGMGRVLLPGTEQFVSIQEKMAEDPLTYKSRLMVVVKMDSSIQPGAFRAVLKYLYTGELDEDERDMDIAYIGEVV

SEQ ID NO: 1016080 - protein, 102 aa, Homo sapiens
GCKDIRLRVLWPSQKCWDYSCDATMPSPIFEDFSYVKLNNRYSLNSWVISNLKRMFEPRHCAHACNSNTLEGQGRWLTRGQELKTSLINMVKPHLYLKIQLK

SEQ ID NO: 1016081 - protein, 50 aa, Homo sapiens
TLLVVKEITCPPPPVIYNGAHTGSSLEDFPYGTTVTYTCNPGPERGVEFS

SEQ ID NO: 1016082 - protein, 74 aa, Homo sapiens
KDYSLKTTSRIKRLLFRYHLLVFSAFTLSAGFVTTGLGKRIAYLLIGKIGNTTLGLGYVTVFLDLVLAPATPSN

SEQ ID NO: 1016083 - protein, 43 aa, Homo sapiens
YQGNRISMAAGAPTLSDRFSKLTMTNSFFIISGTHTIRVQVPA

SEQ ID NO: 1016084 - protein, 30 aa, Homo sapiens
YLCASSQASRTSDPLDTQYFGPGTRLTVLE

SEQ ID NO: 1016085 - protein, 151 aa, Homo sapiens
KQVKQPQAPDYAKKKRTPYPDLDVKLIADTFIAIHLSSTSGTITSRDQETITCCPAVSVAGSSSPVIIGLTYKQFFTAVQFQFKTSCRALILHRLDRAIGLQFTRGVEADMFRQGEASRHATKFLCHQSIKNIRCTNEPGNKPPSLAAYRD

SEQ ID NO: 1016086 - protein, 120 aa, Homo sapiens
MPLTELVSGGKIWFSTTPALLHTAGVVSGSGAAAAGGERAVSHSHPKGGWTPRHPHRDRHRPAFLHPPALLISLPLTRGTFPDGRLLEDARGAFLSPLLRHIILFPADRNALSSCRQEQS

SEQ ID NO: 1016087 - protein, 128 aa, Homo sapiens
ELSRATTLETFKSNERESHYIRRDGETEAWRNTVTCTKTSSKSKTRMTGCVTFQSKSNSAVEVATESCQEPLGTLSMPFPVGARMPALLLSPMALPVMLLNLAESELQLKARSLLYSPLGVVFYTTYS

SEQ ID NO: 1016088 - protein, 78 aa, Homo sapiens
RQYPNARDIHYNEYLNVSIDLAIRRSLEARAQWVESKMLMGKVEKFKPKFGFKGEVINEHVIMGSNLKEVMLYSGERH

SEQ ID NO: 1016089 - protein, 70 aa, Homo sapiens
MHQACGYQLLIEVRCCLGDVIFCPVGIIDGVTLVVTVCLISCSSDRHVAVTSNCRYPSSPEFKYLKGRIS

SEQ ID NO: 1016090 - protein, 76 aa, Homo sapiens
HKIEKKGTLAKSSYDTSITLIPKPGKDITKKENYRPISLMNIDAIILNKTLANCFQQHIKKIIHHDQVGFIPGMQG

SEQ ID NO: 1016091 - protein, 42 aa, Homo sapiens
QHVDHWRVGFLHLGLLPSQSAIATGSAVFSVLSLAARWFGKV

SEQ ID NO: 1016092 - protein, 50 aa, Homo sapiens
QRINSIPNIKGEIAKITISSLSTSTQHLAGTRSRTYLTETQVSGVSATLA

SEQ ID NO: 1016093 - protein, 46 aa, Homo sapiens
FCQTQGLSDHFCLKEIMSAWLGTDLFEVSPVVRGFTLEPLKSRLCH

SEQ ID NO: 1016094 - protein, 69 aa, Homo sapiens
QLVLHYDAICQYMGPSDADDDDPWDSSHAPRLVPVLSHMQLPSAARKIIVPYLSLLVQSWRQGQWERDG

SEQ ID NO: 1016095 - protein, 149 aa, Homo sapiens
KLCIKPSAADGSTMTVSSNGPRYQKLGNHLLTSMQLEDAQNSGHSFDRFTVQPRRPDGAARRARAALSVATRVSVAPPRGVIPRASHRKLRRRRRAVPAVGRYTTRALDKPIILGRGSVQGLARPTASSCMPAEVGIFGVCIFAGWRYC

SEQ ID NO: 1016096 - protein, 100 aa, Homo sapiens
LCSRSSSAAALHALALLTVASLWPKHAHVLDLPPRGIPLATTTPDRRKRDQQHCSTFYCQRPQYMQINQCDDNTLTKRKKKTQIITIDAEKAFDKVQHPF

SEQ ID NO: 1016097 - protein, 47 aa, Homo sapiens
SQFCRYPSHKNNIGRAKGLRPAINHFFEQADGEIQSALCRYQAPTQG

SEQ ID NO: 1016098 - protein, 54 aa, Homo sapiens
LDSDPFGDGSLWSFNYFFYNKRLRIVFFAASSISGSTYTPSEAGNELDMELGEE

SEQ ID NO: 1016099 - protein, 204 aa, Homo sapiens
MLIPFGALATEWFGARTTGGLYEVVLCLFSVPLVSPAQGGVYNPQGSRAPPMGGSGAPEALCDTWDLLGERDGSVGMWGRLIARVPQGAPRGGAPEWGLPPPPLVRGGQHRGSPPGIFCSIFYQYGEGSPCRWPPPVFSRTGFMNLIGVSGRPSVCHPRERAPPLGASPPTRLFWPHREPRGVCAHTQCPGPPSPTGALYLSAR

SEQ ID NO: 1016100 - protein, 108 aa, Homo sapiens
RWSPELVAQAGVQWRDLGSPQPPPPGFKQLSCLSLQSSWDHRHPPPCRANFCTLSKDGFRHVGQAGLELRPQAIRPPQSPKVLGLQARATMSRLVCFLKNLWPWSLKP

SEQ ID NO: 1016101 - protein, 117 aa, Homo sapiens
SLESCSHHPVGWWRFLLTRGLFSPPSCWAAAHWAGPPLPSMQPLQLNPRGSVQEGARRPLLVPDTFADGDGGREVSSGHLSLRRAGPLSALLLGCRQEDIILVLEWSHVESGKRPCS

SEQ ID NO: 1016102 - protein, 28 aa, Homo sapiens
MSSSLEQRPKGQGNKVQNGSVHQKDGLN

SEQ ID NO: 1016103 - protein, 43 aa, Homo sapiens
DTAEVSAESERGRAGLQLWDAIRLPRKLLAALAGCTLSSEDPI

SEQ ID NO: 1016104 - protein, 36 aa, Homo sapiens
IPGVVIKSLRQSGDWCSELREWTCSRRGQEKQVQVL

SEQ ID NO: 1016105 - protein, 133 aa, Homo sapiens
GTCNPPSCIALVFHVPGIWLTWDCSPCRALSFGHTFVPLVWSPGALRSPQLGNASSVILRSSSVLGHGRLLTVQSGARDVARSDAQCLSNALEGGRTVVLRGFLDVWCRMLNGDWSAAKNDARPPQDQDQNFW

SEQ ID NO: 1016106 - protein, 74 aa, Homo sapiens
GERGSTLGKRAKEEIFPKEKNPRGTLNIKERPDFGEEDSTQREHCMQGHSRREKRLAHSQSREVPEELSQKRGL

SEQ ID NO: 1016107 - protein, 104 aa, Homo sapiens
INNRNFLTILEAGKSKKVLTDLSGEDPLPGSWMFVFSLSHGRRGDGALWVSLYKGTNPIHERCYSPDLSLTKSPTSKYHHIGNEDFNIRNSGGTQTIQSTADIK

SEQ ID NO: 1016108 - protein, 105 aa, Homo sapiens
SPPASDPAGSLPQTIPSQGDLPYLLQHARHHPESPAPCKFPNCLLTSFLKLILPSLECRLLQQDTAPNHCFNCCRVPSTQQALFSGVPGSSYSWYGPEAAGGVGD

SEQ ID NO: 1016109 - protein, 76 aa, Homo sapiens
TESPCSLCGLEFLVFTIENGNYKIQSRSLFTCEASGDPIPSITWRTSTRNISSEEKTLDGHMVVRSNARSSLTLKE

SEQ ID NO: 1016110 - protein, 287 aa, Homo sapiens
AALLFLRSVVFVVLGSFPADRRSISLFLSLSSLSFWLCACGASLTHVCAHLLTSFVLFVSLIVFVFLSVLFLFLVFLRLQLVIIERHAPSPSLLVLLARRSRPTRACVFFSFFLIVFRCSLPRYAHSLSLSLSHAISRAGLLFSSSDCAVVVLHSLAIIYMDTLLSLFLWVWRSLFSLSCEACPHPRPALFVFSVSWVCRPPPRGGFCLVLFFCWCARAQTFSLHSSLRCVVTVPPAPPVAELGCVHGCPFFFFSSSDVLFFCISMRFFLLAGAAHHPPRLLLLPCI

SEQ ID NO: 1016111 - protein, 121 aa, Homo sapiens
LHNHWGKVKGKEEQVTSYMDGSSKERPCAGKLPFLKPSDLVKLINCHQNSKGETCSHDSFISHRVPPTTCGNYGSYKMKFGWGHKTKPYHSAPGPSQISCLHISKSIIPSQRSPKVNPFQH

SEQ ID NO: 1016112 - protein, 31 aa, Homo sapiens
ARDRVYVYDSSGSQYFQHWGQGTVVIVSSAS

SEQ ID NO: 1016113 - protein, 118 aa, Homo sapiens
SFPFPFESISSVHRSIPFHSSPIPFESVPFQSIPFESIPFHSMSFHNDPFHSIPFDSIPFYFIPFDSLPLDSFPFECIPFRSISFRSVRFLPFDFILFQSIPFASIPFHFTPFDSIHS

SEQ ID NO: 1016114 - protein, 113 aa, Homo sapiens
SVYILTSHWPRKVVAELQLACARSGGTAGLDPAPARHWMLPLSLVPGTAREKDALSNLLYVHCRYSIVDRCGTHGPLVLRPAKAPRHVSCHSVYSLLMSLSAATQGLGSTGPG

SEQ ID NO: 1016115 - protein, 87 aa, Homo sapiens
SAASGGSTRSRGEGLSQEVRVHVFPPVPAPQPGVEHPSPPFHPPGVLPSGDIRCRVLIPVLRVDDNLDDAFHGRGKPSSQFVVSEIP

SEQ ID NO: 1016116 - protein, 33 aa, Homo sapiens
YGQQSSLLAYNTTSHTDQSSRLSVKEDPSYDSV

SEQ ID NO: 1016117 - protein, 30 aa, Homo sapiens
GHILLCERYSISYNRPGNPGHRLPSIPDQP

SEQ ID NO: 1016118 - protein, 336 aa, Homo sapiens
GGGACGPQQCGTQVAGGGGRSAAGPPPGHWSLNGQVAEQLRTAAALLASPNPLPAGADPVGVQKSPQMWVDLMARPSWWCTRTFEQDVEELDLGAHGLPWRSTVTGGDGWGPELPTHCLQSCSARLERCMDVSVALSGGHATSSDWIRRPQPDQCMTDTLESHFWLDPEIRAMALLPIWSISGPIPLRGGRRPKGTIRNKHCERLARATTGGVPGGWLMGLTNEKPGKTAPRDNNTASNRVRSACRKTEMLADRHITRRIRYQVDRPHLALPGEIEKRGAARGSGGQGERRYHSRGTGRRPRENAVDNNGTNGDYEPSRSHGATEKRAQGQRRKGR

SEQ ID NO: 1016119 - protein, 129 aa, Homo sapiens
MWAWLSVSIFLWLQDAGGPGEVCHWSARSLCTEAGEASKDFRAAEPSLQFLPYKQGSNPKPGVRVRPQGEGPRGMGTCKACEGTFLQQAESPSQVGGESDKTKAQGGSSKDGKGSSIGWIWLLWDGEET

SEQ ID NO: 1016120 - protein, 82 aa, Homo sapiens
NLYTDIINILFWAQVQLLGNKQCPWAHIVCACCANLVHRLIEHLPCNIPLTIRIDASCKRRVPRYCSMKRMLAHTSEVEHSA

SEQ ID NO: 1016121 - protein, 101 aa, Homo sapiens
MSQVAVQHSFTHLSTNPTLSQWRISALLLTCYHWPPCMLPASNYRVDVSHFYPTPVRALTRTEAPPLDEPALHRLLKTPFLGDMATSAEAPIIYCQSPQPA

SEQ ID NO: 1016122 - protein, 207 aa, Homo sapiens
MFVARRMRPRVWRAARDSVCSVLYVASVCPFHHSALWCSYLRAHSRSRSISLRVTRSPAALGYAETQRLSRPWAPRALSSRITALARPRTNAACTHTERYTVRDHPRAVVDNTLTPRWRTHPLSQYLRALARTHTHTQAHNTRGGDTSDQDNVVRRALFVSHHYYATIFSATPLPGRRWRTTSGEMGHPSRQNRYFYTRNQSDNSRH

SEQ ID NO: 1016123 - protein, 49 aa, Homo sapiens
VGAFILIPLAAFLTALLSMDILVEHRSVQDAPGAGLGSSKKRGPRRLHI

SEQ ID NO: 1016124 - protein, 30 aa, Homo sapiens
MDPNCSCEAGGSCACAGSCKCKKCKCTSCK

SEQ ID NO: 1016125 - protein, 34 aa, Homo sapiens
EFHFNRYLTRRRRIEIANALCLTERQSKIWFQNP

SEQ ID NO: 1016126 - protein, 130 aa, Homo sapiens
MVSDRGTTSVKPVRSPVGRQSSGVILRSSPSCFHRTSMMLDHLQGQDVLPEVIPVLKDYAILAPLCASALVYMIHRGFILDSMNVYCSTQTSISMVLGSSGDCRWYRASRYVSCRMHLCIMSLVWGLGVF

SEQ ID NO: 1016127 - protein, 108 aa, Homo sapiens
MGGEGVSGPGPMPRTEKQEQNTIPRKTLRRTSGGAGCSRKLHPGFPSSGTFLSCPIACTESLSDEEPHWGPGRLGKHVVCSGVRGPEAVAVGVDGVVSIHVHVHLQRV

SEQ ID NO: 1016128 - protein, 99 aa, Homo sapiens
SLTLSPRLEYSGVISAHCNLCLLGSGGFPASASRVAGSTGTHHHTQLVFVFVEIGFHHVSQAGLKLLNLKFLDLYPGQINHLSQGACCVLVLWLQGLNH

SEQ ID NO: 1016129 - protein, 279 aa, Homo sapiens
KRGVYEGHLRGGFSLRGENLESCKHWEWTRGGGARQGAGSVLGPPASGRVPLAAVLAYAILVLAEALQGCRAGGVIIQDVLGLPELLVDEDDGDQHQHLSHDAQEGPEGGQVAAHAEERMAWSEPLAAGAVAPVLAGVGLHVQVLNVCSDRPCEELTKNLRSEPFMRALSSESVILYQAQLVTGGTDSDLQTSMARPLVDVVLSDFTAFTLGGPWSWMSAVPMGSGRKTQEYSPHWSSECTLNSVFWPGSASSFSTTPPFSQRCPVTSVALSFKEQVRS

SEQ ID NO: 1016130 - protein, 265 aa, Homo sapiens
MAPGGPSKPPPELPPDGTEKEGALEEFEAVTLGRPTVLGKSVLLWPREVQRSSLRHRGRTQDAVGPDENEDIKAQKWRNQTALASDRQATGPLVSAVNFQKGQGPGTDSGQWRRLCRPPGHDSDPEAESDRRGRRQAAPGRLVKTLQKEKILRNRILNGENPTFLKKKEVYDGNLRGGFSLKGENLESCKHWELDSGGGADREQESVLGPPASGRVPLADVLAFVILELPAALQGVQSRRRHHPGTSSGFRRFYVDEDDGDQHQL

SEQ ID NO: 1016131 - protein, 50 aa, Homo sapiens
MKIQYTVKTPEIQKPHKKKGITKKKKKEEKKTKEKQCKKERENNKKKGIC

SEQ ID NO: 1016132 - protein, 301 aa, Homo sapiens
SCAYLLPALLLARAPCPLLASLRIFVTGPEDSLRLIGRREQLPACKCQVALLGTLARVCACEALPFLVKKLGFLDSRVLSLEHLPALETVLSETPGFSCHFGVPVLASYTSCGALYLFSPVGPAQPVAPLPRSLNSPGPCPVCGRVSPVHHRGAPFSAPVADALTMRACPHCSLPFYGVYIFNQGHPGLAGSHSSPPGPSSYHLVPAEGLNLSPQEAVTPHTLSCHLSRPPSLAARHFRGTTFDRVCPGTLATLPRHSQTLPEYPSLGSTPVGPPASSNSARGPPGNPPPPPPPIKSPPPS

SEQ ID NO: 1016133 - protein, 101 aa, Homo sapiens
NHPRLAACCAWSQTCKLRCIDSPCVPAKTPSLRDYVNCCRNSSSPQTRRSGSLFVRLSCLSRLSLYHTADKHPLSENCHSRHLQAYAHSQPLGVEGMQDSV

SEQ ID NO: 1016134 - protein, 525 aa, Homo sapiens
CRFEILSRVVERRVVVLVSARLWCLVGVWRRHVGVRVVVPLFWVYPCCGRRLSDGVCRAPPCVLWFEAGLSGAVVCWALCGGPPGRGGSPVVSVGWGGGARPWVHHTGWGVTDNEGVALCFRRLFFRELAPPRIVVRDKFSPRGPRDIFGGANPVSPRRHVVLRSQEQGPDTNMFYHPRCVVPTARGLRINGRCFSPEKFSLFSNTICDTLKIVDAQSLSLTSRGRCAQRTQCCVLTDDRKAARATVGGHTQGNGLTPAESPSETPPYCELFGVFLSPDDILCVNRYNSVVIISDNTLLSRGNSVLVCGLRLLWDISVLSTLRVRYTPPQELLWNVAFVGARCYVRSSSMISLVTKLPHEMVYLSCALLSLCARPTLGIREKAPVLSSQREFKGGEFGFYHAATAVYSVLEGDLERDHAAVVVVLCGVLFRFLWPCLCLSWAYSSHDEHPLSTLPPRTKAPPPPPTAPTHPFPSWARNGKHTHAVWLHRKEKAPPWSCGNPGRRVESWDPFLLKSRPFCGYNLPI

SEQ ID NO: 1016135 - protein, 94 aa, Homo sapiens
FFETETHSVTQAGVQWHDFGSLQPPPPEFKQLSCLILRSTWYRCVPPCPAHFCILSRDGPCWPGWSQTPGLNRSTLIGLPRCWDYRREHHKLAQ

SEQ ID NO: 1016136 - protein, 108 aa, Homo sapiens
LFKVILLLTEINAYLIGSFGKANQKLKGMQPFVACPMWKPPPHFVPPLLQVVWPFQTKPVFTLHILIVPCLPKMYKTKVCSDHLGHMSSGPPEGCIMGAASLTLGNKL

SEQ ID NO: 1016137 - protein, 37 aa, Homo sapiens
AAAVVPSGEEQRYRCHVQHEGLPEPLTLRWGGKGGSY

SEQ ID NO: 1016138 - protein, 102 aa, Homo sapiens
GGDLMFHIQKSRRFDEARARFYAAEIISALMFLHEKGIIYRDLKLDNVLLDHEGHCKLADFGMCKEGICNGVTTATFCGTPDYIAPEILQEMLYGPAVDWWA

SEQ ID NO: 1016139 - protein, 30 aa, Homo sapiens
GVHRIRVDFKDSVSLRPSIRFQGSQGHISI

SEQ ID NO: 1016140 - protein, 252 aa, Homo sapiens
LDGALVLEVDERDQDDEEARREMARILKELKQKPKQQQKSRAFYRIQATRLMTGAGNILKRHAADQARKAVSMHEVNMDVVENDPVSKVFFEQGTYQCLENCGTVALTIIRRGGDLTNTVFVDFRTEDGTANAGSDYEFTEGTVIFKPGETQKEIRVGIIDDDIFEEDENFLVHLSNVRVSSEVSEDGILDSNHVSRIACLGSPNTATITIFDDDHAGIFTFEEPVTHVSESIGIMEVKVLRTSGARGNVIV

SEQ ID NO: 1016141 - protein, 153 aa, Homo sapiens [sequence omitted]

SEQ ID NO: 1016142 - protein, 97 aa, Homo sapiens
SLPIDIVLQTLLAFAVTCYGIVHIAGEFKDMDATSELKNKTFDTLRNHPSFYVFNHRGRVLFRPSDTTNSSNQDALSSNTSLKLRKLESLRREDFYR

SEQ ID NO: 1016143 - protein, 698 aa, Homo sapiens
MVGLLLGGIIFGVDEKSPPAMKTDVFFLYLLPPIVLDAGYFMPTRPFFENLGTIFWYAVVGTLWNSIGIGLSLFGICQIEAFGLSDITLLQNLLFGSLISAVDPVAVLAVFENIHVNEQLYILVFGESLLNDAVTVVLYNLFKSFCQMKTIQTVDVFAGIANFFVVGIGGVLIGILLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLIWRALGVFVLTQVINWFRTIPLTFKDQFIIAYGGLRGAICFALVFLLPATVFPRKKLFITAAIVVIFFTVFILGITIRPLVEFLDVKRSNKKQQAVSEEIHWCRFFDHVKTGIEDVCGHWGHNFWRDKFKKFDDKYLRKLLIRENQPKSSIVSLYKKLEIKHAIEMAETGMISTVPSFASLNDCREEKIRKLTPGEMDEIREILSRNSLSNPPATLSYNRHNLTADTSERQAKEILIRRRHSLRESLRKDNSLNRERRASTSTSRYLSLPKNTKLPEKLQKKNKVSNADGNSSDSDMDGTTVLNLQPRARRFLPDQFSKKASPAYKMEWKNEVDVGSARPPPSVTPAPRSKEGGTQTPGVLRQPLLSKDQRFGRGREDSLTEDVPPKPPPRLVRRASEPGNRKGRLGNEKP

SEQ ID NO: 1016144 - protein, 110 aa, Homo sapiens
SGLVTAGGALQLLCPVLCLEATSSSIFSQGPRGHPRAWGRPAGPGWPPCPVPSCSWGGIVPVWPGRWPHTLIHSHKYTHTHSHSHTHTHGCTRHTHSHTHIHTTQSHTQP

SEQ ID NO: 1016145 - protein, 31 aa, Homo sapiens
LLDRMFNSIPGLHQLAASSNLHFLQLRNQGK

SEQ ID NO: 1016146 - protein, 125 aa, Homo sapiens
GGQKQRLSIARGVVGSPKILFFDDPTSAVDARSENLVQEALDKELAGTTTIVIAEKISSVLHADRILVLDDGRLVGSGLHAELLASSAIYREIYETQKAKGGDEACMIFNARMRYFYRYLKRYWL

SEQ ID NO: 1016147 - protein, 55 aa, Homo sapiens
STATISTRTRAMWPGTTPASPKSRRDPRCLGWLHPGTSRTLCSRAAHPNLLVGRK

SEQ ID NO: 1016148 - protein, 49 aa, Homo sapiens
FSLAPADMNHSSRSHSIFLINIKQENMETEQKLSGKLYLVDLAGSKVSK

SEQ ID NO: 1016149 - protein, 80 aa, Homo sapiens
SIDTMFAELGKVWPKFDGFVHSIGFPGDQLDGDYVNAVTREGFKIAHDISSYSFVAMAKACRSMLNPGSALLTLSYLGAE

SEQ ID NO: 1016150 - protein, 91 aa, Homo sapiens
QDKLGNKGTTAVSKHGKQAEDPITTTHPPKDWGWVLQSCTGFHGATKVDFLFSDRTFLGKVQHALDGEIRAMNMDLLVGLCFLEESTRAGS

SEQ ID NO: 1016151 - protein, 90 aa, Homo sapiens
MPYQGRELAFKLGLEGKLVQQFTKIFMGLATIFLERDLALIEINPLVITKQGDLICLDGKLGADGNELFRSLILREMRDQSQERSALMTG

SEQ ID NO: 1016152 - protein, 109 aa, Homo sapiens
CVPRFQHRSPQHHANKEYRRRPACTTQIQYREYRNSYSRDAKRGHRKVISVEQCDDNDGPKIVDNSQSHQKDLQRYRNTTSQQCQYTKCKSNVSSRRDRPPFGNRIGHS

SEQ ID NO: 1016153 - protein, 111 aa, Homo sapiens
LTFHEKLKPEAFHEAKHRTEGLLGWETCSKSLPGKLKTIHTFSWILKMLSPTEGEREIWNPDPAALQDSESHPCRPAGLQRRRPKRSEMQFKIPMTFSFKKKLGMRCALLL

SEQ ID NO: 1016154 - protein, 114 aa, Homo sapiens
HCPRSGALCYPVNEWPSSLRGHKVHLVVQKLHLIKKNTIRLFFSPPRRSLALSRRMECSAMISAHNLHLPRSCDSPASASRVAGTTGASYCPRPIFVFLVETGFTMLARLFSNS

SEQ ID NO: 1016155 - protein, 85 aa, Homo sapiens
LALWFGKRSSRLSPAILRELENTGFPSPMSVWFWGRVEAPVRSVILAPPALAFPRLPYVCAPARGSQPEPDAKAMLTSFRPFVTL

SEQ ID NO: 1016156 - protein, 43 aa, Homo sapiens
MVRVEGGAPGRSLLSGSALVVAAGERLWTGGVALGCSAVCFCF

SEQ ID NO: 1016157 - protein, 145 aa, Homo sapiens
GTPPKRIPPLRETPKTPLICQDSPKVEMKGKKLLRGSQRERVGLPPQKGKPPSGLTSRSSRKKLLQARRKWGPIFNILKEKNFQPRISYPAKLSFISEGEIKSFTDKQMLRDFVTTRSALKELLKEALNMERNDRYQPLQNHAKM

SEQ ID NO: 1016158 - protein, 144 aa, Homo sapiens
TRIRKTHAAFTLIVDPDKFLIIAYNMTSLFTIANTSFGGVSYAFLKTDRNIAAMDNRTFADISLIDKVVEISRLRAFSSFSAMNHGMDGFTHLFFKTLLKIGARDPDRIQYLIHFNPFTGVITNVMHGLNNGGIGSASDNLLSA

SEQ ID NO: 1016159 - protein, 140 aa, Homo sapiens
AAQARFPASIRTDKRQLSTGFNVKLEAIPAFFCRYCCKPPGYIIERALGSGNPDPFQNRLPCAYLRTLFHQTFKAFTFQRYGVDTHMDDDLRAFFGFQAERYGIRRYAAGLLKAYFSCLKVALNLTNEELAQTFTEWNKR

SEQ ID NO: 1016160 - protein, 36 aa, Homo sapiens
QAQTDRVSQQNLRGYYNQSEAGFHIIQRMYGCYVGP

SEQ ID NO: 1016161 - protein, 43 aa, Homo sapiens
PLNISREMLQQTKILKVIRKNLVKNCLDLFTDLAEDKAYKKFY

SEQ ID NO: 1016162 - protein, 33 aa, Homo sapiens
ECEYDGHRASSSSMEKSYELPDGRYITIGFERF

SEQ ID NO: 1016163 - protein, 32 aa, Homo sapiens
KRDKAYFTKRLPVNDIIFLVWNKVDILKRQGP

SEQ ID NO: 1016164 - protein, 115 aa, Homo sapiens
PPQTGPWKTPRGGFRPPRAPTPLRGPKPPGVLTRPRPSLRGGLAPRWGPRPPKFFKGALKKKGPNRGPRGFSPPQAPWGGRGKFWPRPFRSSDPGPPGKKFQVAPPPPGKKVFAG

SEQ ID NO: 1016165 - protein, 39 aa, Homo sapiens
SNEEEEKKDGDKKKKKKIKDTYIDQDELNKTKPIWTRNP

SEQ ID NO: 1016166 - protein, 36 aa, Homo sapiens
MTRNPWRLEVFGWWLEAPRRRHPAEGPQLERRQDGP

SEQ ID NO: 1016167 - protein, 35 aa, Homo sapiens
FLEIVTNPDGFASRTARISMWAKTRSHTAGSLCIG

SEQ ID NO: 1016168 - protein, 41 aa, Homo sapiens
MATASPDVFLLMVNGQVESAQFPEYDDLYCTILLCVRPRLG

SEQ ID NO: 1016169 - protein, 72 aa, Homo sapiens
LSVVSRNGPSERSKNIRGHLKRSAETGEYIGNRSLGTLPGLTGYLDYKYQKELIWIFNWESQNFGFLFKCKY

SEQ ID NO: 1016170 - protein, 68 aa, Homo sapiens
APGGPLETVLTTVPGSEEVLPSTPVTRLAYRGTEAEVVVVRTTRTRHTWGLGEEVGDRVGEGGSGRYP

SEQ ID NO: 1016171 - protein, 49 aa, Homo sapiens
SVRGRSRCRTQVETETASEVEEVGVVEEVLAPTLLLGSVHYPSPQTQRL

SEQ ID NO: 1016172 - protein, 32 aa, Homo sapiens
SICVVEISEEPLGIGADIIGGATCTESVAVEE

SEQ ID NO: 1016173 - protein, 74 aa, Homo sapiens
SINTMLGYSTVTKVAKQTGAIAFGSHDILFWLDIFVLLGLIFARKIKFDPRPLPRFQPFKSANSSVFVLIANLF

SEQ ID NO: 1016174 - protein, 35 aa, Homo sapiens
MCSTRGSQSLNPEMGAIFPAHHPHVGIVVAWLSWL

SEQ ID NO: 1016175 - protein, 50 aa, Homo sapiens
DQDELDQLSKAAVTALALLYGTKFNYAHIRQFIKQWKHYGLDLQPGIRYS

SEQ ID NO: 1016176 - protein, 70 aa, Homo sapiens
RTNNPNKITSPRNPLSNRTVCAWLAKGAGAVLWLGALVKAGHPPLPVDAVIGNWQGGQTRPGSQGVLPNP

SEQ ID NO: 1016177 - protein, 44 aa, Homo sapiens
DYLTETQAKTEVEPEREELSVIFYPAKRQDSEIVMPSRNYTHTQ

SEQ ID NO: 1016178 - protein, 100 aa, Homo sapiens
NLRVMREVKAVVQTQYNSILTTTFPDSDLDKLEMIDKEQIYTAVVYYDPELKPLSADDLRQLQQQPPVVFTSQQHQAGLNYLLGKMDLKDIQDHRLHRVL

SEQ ID NO: 1016179 - protein, 71 aa, Homo sapiens
IGIPPPPPPVGFGFPGTPPPPCAPSLPPYPDFAAPPPPPPPPAADYPTLPPPSLSHANRRVEEEEEDFYRV

SEQ ID NO: 1016180 - protein, 50 aa, Homo sapiens
LTGNGILNYHLFNRHQLRTHRHLTEDRRMRFIIFDDPSNLKLYPSNYETP

SEQ ID NO: 1016181 - protein, 51 aa, Homo sapiens
VNGFGRIGRLVYQGCFELSVPVDIVAINDPFIDLNYMALHACRSAFPTALG

SEQ ID NO: 1016182 - protein, 35 aa, Homo sapiens
MFSLCMVESGADEVNLHGVTSLGLKQALEFAYTGQ

SEQ ID NO: 1016183 - protein, 66 aa, Homo sapiens
MPLSFGVTPYGYESRFEIHFDDKFDVSFGREGETMSLGCRVVITPEIKHFQPEIQWYRNGVPLSPS

SEQ ID NO: 1016184 - protein, 36 aa, Homo sapiens
YNPFDGPNENPEAELPLTAGKYLYVYGDMDEDGFYE

SEQ ID NO: 1016185 - protein, 55 aa, Homo sapiens
DQRARITNQFFIRSKASRSPGRIIGMHHDQRAIPVAQELGIIACQADPGSQVGRF

SEQ ID NO: 1016186 - protein, 68 aa, Homo sapiens
INKWLFIIIILYYNFIGCTIIHIFISQTKCMTSFPVFHHKYCRLNILFADQLNIRALLGNYCNRCPLM

SEQ ID NO: 1016187 - protein, 56 aa, Homo sapiens
PVVAKGGSPLGSGIWNERKEQTLAFDRTDRYSWGNSRAPQGGHRRKFQGYIVYNLD

SEQ ID NO: 1016188 - protein, 63 aa, Homo sapiens
VNSKGLEIISYWLANSKIALVIEDTISSTKPFNDGKPTLTLDKRSYCLTFTFSRENCISFEVT

SEQ ID NO: 1016189 - protein, 71 aa, Homo sapiens
KIAVRNTTCRNNQKIDPTMVGMVNKKKKVVKPGYKRQIKSAIQRENQMDRRIAKREEMRAVRKSNKKRGGP

SEQ ID NO: 1016190 - protein, 56 aa, Homo sapiens
PQFGTNCLESLKTGFECQGGVKGPSRPTLCSPLFCARLIHTEEFASITPTTIKVAP

SEQ ID NO: 1016191 - protein, 140 aa, Homo sapiens
RLQNEIEDLIVDVERSNAAAEPWNKKAEELRQDPVAEWKQKYERVAERSSEMLSRRRLRSVSSRALTYCKNAYAGVPGYMLEDFKRDNKNLQEEYLHLTEQLGFSGETIHELEKVNAAGGRVDGAAVSLEEAEPLEHEEA

SEQ ID NO: 1016192 - protein, 31 aa, Homo sapiens
MAFAPELAVILLFKSLKLITRPIFITQAAII

SEQ ID NO: 1016193 - protein, 66 aa, Homo sapiens
QLEINFNTLQTKLRISNQILTLHEPPEGIAIVYGIIACVPWVRRLAAESVERGLRGSAYVSIEISE

SEQ ID NO: 1016194 - protein, 69 aa, Homo sapiens
SLGKRDFKGNGETPQDRYMSAAAMADDLSSVLSARRGNEERFAQCRKRLMIAHYSDGTNFKTTLKTGGV

SEQ ID NO: 1016195 - protein, 95 aa, Homo sapiens
PPSLRIVHTNTSECPIIWAKVKVDDNALQKAIADAKVAGMTTTQDKSATKTVNFNQFPDTQKTILADYQSQADNINALVHKHTDLNTTLLSQRQP

SEQ ID NO: 1016196 - protein, 78 aa, Homo sapiens
MANLLPVIELMKPAVNAESDPARKTRIILWSESKMFFMQLEVVFQNFWCVKLGVKILKKGINFIIGGVFIYRVTSPDL

SEQ ID NO: 1016197 - protein, 44 aa, Homo sapiens
MCYWPQDLKLASLHPGDCGFQGIRAGVGIHGPPGRCSAVFSNES

SEQ ID NO: 1016198 - protein, 113 aa, Homo sapiens
LIQSCPLDRQGVRNHIRIDVVHQCAVAEGFTITGVHGVTRELLTINDDVVTPRRHRSGGPHVVEGDHNGLHELLEVTEANFIGRDDKGEAHIPHVLIHRSTTGEAAVMVTPFS

SEQ ID NO: 1016199 - protein, 90 aa, Homo sapiens
GLLVLLVLLVLGKALVTVVRSVLLAPMDLLVLLVLLVNLVLKGERGAKGPKGEYGVVGPTGPVGSAGPAGPKWSPPVPAWKFVVMEAPLV

SEQ ID NO: 1016200 - protein, 93 aa, Homo sapiens
RSTNVRTSSCRVAILCSQCDMLVALPRLEHGQIAAMSPVWHNVNRGVVCPSVAFPPPYGLAVLFMLLLSNLFSFCEYERCRSYQCYYITGNSR

SEQ ID NO: 1016201 - protein, 81 aa, Homo sapiens
TVIGGDFLAEIIKTITARSTSNPSTRYQDTGPVISQVVHTLSAVLLVLWVLSFITKETKKFMVAQCIGGHWDFLSGVVSVY

SEQ ID NO: 1016202 - protein, 75 aa, Homo sapiens
WMNSYKPEELFNADGSLKDEVKALAPKGDKRMSANPITNGGRRRGEAPKTLDLSDLLLNSQTTLLTKTLDMNCPK

SEQ ID NO: 1016203 - protein, 82 aa, Homo sapiens
MSVVYVSRIEPTCSSRSINRGYNRGGPGRAYRGYPGIERLRQEDRCTPEGPHTHHQPCVGPRAFRMGTRKRGSRGKCKPLPI

SEQ ID NO: 1016204 - protein, 72 aa, Homo sapiens
PASLRSMAGCCAQGGRYRTPGRRGTDRGPRQQEVSRGPSPGHSRPINQLQDIPGIVKLRLPLLFSFFSEIIL

SEQ ID NO: 1016205 - protein, 64 aa, Homo sapiens
ELHRDLHQGIEAASDEEDLLLVDHPTGPGIDGNWPQFEEWSLEPQRTISRIEKGGRSPDEVTLT

SEQ ID NO: 1016206 - protein, 207 aa, Homo sapiens
MSRPRAETLEARVGDVCGLREQTVRSCEGSKFNPWHKTTAKDRHGKDSTHLNEEGPTGVCSEGNALLAAWLVRIGMLDEGKMKLEYILGLKIRGSSERDACRPTVVQAEALGHSPSTTLRVLIRQRHIRVRKTGWLNIPSFIVRLLIPRSTSTSLCALPYGGGRPGRVKRKNDQEGPRVGAGAGDDEEEDEVHLSLLAADCYRFPAN

SEQ ID NO: 1016207 - protein, 59 aa, Homo sapiens
ISGRSLLPCAKILMDGAHYLLLGTCLAAISVRVPYAIMFDLRAPCPMVLVLLQSTVYVR

SEQ ID NO: 1016208 - protein, 61 aa, Homo sapiens
LSLGNREGDVGLQVNLLEFGTSLSQVVGHCGSQMPHGSSGQSCPHGLLAQLNSWIAIIEIT

SEQ ID NO: 1016209 - protein, 52 aa, Homo sapiens
VRHTLVDVFTGHAIRHDAERDNRSIWLSPNSAAHLLAVPIVFAGIGLRQWQP

SEQ ID NO: 1016210 - protein, 46 aa, Homo sapiens
LYSNGAIAEVRPPTEDVDHNRVAVSPCMHGPPCSTLDHPDSSFSRD

SEQ ID NO: 1016211 - protein, 104 aa, Homo sapiens
SFGHPLCTPELLSLLGRPTSVYKPCFVPVPFSTLRVPLLPLIFPFKALSRGSVLLPSSHSLPSLTRTPFLILPGIQPWSELQQASLQSLVCSKTVASGCEKWAS

SEQ ID NO: 1016212 - protein, 35 aa, Homo sapiens
LPTYNMRILIPQYRHVKAPLPVNKRFQQKLNHPAT

SEQ ID NO: 1016213 - protein, 75 aa, Homo sapiens
QEPVESEGSQQVGGGGPKLSVASSEDLTQFMGTLEPEKGVEPSTNTPGLAPALGYVLLPDSGWDLGEVLCWSVIP

SEQ ID NO: 1016214 - protein, 241 aa, Homo sapiens
FGAYRSRKDESTQRKLQPKGPQKFQYVMVTKKSFLEDIRKALVRFPRVICDAQGVYACYGMAATVVLAGTLQSMAASPLMWRGGCIIRSCIPRKDKLDAFDSKPGYFRTSYWTTFSKSAVENCQDSWRRAVSTGVQAGIPMPCLTTALSFYDGYRHEMLPASTHARLQRDYFGAHTYELLAKPGQFIHTNWTGHRWHRVILVIQCLIMLLLSPSTIPQTRTFHVPHGTATWPFAVFSVQYF

SEQ ID NO: 1016215 - protein, 69 aa, Homo sapiens
NPTLLIEAPLNPKANRDKMTQIMFETFNVPAMYVAIQADAIPCYAFLARTHRPLFLDSGDGVTPQCSPS

SEQ ID NO: 1016216 - protein, 118 aa, Homo sapiens
GVANRAAVEEHVQPLDQDNREEIGQILDGIEQGEYTEPFTTETLKSVRKRSHWQQDLKIYKWAADHDYNGNDILAAYELYQSRISLVDNTVLNQYLQDLESRLDIGFFELADFEESLL

SEQ ID NO: 1016217 - protein, 53 aa, Homo sapiens
PATSDNGKDGLAYFLPLLKNELLGAGIEKVQDPQTEDRSLQPSHALRKKGSVS

SEQ ID NO: 1016218 - protein, 66 aa, Homo sapiens
SNHVLAIGVGLNEPNVSFGKGLVPIFGHNMGDYNAIWPYHPTEFSALQNMTAKSIIGKPIYVSEGK

SEQ ID NO: 1016219 - protein, 67 aa, Homo sapiens
NSYRFCSVITVNNTELAFTGIATTCIINNGHPTAHFIINALHHFIWFGRNDHDLHLLLTGIKGINHA

SEQ ID NO: 1016220 - protein, 57 aa, Homo sapiens
MSVVRTPLKSSKFFMRLGFCGVSVVVVGFLYDFLTMRDLRLISFMSSQTKRSPSSVF

SEQ ID NO: 1016221 - protein, 89 aa, Homo sapiens
MRKFFHNFMKHRVAGRIGGAVFYAVIVAVAMDYFLAARAYLLFWFYRFAQLVSTFIWRADSSWLALAFVNLPMLMIAWWRVSWRFAIFT

SEQ ID NO: 1016222 - protein, 69 aa, Homo sapiens
MDLEEELVAANLGARQQAWRFPLPIKPGLLLLSWAHCDHWPLYSTACRCFKAEPRPLTPGWEVAKDAGA

SEQ ID NO: 1016223 - protein, 55 aa, Homo sapiens
CHHKKYCREEASAQIAPRTHPYSPKSEAPRTTRDEIRRASALMIVERRPPRQDSP

SEQ ID NO: 1016224 - protein, 36 aa, Homo sapiens
MIHVKRLLEAFLLSALTLLVLLVRLAVDVHSPFSST

SEQ ID NO: 1016225 - protein, 112 aa, Homo sapiens
SRSPDLVILLPLPPKVLGLQACNCARPNNTVVIKYFPCLSSCLRCWCRCMLLFCWLWQRAHCCTDHSCSGDCFWPVADFLHCVGGVMWCSVSVCVGAWGGRCARGVVALCLF

SEQ ID NO: 1016226 - protein, 48 aa, Homo sapiens
MSSNAVISLVFFNCANLIADPTPNGIPSCFTVTTLSIPLTNRIENWIY

SEQ ID NO: 1016227 - protein, 101 aa, Homo sapiens
LQKSGAPKIQDSDFKYLNTHREGYPNKQVDVLNIFGNLQDGSNSDGDVTVVSAKSLKYLLRDRYKHYQELEISGKKGQHSQLHENARVDRAIGEFLWPIVE

SEQ ID NO: 1016228 - protein, 44 aa, Homo sapiens
GEVLGLWFPGRGRHAKVLLGVDWKAGALGGPWEGYQSQVSEALS

SEQ ID NO: 1016229 - protein, 67 aa, Homo sapiens
DCPGFTYPTDSSVETQNDVRESIINMKATKRLTVPEDVAGSAVFLASRLANNVTGQCLYVDGGLVMH

SEQ ID NO: 1016230 - protein, 56 aa, Homo sapiens
SCTFLVAQAELTRDKSSKKRPWQWDPLEEERLPSQAAPPLVLTTPLGGGVHWVCVP

SEQ ID NO: 1016231 - protein, 130 aa, Homo sapiens
ERRAKWNASDSSWMLNSSEARSQSDRLRSAGYELSTITYSVSHDTIIGDTYENEGSHKLCYKKSEAVIEIIGTNLYTVRNGTRRPGWRTSVIEGLRSRRHWPESYSSNVLVIVQVNHGTRYEGLTSRKNR

SEQ ID NO: 1016232 - protein, 52 aa, Homo sapiens
VFYRELFYSIPAAPLDAMKHGLQLCPTTPTGSHFSRLSDGPLPDGNQKIGAA

SEQ ID NO: 1016233 - protein, 63 aa, Homo sapiens
SQYGEIARLPRKLPEGYALEYKEEAGIRLASYRRSKKKDRTQRTPPLLAPQRVRSGAAASLVR

SEQ ID NO: 1016234 - protein, 61 aa, Homo sapiens
GSHMLNRQGEGQRRYSGERDEGRDHSATRPGAQQCPLLVLLFSVADDVHHVLVVQVASHVR

SEQ ID NO: 1016235 - protein, 94 aa, Homo sapiens
REQHVYLTAHRHREEGFQAIYHVLLHGLQGVWWMAVEQRSDMFRPSSFLYVAVAAHILYTLRSYSEKGGSPSGNRPPVQKVARLHSTCRVWGLG

SEQ ID NO: 1016236 - protein, 41 aa, Homo sapiens
GGLADDTCGANAKQSRDSCRMPSRVVADAFFSDALWEALNP

SEQ ID NO: 1016237 - protein, 108 aa, Homo sapiens
KAQNGVAYVQEQRANMPPREPLFKRRERPKKSITDFGDDPLGVKTTKTATVDPVVPPATAPADWNLSEPDIKWQGPVRADCNTATQRPATQLCANPLKAQPSRNRQSS

SEQ ID NO: 1016238 - protein, 65 aa, Homo sapiens
MDYLALTFPSPKPMALPSSPASDTDAGALAGLGVDTAGAGVGAVSVGATGPCHLISGSTNSVAGA

SEQ ID NO: 1016239 - protein, 86 aa, Homo sapiens
ALEVVLVGKDGYNRIEYEPGTLVWAVFSIYPPGDMCRSQSSQYKATVELGNQPHKEIRLRPETTYSKKSLHRLCCAARHCELLQSR

SEQ ID NO: 1016240 - protein, 88 aa, Homo sapiens
MVCLSLSSSETYTSRTAPEVCAPGINHAPGTVQLHGIKDAGWFTLSPVSSRLVTVRRRASYREGEPQHHKGSVRYVLIIELDRDLIVT

SEQ ID NO: 1016241 - protein, 74 aa, Homo sapiens
LQREGSIETLSNSSGSTSGSIPRNFDGYRSPLPTNESQPLSLFPTGFPYGTSHLLLTGWPTHPLEGPGHSLPPG

SEQ ID NO: 1016242 - protein, 38 aa, Homo sapiens
VEIVPGSHLEWIPDRALTLLFCLLSCMLSSLQPVRANQ

SEQ ID NO: 1016243 - protein, 91 aa, Homo sapiens
THCRFNNLITQLIDKPDIFSNGMNFSGEMIPRSADTQRHNASAPRMAGVNINDRLIDEEEFANFHCMANITRNPDILFYFVEFRVITENKL

SEQ ID NO: 1016244 - protein, 91 aa, Homo sapiens
IRALYTKMVPAAVSHSDFWHRYFYKVHQLEQEQVLEDALKQRAEQSIFEEPGWEEEEEELMGILPIFPKEAKFPLAKFFTFPEGEPGPQSP

SEQ ID NO: 1016245 - protein, 62 aa, Homo sapiens
SEVPSCHSIYMRQDGFLAHPSRTEGCMFKGPRQFYDDTCVPENFDGDIKTRARTVSGRTHPK

SEQ ID NO: 1016246 - protein, 107 aa, Homo sapiens
EVGITNVDISTVDKDSIAPKITRVTYPAKAKGTFIADSHQNALFFYLVDVTTGAELTPHQTFVRFHNQKTGPEVVFVAAPANTPVYTFPLATFARPLAFASAFRTYT

SEQ ID NO: 1016247 - protein, 104 aa, Homo sapiens
MSPGRRRSGPQPWRREILVRRLPGSRQFSFFKEKKKAEGLKFLDSKITSSSTSPEEAMGTPRIQHFLILLVLGASLLTSGLELYCQRGLSMTVEAVPANMFNWT

SEQ ID NO: 1016248 - protein, 52 aa, Homo sapiens
IKLKSSELQAIKTELQKSNIDALLAALSSLRVKANPDGKKKGDGGGATAAAA

SEQ ID NO: 1016249 - protein, 32 aa, Homo sapiens
MAAALDSVWALLGPVSVREAAAARRGDMLRPC

SEQ ID NO: 1016250 - protein, 60 aa, Homo sapiens
SRWPPRRVTPRAPPAPIGGELSVGWRWSLSPVLAFHFLAQAQAIPFGRVERPKPWSGPGS

SEQ ID NO: 1016251 - protein, 108 aa, Homo sapiens
LRAAVPRIPSTRSYPTDSYVGDLHPDVTEAMLYEKFSPAGSILSIRIFRGLITSGYNYAYVNFQHTKDVGDALDTMSFDVIKGKPVRLGLSVIHEFEKVGVGNIFVKN

SEQ ID NO: 1016252 - protein, 65 aa, Homo sapiens
LLDLLTNRVPPGVDEAAYVKAGSWLLSRKANIPSAAPEKAIELLGTMQGYNIHPLIDALDAKLGT

SEQ ID NO: 1016253 - protein, 48 aa, Homo sapiens
MGPEEWPWCQRVKAELTQQEQGFCPQAAAAAQLKPASHIVFRVVLEPA

SEQ ID NO: 1016254 - protein, 64 aa, Homo sapiens
GSNTCSQEPGLEPLEPESTLMSIVGAPTLLNPESCGIDQGPALCSTPPGTEITGTFGGTPYLSR

SEQ ID NO: 1016255 - protein, 79 aa, Homo sapiens
EGEKIRKKYPDPCPCIVRKGLPKPRIGDLDKKKYPVVLLILTVWFSFYLLEFRKRIHLRAEDALFFFVNNVIPPTIATL

SEQ ID NO: 1016256 - protein, 101 aa, Homo sapiens
AKVQEGGSGFSAGEKQLISFARTIVKDPKILILDEATANVGHRERKYLIQQSLRKMRQNRTTIAIAHRLFTIKDADLILVLDKGEVVERGTHDGLLAQRRF

SEQ ID NO: 1016257 - protein, 79 aa, Homo sapiens
GRFVTIIHLVLSKISCQANCPKANGMPFLGYPWQLMGPHPKFERIQKTNVKARTIVFIQMFPNSGVACMFTMLIGPKLQ

SEQ ID NO: 1016258 - protein, 79 aa, Homo sapiens
IQLDERLIRRCNFEKWGGGVGINVSNLREAGAPTYWDRPFSRWRCAPHEVVGRLFHIFITSWGTTRGRVLSICQCSLPT

SEQ ID NO: 1016259 - protein, 74 aa, Homo sapiens
DRISQIKARLIEHSNSNSNEFASAEEMAEIVDLIVTQKVDGVFADNDMMAVQLQNALRRANIRVPEDVIVAGMT

SEQ ID NO: 1016260 - protein, 37 aa, Homo sapiens
MRLPLATWNSFLTEEIQTPLLLYHEKGFGLATCRPAW

SEQ ID NO: 1016261 - protein, 106 aa, Homo sapiens
MSFWAVCLSPSTLLLSWERMPSSRSLGDYDPYKHTAGYVSEYRFVPDQKEELEEAIERIHKTLMGQIPSEAELNYLRTAKSLEMYGVDLHPVYGENKSEYFLGLTP

SEQ ID NO: 1016262 - protein, 91 aa, Homo sapiens
MTALFVMPNPTNCTTCTIVHSTVERVNSDKLTAGHFCLINNAKKHRNMIVAVLFGQTKPRICLQYGGLYIFKIEKRRDFLGERINGNPPVF

SEQ ID NO: 1016263 - protein, 69 aa, Homo sapiens
RAALSGVPAIKRVDNAIELVIEDGKKGQFPGGQTVTYGLKQKGVDIARDSMPENAWAATQAAKQEILDG

SEQ ID NO: 1016264 - protein, 52 aa, Homo sapiens
HSKKVQSWIPTLPPDSIDMEEEPGDKAPAYQLFTGDPSRLPCSKEVYIQEPP

SEQ ID NO: 1016265 - protein, 46 aa, Homo sapiens
NSLSRYPKPPACILPTSQYFHRSLSHKAYTQYYTDHSSPSSQTSRG

SEQ ID NO: 1016266 - protein, 73 aa, Homo sapiens
EHSSFGLQVRLRQLSIVILQDVPYWPYLTAETLKNRMGHQPPPPTQQHSIIDNSLSLKTPPECLSLPFHPQLY

SEQ ID NO: 1016267 - protein, 49 aa, Homo sapiens
PPLPRTPTIASVIGPGGKHVQAQDPSPALGCGGLSLEPPTLGPVPEGKR

SEQ ID NO: 1016268 - protein, 84 aa, Homo sapiens
NESKQAEDAILVIGSGAFRMGDAASGGYATTITLSELRRLQYPTIIMNNNPSDATLLPHLADKQYFEPLEISDVMQVVELEQPK

SEQ ID NO: 1016269 - protein, 53 aa, Homo sapiens
ALTGIPAVRQGTTIFQQRIFAGKQLEDGGTLSDYNIQKESTFNLVFRLRGGMQ

SEQ ID NO: 1016270 - protein, 49 aa, Homo sapiens
PVYLNFTRAELIFIVDFEFATKEDPRSSYERGPRSLVHRVNFSSSEIPA

SEQ ID NO: 1016271 - protein, 96 aa, Homo sapiens
DLVEIKGGDRVPEDLRIISAHAKVDNSSLTGESEPLTRSPDCTHDNPLETRDITFFSTNCVEGSSGRGGGPATALSWAYRHPGIQVRLADAIAIEF

SEQ ID NO: 1016272 - protein, 62 aa, Homo sapiens
GSVKLVAFEAGLRTNMVPGIARATVVTAQAEAMVCRFPRLFGNPQISGSAESDGDDIKFVVN

SEQ ID NO: 1016273 - protein, 96 aa, Homo sapiens
AQRRERCRPKTMLEKNPEFYAACSAAIKQRPRVHSVDSFVHTFKRVHGDEVFPSTPTVYRDIEAGRFELRAHDLPRKPSLRIKRAIPITRTNKTGL

SEQ ID NO: 1016274 - protein, 66 aa, Homo sapiens
IVGVDDRSANLRVFWDAAVCEPSTGVIFKCFGFEIMSFGVAVSRIFELDKTSIGQQMETTGFVCWI

SEQ ID NO: 1016275 - protein, 65 aa, Homo sapiens
YERVRDYSQKVLERQPDNAKALYRAGVAFLPFWQDYDPGPPTNLPGCRGIGIEKVSKKGFEFKDK

SEQ ID NO: 1016276 - protein, 124 aa, Homo sapiens
HTQGFSSPFTSTAKPPGPPEDPSEGGRGGRFQRPPFKEEDAEAQKGEVTCPRAKNQQCRGPKANLPPLEPQPPGPLAVPTPPLFSLCPPPPQLTWACRDPKGSLAAEIFQEWQLGEAWSTPERN

SEQ ID NO: 1016277 - protein, 66 aa, Homo sapiens
TYSALNFRETSPEQRGSKVHTKMTVNDQTIITRNGKVVSMATQQQHEVLYKQSPLPPETVLTPELP

SEQ ID NO: 1016278 - protein, 72 aa, Homo sapiens
FPTNVTNGHLGLFHFRLHVFNQFLTAVFGQLRNHQPNRFPVVLRRQARFRFVNRPFDVLLRSSSRTARYTLA

SEQ ID NO: 1016279 - protein, 49 aa, Homo sapiens
FVEAATNSLQVVEAASTSSSPKAAWRPAFVRPPTCLVDNYSWFLSAGAI

SEQ ID NO: 1016280 - protein, 62 aa, Homo sapiens
FGHSFSVPASSSGVVVKDIGLLTSPDARFFALSARFEPFCIKGLALVVPLTVNLGGTSLWAA

SEQ ID NO: 1016281 - protein, 76 aa, Homo sapiens
LQLSQCLSCGMLGAAHIVLAVLRVWPLQSHAPAGGIGPTGRSWVLLPGGLGSVTLYHCGPSPQELAYASPAEAILP

SEQ ID NO: 1016282 - protein, 46 aa, Homo sapiens
GGRGCKGLRVSVRMVAGDQEQHVIIEVKTVKGFEEEGQEISSVSPE

SEQ ID NO: 1016283 - protein, 46 aa, Homo sapiens
GRPESNLKRVGEADSGGVVVANPKRELKDLNASLGLTVDRAYTGRF

SEQ ID NO: 1016284 - protein, 43 aa, Homo sapiens
DEARKKKALSNMMHFGGYIQKQAQTERKSGKRQTEREKEEEDS

SEQ ID NO: 1016285 - protein, 50 aa, Homo sapiens
ARANFDIIRSSVINIIIKSKIIRAKRDVGRDGRTTVTDAFRSIIDRNRYR

SEQ ID NO: 1016286 - protein, 51 aa, Homo sapiens
SDAKKDNRLTLTVVTRRCRQRRDLIHFDVNCWEWERIACMELQTERTRAAR

SEQ ID NO: 1016287 - protein, 52 aa, Homo sapiens
LHRITLSARDMEMKGASFIHLITVGQYSNDGEVRATEYNDSGVDIYGGVGQI

SEQ ID NO: 1016288 - protein, 280 aa, Homo sapiens
TPIVLGPLTDRTLTKFHFDHLTWGPAAVVTQSAGTLGEAGEVRKASYRFFSSSHLVVDRQKKDLGTCPGGHRPQSPQGPNLGHGGGCWCVGGGGGQLPPAWQRKAQFQITRDLTVNTLKLVLRPEELWLGLVLVLVPGGISQRKKLQFRRWAGSGCTHSGLGRVPGEGGGLSHSHLASSPEGLSGPQVPMFQGSPGECRSEVSDLVLQFSGNVLQAEGQHLLGGRILLQGIYELVTVLLRVLVELVESKRVYKECVCAREISARCVYMFWALCTICRIPL

SEQ ID NO: 1016289 - protein, 31 aa, Homo sapiens
PAASGGTPRPALPPAQPCQGSPAMLFRFLGD

SEQ ID NO: 1016290 - protein, 183 aa, Homo sapiens
MYENTLIIYLKQLRNKVILLFFYNPGKKKVHIGSWAQGKAPPEPLSEKRLFRTCRFWNTTAPTGQTTMPRRAHSSSRNTRHPVRTPLRKFPVGSSTSSLGDLRKLTLGSILVQSMLSSSGVCSTISWNIVMDDDVMIVRQVAGAGGGPEVVAGGQAHSRDVNAVLPLVLVLQVGHHRQTAPGS

SEQ ID NO: 1016291 - protein, 202 aa, Homo sapiens
GWIWRWRLGPAVPGKAHEASRHWTHEPTLNLLILLLLKKSVTAEITDGNSEHLKREHSLINPYQGGGASSKPRRDFQGITSRKIQDGRRTPDERTKRALVWNHQPGGRKDSCKGTATAKATAQGRRTAKETASPCGTPGTASGQGLCLEAKITSTAVTIILDTYPNDETTERVGPYIAEKVNKGARADDHSKDGRGTERAGG

SEQ ID NO: 1016292 - protein, 179 aa, Homo sapiens
VCGACSPDALCGLCMFFVACGSSWVRFSQVVCLLVCVSLYYSWGLIPALRFPPCAILCDSLLPGGPHPFKLGLSRAAFVCGHYVPELFPLLGDPSPSGGTFALAQFRSRRRMSFIAPKTTVDDPQGDFSPTALCGVPGVPAPVFVRSPLGNHCCCPPGWGPLGFPRNPLMCREPSRFFT

SEQ ID NO: 1016293 - protein, 44 aa, Homo sapiens
GTSASTEWRLRRGLYLGPGANDELFFNRDYKRQQIPILVLPNIN

SEQ ID NO: 1016294 - protein, 62 aa, Homo sapiens
MGCGPCQAAVDAGLVPRHSGVGSWDAGEVLLFGWCVARVATGEAVNWEPRAVLCTLAASWQS

SEQ ID NO: 1016295 - protein, 87 aa, Homo sapiens
PHENCSHLMVEHTPQRGEHRLDPRSSPVNLPSSRPKDNVDPHGEPSRRGLTGWRVFLLLLLSLGIVVCAVVGAVVFQKRQERDKRFY

SEQ ID NO: 1016296 - protein, 44 aa, Homo sapiens
EEEEEEEEESEGEEEDDITSAESESSEEGEQGDPQNATRQQQLE

SEQ ID NO: 1016297 - protein, 254 aa, Homo sapiens
MRPSVEWLPHQGRKGGRGGSLLVALLGDICGVWDRIITPTGGAHTTHSLFVGPPSRKICCCRCLVVLFLLLSRTNNPVGRTAVWCAPFLYRVGRPICSGPSPPLLLLCGPPSPWLLVPLLARLLFWWAPQLSPRGVPPLGVLPAPPFIGSSPPLCPAPRGRERRALSWSTAPLRRSSGGLWERALLLMGASPRVVGRPPPRLMCASEEGASSRRRGSFFTRELLSSACYLFTRPHTVAPHHTPVREFGAPPPLG

SEQ ID NO: 1016298 - protein, 70 aa, Homo sapiens
PEFRKHNIGRMLLGRSREVLEQWSRDHPDEAVMGVAGVIQNPALVAKRPPTSPVGAFTLVGYTQEGEQIR

SEQ ID NO: 1016299 - protein, 35 aa, Homo sapiens
MMSVGTANVDVPCEGGQSETTGYLPLWTRAQERSV

SEQ ID NO: 1016300 - protein, 73 aa, Homo sapiens
WNATLDRLELAEETATRPADLLMAGVRRVAVRDSAGHCHVACTPAFDLYKALDAYTPEHAATTGVDAADIVEA

SEQ ID NO: 1016301 - protein, 117 aa, Homo sapiens
KHRLVLQVADFRGVRHQQQRDIEAIVDQHLLDGFAFAFDDAHAQVADRREMADISDGIRYAEMVSVIPIRTCPEICSGSSCAAETVRIDGHRRVLHMTQESFAGRQTDAFSDDAEAA

SEQ ID NO: 1016302 - protein, 40 aa, Homo sapiens
FTCPFVEKFSIDIETFYKTDTGENDDVFSLSPGEKNQLIT

SEQ ID NO: 1016303 - protein, 57 aa, Homo sapiens
DLCNEEVFPKDITKWNSNDLMDKMENPEPEDPQDGIYHQSSPEFRVASSVEQLNIIE

SEQ ID NO: 1016304 - protein, 120 aa, Homo sapiens
MAVTGSLAVPNCSSGHLPTLLPMSRGSAQVPVDQKPGPRIWSLQLSRQGALLSCRVLRALEGADKMAKRRVVMASLYLGTGPLEQELVDCLESSLEKSLQSKFPSDLKVSILLDFTRGSR

SEQ ID NO: 1016305 - protein, 33 aa, Homo sapiens
DQAQHARRTLLDELVTLDLLLPPGVRGPCSKVY

SEQ ID NO: 1016306 - protein, 76 aa, Homo sapiens
WRLYLLKSTSLNYTKEYYDRHLRQKVTMAERVGIGLDLDPQLAAGYELLQGAMTALEEHDVDQLMDLLVHQMGRAS

SEQ ID NO: 1016307 - protein, 50 aa, Homo sapiens
MSAGRTITSWAGVKHSRDYDSSENYPGYVHIHDYTGLVIGTIAGISKQVS

SEQ ID NO: 1016308 - protein, 41 aa, Homo sapiens
RRYRMWVSVEFNSSCLGIYLMRKLISPIGGFTEAWLVSRSQ

SEQ ID NO: 1016309 - protein, 34 aa, Homo sapiens
MSYELLAVDIIITIHTQLYVCIALYELFGSPGFI

SEQ ID NO: 1016310 - protein, 54 aa, Homo sapiens
QGAVARSGLVVPLPQRTHVAVIIDASRRGTRFNSYANQYHDTRRHPGETITNLP

SEQ ID NO: 1016311 - protein, 37 aa, Homo sapiens
TQTNSEPAKVYYSVTNLQAILDWANEHDTYVILDEIY

SEQ ID NO: 1016312 - protein, 49 aa, Homo sapiens
AEATYSPDPSVCRRMHVYVAGPSPSRVVKTNVIPESSLQDVISVVFRLL

SEQ ID NO: 1016313 - protein, 53 aa, Homo sapiens
GSFAFQDLSHPGPQGLQQTQVALQEEESTTFLIATVKNRRVSSDPIFIGKDIH

SEQ ID NO: 1016314 - protein, 48 aa, Homo sapiens
TRGPYRVERRYYLVRVLEYFVTDIGTNYDDGRVTRGAWLTVLDVSWLS

SEQ ID NO: 1016315 - protein, 36 aa, Homo sapiens
MLKAQSIRNSQSSPKPAVYAEVSLQLVPRASVNSAT

SEQ ID NO: 1016316 - protein, 53 aa, Homo sapiens
VTTLEHKEVKWTYPGEKRSKKCSKTNLRPRGEIKGKMMGSDDPEKKKPGEQRR

SEQ ID NO: 1016317 - protein, 52 aa, Homo sapiens
YPAAGEECTHSSKQQEEQDNLGSMTEERCVIDAGFKKQGCQRCDAEEWKERM

SEQ ID NO: 1016318 - protein, 50 aa, Homo sapiens
HKMLSLCGPLIAPAPLTPPPTESLLLLFIANRLVSRDLSAHAASRRSAYV

SEQ ID NO: 1016319 - protein, 48 aa, Homo sapiens
MRPPRVPITSPALSVKLTAPAYHLSQDTFVTALDPNYRTNKLKSKIPA

SEQ ID NO: 1016320 - protein, 71 aa, Homo sapiens
DPAVSVPHFRFRYITFLFPFINLFHDMAVLESLNLLWLGRLPNLQIILCSINPLNGMVAHGWYSDARCERP

SEQ ID NO: 1016321 - protein, 57 aa, Homo sapiens
TESRLLQRDVQIILESCHNQNILGTILHPNGNITESPSGRKGFARCVDSVALQINTP

SEQ ID NO: 1016322 - protein, 59 aa, Homo sapiens
THKAARVLGLDEGKEVLDIAKSAVGRYYYRPRRSAKTLTTNYRVLLVNIERGQKQCEVL

SEQ ID NO: 1016323 - protein, 81 aa, Homo sapiens
QAKAVLSAEQLRNEEVHAGLGSLLRSTQQLHGAQRDLEAGQPTVRTQLSEFADDFVRRHSQPLPTCEPLSQYTLFPAHRAQ

SEQ ID NO: 1016324 - protein, 64 aa, Homo sapiens
AAGCSQDAGTPGLVQRPLPTSIGRSCSGVPVENLSSVALRLRHWLSPPTPGTQRSCFHALLRPG

SEQ ID NO: 1016325 - protein, 124 aa, Homo sapiens
MCLLPLFHGGPLTTILGGTTCITHDAFWTPKCGEIVKLCGEYTHTLCAIRNIYERLSEALCIGAIVCALKGDTLCLAEHAFCTHKGRLSQNCSLHSHVTSSRRSHEVRTLRVFVASLLARPLLL

SEQ ID NO: 1016326 - protein, 342 aa, Homo sapiens
GQQSGGARVPPWTDLTRGPPVPECCSNVYRRCTAPMLNLRQPSSHANNGPASTTSCLTLEHRTIGALYLVALLPKNLADWQDVMLACWWTLDQCPGRDGRPHLGRRMYHMDAARYNVTPAGIAASDCTVMALADTRITTHRIPGSTSTGMKIAYESQAQASETKTDRSIQAQTVITEDGCTAQGGYHESTAPIHRHDPITHKRTLRRASRTHESNTHPCDDADKHIKRQVPHIKREITPTILGYSTNKTIDCDTTQEDKKTTRHQTESAQKIHTHEYINRPYQSSHMKPKAPEQRSQFTQKSARADTGPNTGREDKHPNGRQPQGKYHYPCTCWTNSNTKEH

SEQ ID NO: 1016327 - protein, 55 aa, Homo sapiens
RFLSILGWKLATERQASLPLHILEGGKTDGLQFPGRRLMLQEARGAGPLIIVQGL

SEQ ID NO: 1016328 - protein, 69 aa, Homo sapiens
RLVDPLIRKHQEGHVEQQGTHHGQVDDNDDLDGGGAASSYLHSQQQAVGSTSWPGTDGLHHVRQLQSFL

SEQ ID NO: 1016329 - protein, 92 aa, Homo sapiens
MTVGEKHNLPTGEDAHPPNLREEEKTQQQRRQAQEKTQYESSEQKRTGRNKEGQPHSNEVMGNNSTAPHERILTSGTNPNQEHQAKHKQGRE

SEQ ID NO: 1016330 - protein, 264 aa, Homo sapiens
MVYFLFLLRDQMGLTGVTMEENNLGYESPAHFVTQKDLTPLGESVTHLEDDQSGLNDLLNPSSSLDCVKPRDTPLSKVQCQPALEAGNLHDPSSHQGSTKCTNLLSGTQHWTAQAQPDSITKERPDIIQAEDAKPTPDSIKGTQIDIICQNTGKPHNGATEAHILTLEVMTIQGKPKEQRRQKEPNRRPRQEVHPPRRHKSNYHQVVRGGDRATHNVTNEHPTPLLTSTHSPVVDKRPSIRSNDENAHDTYCIRVRPPYLARTN

SEQ ID NO: 1016331 - protein, 40 aa, Homo sapiens
SLKSAGTSHSPELWAIMRLAASMLGMLGTAALDVLQQTQR

SEQ ID NO: 1016332 - protein, 31 aa, Homo sapiens
VQNSHGRMPLFFRKRKASEEARKRLEYQMCL

SEQ ID NO: 1016333 - protein, 48 aa, Homo sapiens
MATIRFLCGEEVDTEEFFLSTEQNEKSPRVYLFATEEVDLDILVRFLR

SEQ ID NO: 1016334 - protein, 82 aa, Homo sapiens
MQKAAFEALQVKKDLAHRQIRNQIRLIETELLQLTQLELKRKSLDTEALQEMVSEQRWALSNLLQQLLKEKKQREEELHDIL

SEQ ID NO: 1016335 - protein, 77 aa, Homo sapiens
NEEETENLRQREIAAAMQQMLTESCKSRLIQMAYESQRQSLVQQACSSMAEMDQRFQQILSWQQMDQSKAISHILQE

SEQ ID NO: 1016336 - protein, 77 aa, Homo sapiens
DFVNHHKQYQQPRLEMLNTYYTGQNVSILTPDNRRTGDGSDVRLTHPFGREIADFQAGFSVGQPISIDVDDSGARQS

SEQ ID NO: 1016337 - protein, 81 aa, Homo sapiens
SEECGKDFRQSSSLYMHQRVHTGEKPYICCECGKGFRQSSSLCIHQRVHTGEKPYRCCGCGKAFRQSSSLCIHQRVHTGEK

SEQ ID NO: 1016338 - protein, 32 aa, Homo sapiens
MPFEGCDRRFANSSDRKHMHVHTSKPYLCKMC

SEQ ID NO: 1016339 - protein, 109 aa, Homo sapiens
IRMAIEMESDWKKNGIIIEWRIESQNEIEWNHHRMESNGIIMNGIEWNHRVDTNGIIIEWNRIESLNGLEWKQHRMESNLVIDVALSGIIIEWNLRKSSNGLEWNHRMD

SEQ ID NO: 1016340 - protein, 53 aa, Homo sapiens
LHNMILVDQMDPTFLALPSLLDVRFWTSDYPPGFAADGPNLRLLPSLMVVGRF

SEQ ID NO: 1016341 - protein, 105 aa, Homo sapiens
NLWIVVGTYGASSGSPWDKLAATFLLSEVHKSPGLSQSRAEDGQRTKRAERWWDDQLQRGVLSADSWRQWDGWLQRRATFSTESCRDNLPAERSHPFQGLLSTEN

SEQ ID NO: 1016342 - protein, 73 aa, Homo sapiens
GFPALDGEPQASLNLAPGGQDLPRQFGKRPRKGFLHWGNLNPPSWGPDTHSPFAPLTTQSPQYFQACTKVPVL

SEQ ID NO: 1016343 - protein, 49 aa, Homo sapiens
MGKDYQTLGLARGASDEEIKRAYRRQSATTRTRTRSPCAEEKFKIAEAY

SEQ ID NO: 1016344 - protein, 46 aa, Homo sapiens
LSASTTEHKDKIHNSKSTSNGAMPKPSPLPKAGRGLVGAGAALTTS

SEQ ID NO: 1016345 - protein, 63 aa, Homo sapiens
MINIGKIIGLRAEARYKIRDEVINNGLTNISFSGVTLFITRRIVPNIIRRPSLIKSPDSRMKT

SEQ ID NO: 1016346 - protein, 122 aa, Homo sapiens
QEPPRHRKKAKIVRKQQVEFEGPRAQNEAAHSSERKVPSGAKSSVYTPGAISLPKPCPLALGLPCRPPAVFMASSSPPRPRVSCSCLCLIAAPGLTFYGFVFYWFVFIFSGILNKSIAVRYP

SEQ ID NO: 1016347 - protein, 99 aa, Homo sapiens
KVTKNLAGGLRLTTLTAFLVSPSDQKRELVVEPVGPVGFKPETQKVFTLYICMVLRERRNPLNPETSSCLSSTEEGLGHVEPQCPFGLNLSLTIKSTLR

SEQ ID NO: 1016348 - protein, 69 aa, Homo sapiens
KEKGFSKKGKQRLGEGKGGPLSLINLPGTSLLIIVPSEPRSLLNWGQEIPREPFRKKSGKMEKVERGSP

SEQ ID NO: 1016349 - protein, 96 aa, Homo sapiens
KPMDPTSFSPRNLRGFTRDISKFQPIWIGYGPGCPKVCNKPFAYNLTRGPHALDLCQKYLLVFQGLLTDEVYVQKRVRYKFKEEKKLIAKRKSVSI

SEQ ID NO: 1016350 - protein, 82 aa, Homo sapiens
GGTTNCGDLYLSTSARPLPLNVTGPFEIPGNQDPSLLGPGSGLMSQGLPFLGAPSCNECPAGGATILPLVIRGFLRVWDFYN

SEQ ID NO: 1016351 - protein, 56 aa, Homo sapiens
PVQPAAPARDKASQNGSSLTLEDINAILVPTARVPLHPRLPAQSPRLLNKDLPLLP

SEQ ID NO: 1016352 - protein, 45 aa, Homo sapiens
MAGWLLSNSLSSDHAEVWAGWHWLASWEVEAGVVRKLGGSHCGAA

SEQ ID NO: 1016353 - protein, 119 aa, Homo sapiens
MNTMRTNHPPSSPVAYPGTSEITVHFLGQTSRSINSLSIEQRREIDNCLWLIASDMREAVGHRSARDEGRGMAVPPFAQLVVVNILIKHRIDLCGQFGVDDGVQTAIDRHVAAGTTRCR

SEQ ID NO: 1016354 - protein, 78 aa, Homo sapiens
KKLASAGERPLRITFFVKDVQGLDDLAERCQLKLAVVVNGEKVDVRSSHVMDIQEVGGIAYFLWIGSQRRKGDSQRGG

SEQ ID NO: 1016355 - protein, 84 aa, Homo sapiens
TLTVKLPLREAAMMPSSEKGASRKAALGGKGAPTPTCIGLRQGPELLLLLLLRVTMNPMDTESGLVVAHACGPSTLGGQGGRIA

SEQ ID NO: 1016356 - protein, 184 aa, Homo sapiens
MSSTIGNRPRPTKKRPQRATSNVFAMFDQSQIQEFKRGLHTWIDQNRDGFIDKEDFDDMLASLGKNPTDAYTLSAMSEEAPGPINFTMFTDHDLDEKLEMAQIREDVSQKRPLLALMKKQTRQPSYEDLNLREAADNPWGIGGTDRGTWMTLYQREHRELTKRGISTDMEVTRILKHGAKDKDD

SEQ ID NO: 1016357 - protein, 64 aa, Homo sapiens
RIRHEVTRAILCLDLAGRDLTDLMKILTRGYSFTTTEGEIVRDIKEKCYVALVFEQEMDTGVSS

SEQ ID NO: 1016358 - protein, 46 aa, Homo sapiens
AGFGTRFGKANTKMKNKLVGTPNPSTPLSNTVPQFIREPYELTPAL

SEQ ID NO: 1016359 - protein, 70 aa, Homo sapiens
AAEEEAEAAARAPKPEEEDAFTAPHWRRKQLEGPYGDKLAKTKGSNNNEGRARRQSLQATGKEGKRHAFI

SEQ ID NO: 1016360 - protein, 133 aa, Homo sapiens
EESFRVQCIQRTDDNFPGCLHLQVRPFSHSMAATAPSITSPCNCSQSKTETLSLRVCGTSYVDGREQTPLVAMALGDEEGTYVLQRSSFCPCWLSLASGGTGYRKMAEYMPFLTNHCPLGGHIYRCADGSGRG

SEQ ID NO: 1016361 - protein, 78 aa, Homo sapiens
WWWSVVGEVVVEAELVVQARQEAGEQEGARIITKGVNLNSISSMEVISITILDFDREDIPLVESTEPYILLELKYQKL

SEQ ID NO: 1016362 - protein, 106 aa, Homo sapiens
MSVRDSFQDPEIRSSRGRSGSSELLIYEMAENGKNCDQRRVAMNKEHHNGNFTDPSSVDEKKRRERERKAEYCPVETAVHYLAVFFSGNPCNLGIGPQNFVIVKAL

SEQ ID NO: 1016363 - protein, 59 aa, Homo sapiens
LVRQRISRLGQRMSGFQINLNPVKEPLGFIKVLEWIASIAYSTCGGFKGQTIQVNCPPA

SEQ ID NO: 1016364 - protein, 49 aa, Homo sapiens
GKQACILMIKALELDPNLYRIGQSKIFCRTCVLHLEEERGLQITGYGHT

SEQ ID NO: 1016365 - protein, 107 aa, Homo sapiens
MQPGIVHVVPPPRGDFCGGTERAIDQASFTTSMEWDTQVVKGSSPLGPAAWGLRSQPPPRSCRLGCSLRGALCSAHSVTHFGRIGAPRTGTFRGSLQGPWSFSQSYK

SEQ ID NO: 1016366 - protein, 77 aa, Homo sapiens
RRSCEKGWGRSWEFSAVAGVRGQRPSGPSLAERVPGASLSQRGAKVARRRLLIDLVLLKNPKLNSRCGAYDYYSRPL

SEQ ID NO: 1016367 - protein, 36 aa, Homo sapiens
MYALSLLASLLAAALAGPVLGLDCPRGSAVWCQVTT

SEQ ID NO: 1016368 - protein, 57 aa, Homo sapiens
SDFRKEFYEVVQSQRVLLFVASVDALCACKTLQAFQCDHVQYTMVPVSGWQDLETAF

SEQ ID NO: 1016369 - protein, 38 aa, Homo sapiens
MSGLHPFEFGKRKWPEPSRLLISPPVGKAPQKKLDTIR

SEQ ID NO: 1016370 - protein, 50 aa, Homo sapiens
DLGTFTGYYSPGPGLALPADGGVVTCEVDAQPLELGRPLWRQAEADDKID

SEQ ID NO: 1016371 - protein, 30 aa, Homo sapiens
SLTMTAEQKDSELNELRKTIELLRKQNAAA

SEQ ID NO: 1016372 - protein, 33 aa, Homo sapiens
FECRLFISQDSRDASEVSSDDNIHPALYDGRRA

SEQ ID NO: 1016373 - protein, 32 aa, Homo sapiens
WFLENLRHVRPDKQAGAGGMGCVRGPVCTQLL

SEQ ID NO: 1016374 - protein, 41 aa, Homo sapiens
IFPFSPEGNPDKQFSQEEAERTGLGKGPPGPGSSSLSLSLS

SEQ ID NO: 1016375 - protein, 47 aa, Homo sapiens
TRRGRHPLTEAPTKKQRSNDPNRTTQPYTKNYEGLRTTQRCNIPKGK

SEQ ID NO: 1016376 - protein, 39 aa, Homo sapiens
RNVVVDTRYNSHKYHQVFGKVGMKITIPKRQQSSDPMSN

SEQ ID NO: 1016377 - protein, 42 aa, Homo sapiens
VTHLLKTYYLTFLKLKTQKIKASFIELLVTSGRATTRLSTLR

SEQ ID NO: 1016378 - protein, 53 aa, Homo sapiens
EKTHINIVVIGTRRVAGKVHKVRPTLIYIMWAAFDRKKDLIFLMKKDDSDWLK

SEQ ID NO: 1016379 - protein, 38 aa, Homo sapiens
WTTHQVYDLAMDYTLRSRAPHGKIVLHNVCDTRRYVVL

SEQ ID NO: 1016380 - protein, 35 aa, Homo sapiens
VRPGLPPAKCNLNCLEYFWSFGGYQTCVFCVAKSF

SEQ ID NO: 1016381 - protein, 31 aa, Homo sapiens
WSGGMGEEVMLGHPNDIQCSRRMAAEVLALF

SEQ ID NO: 1016382 - protein, 45 aa, Homo sapiens
QTVKKGSDLQKKLFTLLIEWTPFIKDIMEDAIPITRLDSKEWPYC

SEQ ID NO: 1016383 - protein, 38 aa, Homo sapiens
KRGEAPFAQRIDPTREKLTPAPTPEICKRESNTAQEQH

SEQ ID NO: 1016384 - protein, 64 aa, Homo sapiens
SLYTYSEGSSSSFCRSRSYWPGTTIDWEQRRSGFSNLRDHGRERWSLGWLFGEHMSFEEHIICQ

SEQ ID NO: 1016385 - protein, 42 aa, Homo sapiens
VFLGVVIYLCMSLSVWCRCFTVIVRRRSFVSLQTYISLYNQP

SEQ ID NO: 1016386 - protein, 58 aa, Homo sapiens
FLSAASLNLNIRLEINILDYTVKSQKVVDPSTLKVSEVLENESTDGKHSAESSSVTSE

SEQ ID NO: 1016387 - protein, 62 aa, Homo sapiens
FLHGLEVQYFRYVREFQGSDALPCQTDLCKDDHGMVTPIGHRGTNGSRRGASNTDGGMRHRQ

SEQ ID NO: 1016388 - protein, 35 aa, Homo sapiens
MSESSWDCDSFRLMLFVVSDADASWVVPDSSGQCF

SEQ ID NO: 1016389 - protein, 69 aa, Homo sapiens
ELHPFPLFRVYDDTKLVRSSRPLSWSGTRGSYGPFVLEEEEDLDQIDLYPPPNRRTRVLVLTELRRQES

SEQ ID NO: 1016390 - protein, 66 aa, Homo sapiens
RTRTFTYPTLRSLSSSTSEDNHFVAEDLGHFLLVPPYFVVDQSTHLREVKTGDLSVVNRVVGYLYD

SEQ ID NO: 1016391 - protein, 60 aa, Homo sapiens
SDDYRAYSLEAKMERYDDRTDGSIMGRGGTPDNGILSIHRIPKSCLQPEVEARIERAPGL

SEQ ID NO: 1016392 - protein, 30 aa, Homo sapiens
STKQIEKSTAETSSGMDSDVCDSKSKEVYS

SEQ ID NO: 1016393 - protein, 44 aa, Homo sapiens
FEIDKGSTQTEDLICGPVKVAGAPGALMTAPEYYEVSEVGGDTN

SEQ ID NO: 1016394 - protein, 51 aa, Homo sapiens
MISGRILWICILLRCSRILRFLLVLLVFGGPSRVSGGGDSVTAILAGSYDL

SEQ ID NO: 1016395 - protein, 60 aa, Homo sapiens
PHYRVSFKRRGSVPREPKDGAFACSSVAPFHFSKGFLLGRFGQVECPEGPYVPTVLSVAR

SEQ ID NO: 1016396 - protein, 35 aa, Homo sapiens
FKTLVYPFFKLRGVFLLGGPLEKGIYFSEEGGQSS

SEQ ID NO: 1016397 - protein, 81 aa, Homo sapiens
MSKMETIHEDYLSEQPFNQNFKHRHGAESKQQGPVKRPEKEILMEPASRVDHCASLNRPSVRDEKNGDKKGGSLPTITRLS

SEQ ID NO: 1016398 - protein, 208 aa, Homo sapiens
PQLVADSTTKRRCTRGVNPGWNDGTREPFVVRHILKGATRPSWERPSGEGRAQPRALARDFHKAAECPVTRAPSTGTVKARGINSTQIRRIPGRLIQGKMHGPLKGYKELAPRKILKEPEENQAGRGRKPGPVPDKTDRRAAAPRISRNGPHQALPSNPRGTGELLPPATGLLVSRCRSNLGIHPCLGDESTIDEGVLRKILAGVQKM

SEQ ID NO: 1016399 - protein, 101 aa, Homo sapiens
GELTQRSNAGCRGCQCVVQVRSGHLVATGTQRWYDLGVAEWSAAGWANRVEQPVEARREGARIDRVLAPTMLLAMVIANPECLDGVWATGRRNNGSRLGHV

SEQ ID NO: 1016400 - protein, 49 aa, Homo sapiens
HIHKNKLIRLIAAMALAGLRKLIAIGRHEAHDETWYVGWLKIRIQSNPV

SEQ ID NO: 1016401 - protein, 49 aa, Homo sapiens
PNLVPPKIPDGERENFDDIHRKRMEKDLNELQALMQAHLQNRRTEEEDL

SEQ ID NO: 1016402 - protein, 83 aa, Homo sapiens
KLGTRVMTSLECHEAAAHDPATVMTSLGVATWSLPTSRALSSPAWSATVAAAVTDSILGGGGCIQGFVNRLDHVSLAPVTGGG

SEQ ID NO: 1016403 - protein, 49 aa, Homo sapiens
CDPFEIGEYKGIKLKTPHSDFAKSFCKIRSSAINKDDYLSRFRTNNTSV

SEQ ID NO: 1016404 - protein, 52 aa, Homo sapiens
RRSHVQSDPKPGRRCKIWSPAVRDSATIPFSAISTIRSVKQSCSKLQLQSSW

SEQ ID NO: 1016405 - protein, 38 aa, Homo sapiens
MNWAFPLPSAMIVHFLRPYPEAEQMPGTMLPIQTSQNR

SEQ ID NO: 1016406 - protein, 50 aa, Homo sapiens
RSLKADITLNCVYSMDEEGKINAEYLRLISRKRAAEQMTLNPWPALLTAS

SEQ ID NO: 1016407 - protein, 102 aa, Homo sapiens
AWHEAGAGPDRLPQLLQPRLLGACGADLLLAKDRAAESPPHSSSHLWMPPEVEAEQRLRAGLLPSHLPEVVGALRCAFIALVFVTVFLVLQLRSRFSFRGVK

SEQ ID NO: 1016408 - protein, 139 aa, Homo sapiens
MGMIVDTAMVKRYQEVAEIFYGRLSVNLRIREATIRFMDIVGALVGLTFFAVPMLIIGMFVKKDGGEVFFKQNRIGLNGKHFVMWKIRSMVVDAEEIRQELIAQSDVEGMFKMKDDPRITPIGKFIRNIQLMNPQFWTS

SEQ ID NO: 1016409 - protein, 57 aa, Homo sapiens
SANIEVIKPIAKKNGKKVRSGFDPDAENKQHKAKIKRIGVNAEMLLAYNSDTTKTAM

SEQ ID NO: 1016410 - protein, 33 aa, Homo sapiens
MVHLNPEEKSAVTALWARVKRWMKVGGEDPGQA

SEQ ID NO: 1016411 - protein, 51 aa, Homo sapiens
GVGVVFQAGPCLRLTANFPAPSRKQANGYNVVPKLHVMDFPPNLPKLQVLN

SEQ ID NO: 1016412 - protein, 49 aa, Homo sapiens
SRLSPRDEYKPLDLSYSTLSYTETEATNSLITSPGEYSDASMSPELQCL

SEQ ID NO: 1016413 - protein, 87 aa, Homo sapiens
SAGRVLYAGDAVPGLVRLSVLPTVAEVTARSGSTSSGSLALVYRKVFHVQCPFSRQLSQPRTSMLVCLEVVTMMSSGEKSLTSTANS

SEQ ID NO: 1016414 - protein, 51 aa, Homo sapiens
LGATENGLNSRESPGWQAARQQFSSQSPGLVIDMVQHVTLLGAYHHGASWL

SEQ ID NO: 1016415 - protein, 55 aa, Homo sapiens
TLEKLLPHIRGNEPFVFTKEDLTEIRDMLLGQEGGHLLPSLVAIAPSLKSLCQRQ

SEQ ID NO: 1016416 - protein, 56 aa, Homo sapiens
EFSGIYKRLRPILMTPFPKTLSKTNDRKGGFEGFYWVDTSNTHSKTTGMTRSSKDQ

SEQ ID NO: 1016417 - protein, 50 aa, Homo sapiens
YGGHAEVTSQTRRRMNVAHQEEPRINDNTALEDCYVSAVQGDDHTGLMAK

SEQ ID NO: 1016418 - protein, 50 aa, Homo sapiens
TTVTKKTYEILAFDGMTTSCCGIINHGYARVRRQSRIDPPYASSIELSRV

SEQ ID NO: 1016419 - protein, 51 aa, Homo sapiens
TPSPTPGTQLELEAGIGALGEGQHLLHTLHRAPGDYYMSVRPSLFLSPSLL

SEQ ID NO: 1016420 - protein, 53 aa, Homo sapiens
TNRDCDSLKGALRIMGNVFSGLHAVPPHLPPVKVRVLMLLYSCQKKKPQGPQS

SEQ ID NO: 1016421 - protein, 40 aa, Homo sapiens
ICKLRYTRKDKLKVHMRKHTGEKPYLCQKCGAAVGHNYDL

SEQ ID NO: 1016422 - protein, 48 aa, Homo sapiens
WTKGFSNHPRVHLTKRFYECGHCGKGFRQLGFFMRQRIHSHGEVYVVP

SEQ ID NO: 1016423 - protein, 118 aa, Homo sapiens
SLRLECRGMIPAHCNLCLLGSSNSPASASQAAGTTSAHYHTWLIFTFLVKTGSHHVGQAGLELLTSSDLPALASQSAGFTGVSHHAWPNFVQMLQVSIVNLHIASLVGYRISRLEGIF

SEQ ID NO: 1016424 - protein, 58 aa, Homo sapiens
MSLSTIKVLAGRKARETQAMLKDQAAKDKALQSMAAMSSAQIISATAFHSSMALARGP

SEQ ID NO: 1016425 - protein, 304 aa, Homo sapiens
ARSAVAALIRAGSPWLGGPAAAGEFPEEVVMQHVSSSQSSQRHVQWPGACPGAGEEEPACSQPCLLLTVPSPSNKLEELMVQIQSPTQPSPGPGEALENVRAGAPGPGLGLCSSSPKGDFVDASVVVRKISLSGSSGGEFVFEDGEGLTQMAQGAQVQLQHPRYDHKSPRAETLPAPETEGGTHSHTWGPQSPAAAGGAGLQPLASPSHITTANLPPQISSIIQGQLVQQQQVLQGPPLPRPLGFERTPGVLLPGAGGAGGFGMKSHPRPPALPGLPCPRPFQPPTHVCGDTGMKKVPRSRGDS

SEQ ID NO: 1016426 - protein, 97 aa, Homo sapiens
RGLDGIVAVLLPIRKLRYLRTLSRWRPPGFQHLHRQNWEDADFPFCARHVLEKTHIRMTKEKYGRNANLCQAIHSVSLVPGVRMGFKKTEVCQTCSK

SEQ ID NO: 1016427 - protein, 58 aa, Homo sapiens
MGSCSGWSAALQSRLTATSASRFKRFSLLQPPSSYGYTAPALRSLIVLNFIETRFTKT

SEQ ID NO: 1016428 - protein, 147 aa, Homo sapiens
PPSLVVHQWCCYGSSLLSARWRHLTLGLLPRGVFSSSAFARKFVGRPIRQLLFLVAREYPAFSPPGGVFHNREWLYILPQRLLLLARRYLVGGHALMTHGVTPSLVTRVVVVALFAHARRGAPLELPPPPPLVVAPPPPPLIIRGEV

SEQ ID NO: 1016429 - protein, 67 aa, Homo sapiens
FRTPLQLDPQQEQQLFPAPWKRSSLANCRGPLRLVAELNPTGTSPDQLGPPTLQSSDSAYASQSLAA

SEQ ID NO: 1016430 - protein, 41 aa, Homo sapiens
LEKLERRSRLGRRIRTTIDLSTVAEPLRSDLNGATEPYLGG

SEQ ID NO: 1016431 - protein, 84 aa, Homo sapiens
VLVPVLPRFPGARLGATAPHYAARPYPPSAAYGTQGKSVVGRRVARVGRRPTLVLAQTLGRMSGLTAGARASRARSPRTTALEH

SEQ ID NO: 1016432 - protein, 41 aa, Homo sapiens
YPPPPRLPPKPPRPLKFPPPRPSRYSHRNHLTTTTKSIRTM

SEQ ID NO: 1016433 - protein, 40 aa, Homo sapiens
GCWLRCHCRRFQHALKRTDTAQGSTLLSGFSNSLQLSSPI

SEQ ID NO: 1016434 - protein, 31 aa, Homo sapiens
MSFLGRGKERDSTEDKDPHDELFSQLISFCH

SEQ ID NO: 1016435 - protein, 264 aa, Homo sapiens
HLLPVACLPFLMCMDRVLVLGTSLDDSVCVIEITLPNGNAIFAELIFSMRTWPMCFVTEPDWFPISQDFALQRYPRVVNPKAFSDCSDSLRSRTDALTGWLLAPPAYFCLPRNQLCARTRNTTGTHSPGPPSQNHHAHPTPTPGPPPYRYTRLVHPSPAAPASPPTYTTTPLTTTTTPHHTLAPSTSSPSPLPHPHHTTTPTTNIPQTQPHPHTYAPPHPHLPPHTLTHLSTTTPTQLLPITLTPLPISTHPHNHNTPHPTPYQ

SEQ ID NO: 1016436 - protein, 278 aa, Homo sapiens
FSFSSVVSWSGLWLVVGRGGRGGGGRGGGGGRRYNTYFSSMPGTDSSSSLCCGVLAGCCLPALVSPIKIVLADDCRLWSGVTASIHFWFVVSRRASLQFCSSSWSCVHIAVVFSSRVLFFSLLVTLPLGSTRRVICAAALFCKLAYAFLLGAATLLWWPPTTCAGVRRAALLWGQQNGTGRRRRLVFGASRWCLRAPLRTLLWVVVSVVSSVCAPLLGWLLEITGGVCLAHMLLAGGGLPHRWLVVGSRGVMFFFLLLCAATTPRGPPSPVFFGGAHP

SEQ ID NO: 1016437 - protein, 231 aa, Homo sapiens
PPALFFVCASSSWVLVCLLALLLLVVLCLCPIWVRVPLFRGVGSRGLLGGWGFPLLILASHLFTLEFLGVFLVFWFFFPFFLHSDFSLTKGIASGRHTLDACKVTIVVRLYMPHTLPPLRGYPYSRTPEMSVWSASVQLLRPGRATRGWRPRSRGGTSLGVSNVCSSRAGTFFSIQMGVIFIFFCQVIFGLLLTFGVILFCAVYNVRSVRSPDVFLAWGLYTGPAHVKHCQ

SEQ ID NO: 1016438 - protein, 86 aa, Homo sapiens
MESCSIAQAGVQLRDLGSLQAPPPGFMPFSCLSLPSSWDYRRPSPHPDNFFSTDRVSHVSQDGLDLCLVIALGLQWLDTAGHTLLD

SEQ ID NO: 1016439 - protein, 51 aa, Homo sapiens
EWQVAPIAIIYLWVVYRQPGQCIFLPYRAEVGLLAPVRHLAALVELQSWQI

SEQ ID NO: 1016440 - protein, 50 aa, Homo sapiens
CVRTSICCVLCSTWFQDRLSFPRGYCCQEEVALKSVHRCDQHASRSQSQK

SEQ ID NO: 1016441 - protein, 44 aa, Homo sapiens
EFCGSLFVGQSPYHKFIAFKSFGELDHPLLVDLTVEEQRLKVIY

SEQ ID NO: 1016442 - protein, 91 aa, Homo sapiens
KYAFRSIKKKSVLTERLVYIDRMCTRIGKPDTAESERKAQFIIRMYTRSRDYQRLSSSITDKFVSTGLQLAEITANYVAANSVQSSNRAAT

SEQ ID NO: 1016443 - protein, 33 aa, Homo sapiens
GTRDFPACNHLRRYKYYTDSIVNPDGFGGFPCA

SEQ ID NO: 1016444 - protein, 175 aa, Homo sapiens
FLIKIIFKNNIITQNPKPTNNNPLSSPKPNQKPPTPTHYIPQQYTHFLNFTSTPTHNQQTKPPHLPQPQHPPSQTHTNTYPNPPNKPNITHLIKPPQHPNKPPHKFHNHFHPKQNSQLNPFVKHKIPITNTLTHTPNQKSTILTPNTKPPTHTPPTSLTTPTPIQTQHHTSPNRS

SEQ ID NO: 1016445 - protein, 98 aa, Homo sapiens
AQRVKPRLSRIASDECTERVVFDSYFICAPRGNHQHVNLVLHVYASCCRFHICTCNRAPDVSCCVLFVLSSACVFLMSIVIYILQLCVSRESTAQNIV

SEQ ID NO: 1016446 - protein, 77 aa, Homo sapiens
TPSNLSKSRPCLSEPGSVPGQLSEGGPVNHEPGLGLHVIVYERVKTGLAPCYMNLPETQLRLLSEFSSVSVCHHQLM

SEQ ID NO: 1016447 - protein, 68 aa, Homo sapiens
SPGRTQDTRKPEMDSVAFEDVALNFTQEELGFAESFQKNLYRDVTLETFKPGLGRIQWKDQDIEICTT

SEQ ID NO: 1016448 - protein, 61 aa, Homo sapiens
LRFCGLLSVLSSLFANFVYVVTRTLQRIQRMRIVDPHTLPRSLCQGSIGRFFSAPHRILDT

SEQ ID NO: 1016449 - protein, 63 aa, Homo sapiens
IGPPSLPDLVPVRNVFGEKARVIPGEENNFKTFASLRLARSHPRLFGIRAKRPREPPRVVKEK

SEQ ID NO: 1016450 - protein, 64 aa, Homo sapiens
MVHRVCTCSISPSSAHKRLSSPVRLNTIRFCLPVSWVIKSKRFQFLEDSASSSQHPTSLLQLLW

SEQ ID NO: 1016451 - protein, 94 aa, Homo sapiens
LARGTGELEQLLYHLKVYNAKRRPSWARPASRSGGSHARAGSPLGLFLSKPGCKFGGFKCIKCLDTGEFVVLLGLWASPAGLKCHVGKHSVPRT

SEQ ID NO: 1016452 - protein, 98 aa, Homo sapiens
MESGELPHLFQSMSMVIRLSFKNLLATFCFHQHIPDEERVVILRLHVQTSLSRVTMSELLVKTGEYLLSQTDGKCSDSTLTEKTRLEEIKATLVCLSR

SEQ ID NO: 1016453 - protein, 34 aa, Homo sapiens
MGRRVHGGGAYLWGGAHLAITGLPQNKGQTGAVL

SEQ ID NO: 1016454 - protein, 111 aa, Homo sapiens
AKTSSHPHLQLQAPSALSVPHNQYGMLFRSLHNRYIYYTYIRGLTISGTPSLSPGPASYLPRGITSFHVAALLLSVPVVRAFRIVWPMLRPLYIPACYRSHLSLSSLGIRT

SEQ ID NO: 1016455 - protein, 78 aa, Homo sapiens
MWLVLYHQHLVRAGCRGWATILVVALCNATRGGVVYSQVKNTRGGGIWASQSSHATAKLCEGIFSRPRVFEPPSSHPT

SEQ ID NO: 1016456 - protein, 96 aa, Homo sapiens
HKSLPVCGQQRFARPIARRYKGAIPGKFHCQVLLVVFARFRQYPLARFAQQGHFCNLHSRLPCYPLTRHICFYPQCGIRYSSPVRPPLTPSLLKKK

SEQ ID NO: 1016457 - protein, 105 aa, Homo sapiens
RRGHPRCHQREGCKPGGEDRACVTRKQWWWGPNTGDNRVTERAVATESCAPRDGVLRAPKARAQKNPAAPRGWPAKSIWSAAVLPPIGSPPAETFLNRGAPKVCP

SEQ ID NO: 1016458 - protein, 207 aa, Homo sapiens
MTLCGGKRRTLCLHVWSRARWSCVCVWRSCGDSVGVATCAGGHFQSEGLLHSFDFSWSSGGIRELVVIAWRRGGANHQKVQVLCTLIKGSAEDMQQSLYGPGVCFLCKQVRIEVTLPTYVPRKLAPLDLEVPKGPQVVIQCHTCCESEILWDASQQREGDFIPNPRWIRKGKGLFGIDNPGATRSSHILGDQATQLQRILAYGSNKR

SEQ ID NO: 1016459 - protein, 70 aa, Homo sapiens
QLALQVSLEYEKSGSFYHTCAVMHRPRLVVLPATDSRALDLPVVLGEYDVLLKEGPSSDPINSGTLCASL

SEQ ID NO: 1016460 - protein, 46 aa, Homo sapiens
DKRRTSPRHHHPEEQARQSSQGGSLPSEEKGLPQEESEESNSAWPF

SEQ ID NO: 1016461 - protein, 31 aa, Homo sapiens
MNRIRTLVDNAYSCDPRIKKFKEEEKAKKEA

SEQ ID NO: 1016462 - protein, 57 aa, Homo sapiens
MNPFIEIVFANKVPFNQMLGCLRRRLGVHEKGVGLGKRAGCNCSSLLLPLRQRVGEG

SEQ ID NO: 1016463 - protein, 75 aa, Homo sapiens
FANVSFVAKDGKLNDLKSKANRSIRRKLTVMATLNFNATGVMDIAALITNPGYVNTGFIDAEVLKGYIRKARRWM

SEQ ID NO: 1016464 - protein, 39 aa, Homo sapiens
GCSSHIAITLVLPSTAEDPGDRPKSGRNTLSPQSPLKHW

SEQ ID NO: 1016465 - protein, 124 aa, Homo sapiens
KIDDTTVSVMDFTSGLNWQEKTLTLKPTSLKGLLIALPKVAEVAQEEVVEPKIENPQPDEKPLGETLKDLFSRPVLPEMTDVHLPLNLNIEEFKGEQLRVDGRHGHHREHHAAESEQHLTAILK

SEQ ID NO: 1016466 - protein, 68 aa, Homo sapiens
TFFITRGKDTQQHHLRLRMCVITAVVLDEVTCFYIFWGKYITVILETLKSHLKMYDIYKYIYILFIKL

SEQ ID NO: 1016467 - protein, 108 aa, Homo sapiens
MLCCSTFSWWWCRRHGARTVVAAPIDGAVCSLTLSHTPRVCVFCVLRVCVCVTPHTPSLSLVHLSHAASVCVARHTRALYEERAHTRVYRENISLWRHTLFVPARALV

SEQ ID NO: 1016468 - protein, 99 aa, Homo sapiens
PETFAFVRYQRFGGDSESLNLKAERGTVVLRGAGSLPAERPGPRSAVLPRQRQYPALTVRDEKRLSGYGHQPSPPSVSLNLFRPFLAQTQPNSVLIAVS

SEQ ID NO: 1016469 - protein, 71 aa, Homo sapiens
MHGTHLGIAICQRGSQRSQCIQISGNTPQMEGDLLLLQYSEPWDSSGYAPGVDCVAGEDLHHLLSGYTARA

SEQ ID NO: 1016470 - protein, 122 aa, Homo sapiens
EESTPEMGCSKPHLERVTGITLILDSAPRVTEVTIIEKSPGERHLISSRGQETSCVMPGDVKTFHLMTNGFHMTWSVKVGEHITPLGCMGFNSISNLTQVTQPSMFSLPNAPTLADLEGRYT

SEQ ID NO: 1016471 - protein, 124 aa, Homo sapiens
PKFRVITIKTIGRTYMVGSEITPDVNTIGFDRSNKEKDKSARETLVRHLADLADYRGHEKDALTNITNQSFIRFMMCIGMNKGGVLVGVIGARKPHYDIWGKYSQCSQQGWSPRGVMRNIHVRR

SEQ ID NO: 1016472 - protein, 68 aa, Homo sapiens
TLARGKKIGAKPSPLSTSETGHASYSAMLLKPFFLIEMLPYLFSPMYGMLYFIILFYILFYRGGARYL

SEQ ID NO: 1016473 - protein, 83 aa, Homo sapiens
LNGQNLKKKANLAKPFEMESTQPKEFDRAKDVDVKNFAEALTVLYPLILEEDQTLASINPTLKEVPPFGETGGAFGCNSLWMD

SEQ ID NO: 1016474 - protein, 69 aa, Homo sapiens
LKPADPPIVDTVPGNPMCVETLPKDYLTKGSALIRDMRQTFAVVFIKAVDKPPGPAKFTKSAKKAQRAT

SEQ ID NO: 1016475 - protein, 57 aa, Homo sapiens
MDSQLHPNSGGLRPGTPSLHPYRSQPLYLPPGPPPSALLSGVALKGQFLDSTMQATE

SEQ ID NO: 1016476 - protein, 90 aa, Homo sapiens
GSQAHLTVKDEKNHHELDHRERESSANNSVSPSESLRASKHRGSADYSMEAKKRKAEEKDSLSRYDSGDKSDDLVVDVSNDPATSRVSPA

SEQ ID NO: 1016477 - protein, 68 aa, Homo sapiens
MSLLNKPKEMTPEELQKEEEEFNTGPLSVLTQSVKNNTQVLINCRNKKLLGRVKAFDRHCNMVLENVK

SEQ ID NO: 1016478 - protein, 135 aa, Homo sapiens
VLPCRGVWPLADKRPRRGGVCPEEGACAFPGSFARRGKMPGRKIRLACGAFTLWVCARQRPSGVKPLLVEVPRYRITLRAESPTGAAGRAHLCGGHMGTHMCGGVSTGVTHTPTNWITEPKSSTHTHGCAFFVAQ

SEQ ID NO: 1016479 - protein, 90 aa, Homo sapiens
VFLFEFKMVHKAAKTTQNISNTFGPGTANKHTVQWWLKKFCKEESLEDEERDMGHGKLTTTNLRAIIELHEKLQKNSALILRVIRVVQHF

SEQ ID NO: 1016480 - protein, 100 aa, Homo sapiens
LGEENAPVPVAPENGPRRPWFIFPTGLSSNPVAPLVPTPLPPFCSAEVVGTHGLWNWETGTLTHGWTGLPNTGRRGDPWEGWAEGPVATGFLRSPVPHLP

SEQ ID NO: 1016481 - protein, 125 aa, Homo sapiens
GVWGLEHELNQRRWDSDVLPESSGEDLSPPFFRCGASGLLRLHVQSVHPGSPCLPPGDRRVRTLSQLDGKCSVLHGTEQLVRRDEGDAGHVSRDVCETRTTPAGARSPGTAGPDVSRPLLSRVVL

SEQ ID NO: 1016482 - protein, 154 aa, Homo sapiens
RPSPGDRMTRLMESLVARETPQASRNETNEFQCELPKGTPFINLLRWTTVVALAETPVVVSVWETDDVSKEREVLRKCRVGHDSLLLVGQCPHGCLCVYKEPRATTLCLFEVDDCIYCPLTSDLRRVQLSVPLMSTMHTEPPCVYFSVPLWLTQ

SEQ ID NO: 1016483 - protein, 319 aa, Homo sapiens
DLFETRTRELGESPGELCCVRRARAGGGAGHVKGGRDGLFLGIWGPSAHHCFRGHWNLEGVGLGNSVPRAWWPSPPNTLGILESEKKGAVVQSGLPSLWSSTARKLERELVGDLGMRKERDQKAYAWGEESEEEEAEGRGKGGGGGGGGEGAGREEMAAAVLNEKPPESIFGDPKAGNGREGLCDRWVMNPIQGNTLDLVQLEQNEAAFSVAVCRFSNTGEDWYVLVGVAKDLILNPRSVAGGFVYTYKLVNNGEKLEFLHKTPVEEVPAAIAPFQGRVLIGVGKLLRVYDLGKKKLLRKCENKHIANYISGIRLSDIG

SEQ ID NO: 1016484 - protein, 101 aa, Homo sapiens
WFARGTRKGRLGTEELRGLGDFGGVSVKRCNQFRRRGTPFWSLLWLPKTLAHPPTLLEVGASGQMVPLFPLHSSLPLFFGGRNLGISMRPPPGRGSVGPPS

SEQ ID NO: 1016485 - protein, 255 aa, Homo sapiens
MTTTGGNMGQQGVNNRQCYPESITMGASETTSRGQNAYNVGRSLAYAQGRPRHTGRSTRRNTHFGGGTTPDFPPKIPLRKGVCGKHSVATSNSTGSPPSKMSFLFENCARNPKPRVFPRKLRGLFSGPRNALVETPPFPPWGPHKETVCVVFAAADHTTQLRNTGACVKQLATEEVDLGFIFSPAILLVEFNSSFPTQVFSWMVWLPPPRLATRGVCRQRCSPPRGTLITLSPTGSQCVGTCGAPTFPKPTSFAL

SEQ ID NO: 1016486 - protein, 277 aa, Homo sapiens
AAVRVFVPSGVLRGASLLVLWAHNCWFAWVGVLLLVLVVPRLLLFLIVSVFGLWFSFHRGFIPILPLLCGGLFVWGSFAVFPKLWGAPSFLSSVNVPRMGVFVFLLVSLLRSVFFGGGYYLWLSLVLPVARLVVVSHSAWIVPASGDGWLSRGRCSRCGVVCLCAAPPFGCLVSRGDFWGHLPPFGGSHFVSLRVRPPLRGGAPLKVLFCLAHTRICWVKVVTASFARVVVGDTIFLAPLVFSCVWGARGGRPSSSHTRFVLRRSSYDRDLLSSPSL

SEQ ID NO: 1016487 - protein, 64 aa, Homo sapiens
MSLGHIWLSKGLPENFTYEHQARVVHGPWVTRKPRLSTRLHRGSSVPTDTYSTATRADAGGIRG

SEQ ID NO: 1016488 - protein, 139 aa, Homo sapiens
TKGAWQSYPALWPEDIASEITSSRGPAWSVTRCLTPGGTLSRAEVSIISVLQIGPLYGWLHEGSAVSYGVRSGNDLPLEEAVMVQQDEETLWISHLLMRQYLTPRVNYTFNGFGWDDLGTDNLRPVHILDFASPTVLLK

SEQ ID NO: 1016489 - protein, 66 aa, Homo sapiens
TLLILSGGDSNWYSGTEKPGMTNSTGAKACNLSRGGGVVTEGGLRALWKPSDVRELPPLPTPSLTF

SEQ ID NO: 1016490 - protein, 102 aa, Homo sapiens
MPLDEGFWTCHNTRYPHTSYYLMPGSLVKRGNSGCPDYPVTCAGVDLLMELIGSPTGAISSHLLSKLMIILKRIQLIVLPPRPAHVVILLVSLDLFIHTEKK

SEQ ID NO: 1016491 - protein, 101 aa, Homo sapiens
PSPLKLPKISFPRGQATSFFKGGVPLGAEARKFIRYFTFNGELEDYMSDRGQFVISAQEWDPFEETLMNPSLAFVRPRWIYSFNEKQKLLPHHLYGVVPQA

SEQ ID NO: 1016492 - protein, 100 aa, Homo sapiens
TTTLSSSFPGMTTKVPTATLVVDLYVTTCPPRSTPGPPAPARALRGRERPSLLEPCHTQSPTTLNLPSSQFPCRPLEEGRLGSRTFSCTIKVPCSLHKKK

SEQ ID NO: 1016493 - protein, 123 aa, Homo sapiens
RTPSWEGMIKMSLRLWPPGGLNHKPPDGPRKRWEDPETRRTLSDPSAHPPGTHQGAGLQGPAHKLHLGSLGEEGPGGPGVPDSRTLGNRDTGNRGLLLLLAWETLWGQHCTPLLFFITLLEKK

SEQ ID NO: 1016494 - protein, 91 aa, Homo sapiens
MGESSGAGPGHGAVSGRGVAVADVVGAAEPRGQSYYVKVVLYCALCFMVSVASLVCLLRHGGRDGGEHYHRLVSSDGSSTSYGLRFRSAAT

SEQ ID NO: 1016495 - protein, 99 aa, Homo sapiens
MGKVTSPEMSTCTDLNPDNLQGGDDLDPNYVLSWVRTGRSIRGSCLPPHCSRGERRVIEKLVVEALSSLDGDLVARYYALKSITAAEQQQLIVDHFLFR

SEQ ID NO: 1016496 - protein, 40 aa, Homo sapiens
VVVKTLEQLAQQGKIKEKMYGQKILTRGVHTLIKDGGLRQ

SEQ ID NO: 1016497 - protein, 37 aa, Homo sapiens
SSDRGTISYGYMEKKAVLNPHEGLVSLFPPQAHQGQK

SEQ ID NO: 1016498 - protein, 42 aa, Homo sapiens
RNQEYRRNMKVDKEHDQLKHSTTGEGFRPPDDCSHTRLLMVW

SEQ ID NO: 1016499 - protein, 72 aa, Homo sapiens
STGVIDPEVQRYNTPGFSGCCLVYDFNNVAPLKTHFRTPRPMTVEVAEALRVQEELDSICGDMPRLDFRGAT

SEQ ID NO: 1016500 - protein, 151 aa, Homo sapiens
MAPRRFWRMNWMEFSYFIPLLNKGQRHKDWSPAQARHAANSHAAAGGPHRTWPSPGSASFPLPCREGAPIVKRPVHNGDAILLQRRFVIGHFTHTHHSGSPVLLQVLNEGAERGVGGVVGYEEAHVFELISTGAGRFIRAMAPSDGPGSKK

SEQ ID NO: 1016501 - protein, 42 aa, Homo sapiens
ALQEFGTRAGGNTMGAVTLTVIERWEEVPPSLDWYLRQLLFP

SEQ ID NO: 1016502 - protein, 175 aa, Homo sapiens
MSVLPHRMAKEFTPKALLVAMPFSYGHASGGIFFAPPAHTLTLLARAIALTHAANSGRTRKGEAECMRLYAVTPHRINFVARLAWISHTKNDNRDLRCFNTTRCRALLSQHHRGFILLLMTRYRRLYAEHGHGDILCRATINSRSVGSSVLFDCIMCRKQEILPLEEMYWAYVRT

SEQ ID NO: 1016503 - protein, 54 aa, Homo sapiens
VLHPSFPASQPSSLQAQARQQPPQYYLVQAPSLNSEQDSLLLSTYSQQAGALGY

SEQ ID NO: 1016504 - protein, 115 aa, Homo sapiens
MRAARAAPLLQLLLLLGPWLEAAGVAESPLPAVVLAILARNAELLAAPLPGRSVSGWTTPPRPGWPSGVPRIHNVDNTTEMLQELLAAVGDDYAAVVWVPEGEHTVFYPDEEVSQ

SEQ ID NO: 1016505 - protein, 218 aa, Homo sapiens
TTLPEGASQRPPNPAKPGVRQPGTNPGRRAPENIDNRAGAAALVAAQRSPAHATGRDTHARPCMYTPRTRTRSRRRSPPRAISNKLPGCLSSATISRAVCDAHKPPTGTKGTSHTVPSACAWFELLLALSFGGSNTARFVIYGPGTHRGKRSFLGPATQAGLDTLYRHELGGDAPPRPPHATRALFARRNTWNPRVGYDKNRKIEQQGNKEEENKRKK

SEQ ID NO: 1016506 - protein, 33 aa, Homo sapiens
TVLGPDRQTCFDENECEQNNGGCSEICVNLKNS

SEQ ID NO: 1016507 - protein, 79 aa, Homo sapiens
LSRRENVVDSTSDTHCNALPSSHGVTCHLFIPDIQSLLPLRTGFIPFPGLLVRRKTPATRQHITYPQPFISFQHRVYAP

SEQ ID NO: 1016508 - protein, 119 aa, Homo sapiens
DCSYALFVRDNTQPFRFHHAWAGFQVITRPIGKLLELTAAYRDAALQVQVTDQRIEHHHSPTVIETVTAHHATVSNHRRLQLVRRELFGKCSNGLSIDTTPAAVFSTRKTLSSLLQAKE

SEQ ID NO: 1016509 - protein, 97 aa, Homo sapiens
SVEDFVPDDRLDRSFLEDTTPARTLKKVGAKAAQQDKVTVDGEALGRQPRWVAGFPGTMLDLRRPSHCGESHLLSAGRTSPSSKTITYFQSRVMEAS

SEQ ID NO: 1016510 - protein, 74 aa, Homo sapiens
DRRRALYLRATYVKHRCLNANCNKTVSWMLDNTPATPDNRSYLQRTKAFWIMLGLRIGENGPSYLCQGFIVGYV

SEQ ID NO: 1016511 - protein, 113 aa, Homo sapiens
MAYRNPTWIINPPGVFTRADARVAGTSVAVVSYVINSPLALAEATRLRVLAAIEQTGYRPNDIARALASGNTLTYGLVVPDISNPFSTLARALQREDSAHGRVLLLGDRATTG

SEQ ID NO: 1016512 - protein, 36 aa, Homo sapiens
MGSIEVKAFGGTPVLKTSDAIGMKLYTPSPTNRYFS

SEQ ID NO: 1016513 - protein, 97 aa, Homo sapiens
APQSPILISYRRPAKKPATLNPHHRNDMGGIIPVPAVVRVIPTTLGRLRGRPGGFWVGFAACVCLSGGLCRYWYRHATSSYSSVTRLGSTRESGNRK

SEQ ID NO: 1016514 - protein, 91 aa, Homo sapiens
MREQYDASERGNPLRNAPREVRHAASTAAAKRIGGVAQVNAWWEVIDRQQVADQIAALERSSSRQQHGRRHRSRGVELLFVPETAVTKPVI

SEQ ID NO: 1016515 - protein, 68 aa, Homo sapiens
PPKPAWEAKKAKKTENPFCCGQPGFAGLQRLGNPQDLRTFIQGLGFGSSGMGLGWCWCHGLCPEPSCL

SEQ ID NO: 1016516 - protein, 144 aa, Homo sapiens
KCIRAWGPYEPKTAVAANSMEHIQAVKLLPLGGRSSINPSLAASKTESSEKRGSSGKSASNCCWPTCLKSCCLRQGLHRALAWEFLHRLAMSDLTPVVDAITDALLAAAAAAAITPGLGLMYFIHYYALRCGAASCRPSSSVTV

SEQ ID NO: 1016517 - protein, 69 aa, Homo sapiens
GTRISVVSATKGVPAGNSDTEGGRPGRKLGSHTATTQKKPSISITTESLKSLIPDIKPLAGGGCCGSSC

SEQ ID NO: 1016518 - protein, 154 aa, Homo sapiens
ACFSTVSKLSTFEPMAMLTRVYQGRIETFSRWYYLLNTSSVPARCRGDHHDMSLNVATQCEAFDRRVMNLHTRRHQPTLETYAQAQPCEIAIANTLAYTSLALGTRTSCEALRTTQVQPYVYVIGKSYTPRARSLATNPLHSARVRFLSLSRTP

SEQ ID NO: 1016519 - protein, 81 aa, Homo sapiens
NPVVQQKTLTSDVARCWAVELWRARYRNQGQIVVGRSIDVNAQFADQEEMRYRTEVGRYSIHQENCEFTVSANLPKPLGHG

SEQ ID NO: 1016520 - protein, 247 aa, Homo sapiens
PRERCVVPPTQAAPRTRPAEGICAAYTHQRDKWPCPHHPLSYVPSIGDASLPRAWCFSLTIPVAQETLFDRGATRSLAAGVARQRLFCLIKRATSRAHTQGSGRSSPRALPRELKTPSILPSPPHPRWVFIARPTPPAQGPRRRISALNARRGLAPESRRRALTNRYLAYERRRSQPAPRAQIPQHNEEGGNALRETNKFLPDRAVSRATPGHGTQQTQSLWARAVERGTCHRRKARFIKGADFRFR

SEQ ID NO: 1016521 - protein, 137 aa, Homo sapiens
MISHVELLSARDLHALQFSAPLRERFVDLATHLYDAALSPLSTEEISATGPPALYKVLERGLRADTSARELTQEGGKPRHTERISLTTTARVPVHTLVAAHHRESRKVWGLGHTTPRNFPDLEGGFGPGRGPDPPPV

SEQ ID NO: 1016522 - protein, 71 aa, Homo sapiens
TMCFENAAPWFTLCQPTTPTIDATRRRAFALVSQAYTSIIADDFAAFVGLPVEEAVKGNFGLLFTYKENGK

SEQ ID NO: 1016523 - protein, 140 aa, Homo sapiens
MAATMFRATLRGWRTGVQRGCGLRLLSQTQGPPDYPRFVESVDEYQFVERLYRLPGFQIPQSMNIILPQWLAAPRDPPPNLPYFVRRSRMHNIPVYKDITHGNRQMTVIRKVEGDIWALQKDVEDFLSPLLGKTPVTQGQ

SEQ ID NO: 1016524 - protein, 359 aa, Homo sapiens [sequence omitted]

SEQ ID NO: 1016525 - protein, 83 aa, Homo sapiens
SHGDSPAALRFLGCVDIKDLPVSEQQERAFTAGAKQDFSAREFLTFGELLMHPVLESLRNTGSGCIDTLCAFNSGNVERFQTL

SEQ ID NO: 1016526 - protein, 127 aa, Homo sapiens
GGGGSRALRVSEAEGTAGLTRTETMFRAAAPGQLRRAASLLRFQSTLVIAEHANDSLAPITLNTITAAGRLGGEVSCLVAGTKCDKVVQDLCKVAGVQTVLVAQHDAYKGLLPEELTPLILETQKQF

SEQ ID NO: 1016527 - protein, 142 aa, Homo sapiens
SPVSSTPISPIFGPSNWHFMPPVSEVVPTQGADPLLNELLLLPCQPPPLFKKWEDSAHPQRPDNADLAILYAVVDGVPPARWKEFMRFMGLSEHEIERLEMQNRRCLREGSVQHAGSWRRRTPPNEDTLEVVGLVLSKMNLA

SEQ ID NO: 1016528 - protein, 95 aa, Homo sapiens
LYYGCRRSDEDYLYREELARFHKDGALTQLNVAFSREQAHKVYVQHLLKRDKEHLWKLIQKVVAHIYVCGDARNMAKDVQNTFYDIVAEVWAHGA

SEQ ID NO: 1016529 - protein, 45 aa, Homo sapiens
ELQRPEEEKKEWIQIIQATIEKHKQNSETFKACGGALARMRTPPL

SEQ ID NO: 1016530 - protein, 340 aa, Homo sapiens
LSLVFSLLFMFRSVVIYVLCDCILSSPRGVLPVIFSVLCSLVSCPYLPALDSTRALPSCPLMPPGGPGPRYSCDLPLSSAAFSRRLQTPVSLPGSSAPTPLRPSLLRYPEYAMPLDLGPRIPNPWRFTADFMVTHAHLVFLFLTAPQPHGGTVTCPNPGDFRGMRLLRRADFHVGAHVNTFWRTPCPGPPEGLSQKSFLWENKHITWFAPWTAASGLLLPKQEKTYRRLLMPQNALTPKLPHHAGLNPRAFRMLHLDRRTLQNAVRNVLDGELLHRYLYLSTLERSELTQKIGTTPRHNPGRLAGDGPPSPPTSSPVEAVTPSTRNYLPPPFCTKPPGKT

SEQ ID NO: 1016531 - protein, 237 aa, Homo sapiens
MDPARPLGLSILLLFLTEAALGDAAQEPTGNNAEICLLPLDYGPCRALLLRYYYDRYTQSCRQFLYGGCEGNANNFYTWEACDDACWRIEKVPKVCRLQVSVDDQCEGSTEKYFFNLSSMTCEKFFSGGCHRNRIENRFPDEATCMGFCAPKKIPSFCYSPKDEGLCSANVTRYYFNPRYRTCDAFTYTGCGGNDNNFVSREDCKRACAKALKKKKKMPKLRFASRIRKIRKKFKHS

SEQ ID NO: 1016532 - protein, 199 aa, Homo sapiens
MDPARPLGLSILLLFLTEAALGDAAQEPTGNNAEICLLPLDYGPCRALLLRYYYDRYTQSCRQFLYGGCEGNANNFYTSDPSHHPSTIQKLPKLSPQLTLPPHLSPLHTKLFSTSHPISIFPSLSPQPHSLSPFSPLLPPKPSLLFHSPPSPTAPLPLSLAIILIQDTEPVMLSPILAVEGMTITLLAGRIANVHVQKL

SEQ ID NO: 1016533 - protein, 88 aa, Homo sapiens
LSDRCGRTEMPVPVGPYGSPQPSCFDRVKMGFVMGCAVGMAAGALFGTFSCLRIGMRGRELMGGIGKTMMQSGGTFGTFMAIGMGIRC

SEQ ID NO: 1016534 - protein, 197 aa, Homo sapiens
MFHGIPATGIGAPGNKPELYEEVKLYKNAREREKYDNMAELFAGGERQCNALEKAYIKDCVSPSEYYMQHCSRRPGSNTKLPSGRSRSQKSALLTEFCRKFRLDCPLAMERINGGPAHHASRTTRAYPQPAASLDVVSLLITVMDIAAPGGSAAMDEIQPDLRELMEIMHLHEPPRTDFEGRRTVRQWLQTLSGMSA

SEQ ID NO: 1016535 - protein, 248 aa, Homo sapiens
MFHGIPATGIGAPGNKPELYEEVKLYKNAREREKYVQAPRLSHHTSCASGCPGAAPPDPPQTEGWEDAGSVWGTVPEALQDGRERYDNMAELFAGGERQCNALEKAYIKDCVSPSEYYMQHCSRRPGSNTKLPSGRSRSQKSALLTEFCRKFRLDCPLAMERINGGPAHHASRTTRAYPQPAASLDVVSLLITVMDIAAPGGSAAMDEIQPDLRELMEIMHLHEPPRTDFEGRRTVRQWLQTLSGMSA

SEQ ID NO: 1016536 - protein, 221 aa, Homo sapiens
LKMAMRLQQIHYLASSVKVAHFNKDRKKSSSECQAHKPVGQQECNKGSWELENIRDGHCHCPWGVLLLLLSVAAQTLQSSDTKEQLLWGRMAAHSQGTWLSLAQAFSHSGVHSLDGREIDRQALRELTQVVSGTASYSGPKPSTQYGAPGHFAAPGEGGDQWAALLLPTLAAHSQHMASEDIASDEEHTVIHEEEGVTDVIADDGFSTTDTDLKFKEWVTD

SEQ ID NO: 1016537 - protein, 81 aa, Homo sapiens
AQLGFIRGGKASQLGIFISKVIPNSDAHAELQEGDVLAVNDVDFQDIEHSKAVAILKTAREIRMRVRFFPHYHRQKERTVH

SEQ ID NO: 1016538 - protein, 73 aa, Homo sapiens
HRCSFLCACGFPSSPALRVHGHHGVLGAAVLRSIWPLQRQQQHQALQRNPQRLKPLRVLTGIQQQRFLPTKTT

SEQ ID NO: 1016539 - protein, 150 aa, Homo sapiens
FLVSFKDVGRKPPTFGDASVIALELLNSGYEFDEGSIIFNQFKSVISYKTEEKPIFSLNTIATAETMSIYDDIDADVLQNYQEYNLANLIYYSLKESTTSEQSARMTAMDNASKNASDMIDKLTLTFNRTRQAVITKELIEIISGAAALD

SEQ ID NO: 1016540 - protein, 261 aa, Homo sapiens [sequence omitted]

SEQ ID NO: 1016541 - protein, 70 aa, Homo sapiens
ESPSRLLDTSSRRFKSSKLVPLANIYGPGQDPPRPPAGAVDYGSTQSGTGYCVFTMVTPWMACRSTFVPV

SEQ ID NO: 1016542 - protein, 132 aa, Homo sapiens
MWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHWQQPPGALSSIWRVSLKRLSWS

SEQ ID NO: 1016543 - protein, 209 aa, Homo sapiens
MLCSSFCFIEYRLDPHSAVSLRRQVLYHWHLLSDQWHLALSSEVRIALFCYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHWQQPPGALSSIWRVSLKRLSWS

SEQ ID NO: 1016544 - protein, 68 aa, Homo sapiens
RNEHFTRGQMPPLSCILKLVTSGSVAGIRQWPSAVLWRKLPFPKASASIDIGNVASSPWSCPQPMLFQ

SEQ ID NO: 1016545 - protein, 159 aa, Homo sapiens
PRLNGDDREAVEKELGSLTLSSEELAYGKTKIFIRSPKTLFYLEEQRRLRLQQLATLIQKVYRGGCCRTHYQQMRKSQILISAWFRGNKQKKHYGKIRSSVLLIQAFVRGWRARKNYRKYFRSGAALTLANFIYQSCTGFIDHPQLYGLKQATWSWFAV

SEQ ID NO: 1016546 - protein, 66 aa, Homo sapiens
KVTVQEEVGVEDEEAEDSTGKRVAEDDDDDDVDTKKQKTKEDDLAAKGKITLRTVTYSPSTSRLRI

SEQ ID NO: 1016547 - protein, 78 aa, Homo sapiens
SFRAALFVAQFPLSGRVSAPQPPVPLHSRPGSRRHGSPREESVRLRPQVVAVAEKREKLANGGEGMEEATVVIEHCTS

SEQ ID NO: 1016548 - protein, 179 aa, Homo sapiens
MWLDPADSKMSSGNAKIGYPAPNFKATAVMPDGQFKDISLSEYKGKYVVFFFYPLDFTFVCPTEIIAFSDRADEFKKLNCQVIGASVDSHFCHLAWINTPKKQGGLGPMNIPLISDPKRTIAQDYGSLKRLMKVSLSRGLFIIDDKGILRQITINDLPVGRSVDEIIRLVQAFQFTDPW

SEQ ID NO: 1016549 - protein, 266 aa, Homo sapiens
AGGREAPGPWRRAAAAQPSAGHVLSGGGEDLPRRESGDGPSAAGPRPVLGSGRRQRPSAGARGAESERWELLLRRGELLALGGHLKGALEAFAAALRAGPPARPECLGALVDCLVFNYRLRHGLGWSAAPVAGADGGAGGLLRCLGCRGFLSEPGDRALWPQLLPPLPCGGELREPVPALPGPAAAATASATDAEGTARGRRSGAAIAASDFRTSVVLNHLAEKWFPGQRERARAAGSSESYGPGRYREALARLEGWSRTQGLDCT

SEQ ID NO: 1016550 - protein, 117 aa, Homo sapiens
GEGGRRCRPGSVVPCGDNWRQRAGARDLVSGRHGPSVHESLYFNPMMTNGVVHANVFGIKDWVTPYKIAVLVLLNEMSRTGEGRRPASWKRRRLNQLAPAPACRGPDITPVKTLQVN

SEQ ID NO: 1016551 - protein, 187 aa, Homo sapiens
MHVQSGVTKSVSHSLWAGSASASPSRQHFIPFRNKETETGARGTDVDLLELHNRGNLWARADTRNQAPCINSLEVTLKNLFRAKEDGDSRSPRPDERRDKARDEPQRGRELLNGGKQGTGRRTRQSPGGAWQGSEAGNIDAENACANLRDDRAEKRTSGGGHNVERTIAAPNIGYNTPIRKREEGDS

SEQ ID NO: 1016552 - protein, 42 aa, Homo sapiens
QSQLPRPLLAMDTGVINGGLIVTLTIRLLLHGRKVGSIIGRR

SEQ ID NO: 1016553 - protein, 115 aa, Homo sapiens
HEVEQEAPVPNTDGTMNSGHSFSQSRLGLLPWRRRWLGAAQELPQGFHRPWRCGGIPDLPCPSPRGVPTPWGVLGFWKKQPPTRRKLGGHHAEISNDRLASYLGEVSRPGGGHHE

SEQ ID NO: 1016554 - protein, 90 aa, Homo sapiens
SPFWAPSAVFRRGGLRFARRGPVAVPASAFPAGGLLCWGPGQFRWVPGTCLPRRNSSRRQVRVVPLPPTRACAVGNRLSQMNSQMNRGVR

SEQ ID NO: 1016555 - protein, 107 aa, Homo sapiens
MAVALSAGSAFGLRPSAAQRAAATWQLNPSSPQPLLQLPRFLPPLRCALGNWLWASMTFMGRFFRSSSRAPVRTRGDLGGDANRFNIPFLNVFGVGSGYFTQGKDSF

SEQ ID NO: 1016556 - protein, 129 aa, Homo sapiens
QLTCPGLNDSLQVPERLTEYRELLQSFQSKDAQHLIPCWSKLNDQFKLGFPVGYPSHRKTSTYLRVSTVTTHSSDSEVPSRVTEVVVKLFDSDPITVVLPEEVSKDNPKFMDTVAEKALQEYRRKSRAE

SEQ ID NO: 1016557 - protein, 131 aa, Homo sapiens
PCPQKRVCPDLERLDEKGRATRSWTPLVSLDTPRESHSASGHPWLTLMDMKFALLGMKLFENSLRWIQKEANYWMMQWKQTKVTSGLLRGINQRLRVSGRHMKSTYISSPVCYQSGTYVLRNAPTTWLCPA

SEQ ID NO: 1016558 - protein, 181 aa, Homo sapiens
ALFFLVTTIHAELCHPDAENAFKVRLSIRAALGDKAYVWDTDQEYLFRAMVAFSMRKVPNREATEISHVLLCNITQRCPFWFVVTDPSNNYTLPAAEVQSAIRKNRNRINSAFFLDDHTLEFLKIPSTLAPPMEAIWCPSGIIESGVNICIGTGCNGTTGSIWDRQSRKEQQRTTGVEDAE

SEQ ID NO: 1016559 - protein, 220 aa, Homo sapiens
MFATAEDITNLSKCCESASEDCMAKELPEHTVKLCDNSTKNSKFEDCQEKTAMDVFVSTIHTCQQPNIPELPDVELPTNKDVCDPGNTKVMDKNTFELSRRTHLPEVLSKVLEPTLKSLGECCDVEDSTTCFNAKPLLKKELSAVIDKGQELCADYSENTFTEYKKKLAERLKAKLPEATPTELAKLVNKRSDFASNCCSINSPPLYCDSEIDAELKNIL

SEQ ID NO: 1016560 - protein, 96 aa, Homo sapiens
VKNRFQTVHFFRDVLGMQVLRHEEFEEGCKLHANGPYDGKWSKTMVGFGPEDDHFVAELTYNYGIGDLQSFGNDFMGITLASSQAVSNAREAGSGH

SEQ ID NO: 1016561 - protein, 133 aa, Homo sapiens
PDAQFITIGNERFRCPEALSQPSFLGMESCGIHETTFNSIMKCDVDIRKDLYANTVLSGATTMYPGIADRMQKEITALAPSTMKIKIIAPPERKYSVWIGGSILASLSTFQQMWISKQEYDESGPSIVHRKCF

SEQ ID NO: 1016562 - protein, 158 aa, Homo sapiens
EPYGILIYRRDIIMDGGYDLVHVVVNIIIWFLISSNGQVKFSTSFSCLVFTESHGLGPKVSSPILPCSLILGNELLLLHNNNNNNNNNNNNNNIASLEFGTSLAPSTMKIKIIAPPERKYSVWIGGSILASLSTFQQMWISKQEYDESGPSIVHRKCF

SEQ ID NO: 1016563 - protein, 175 aa, Homo sapiens
PGLLAPPAEGSAAVLKAAAPPSSHGVSTGTKYRYFACLMRARFEEHKNEKDMMRATQLLREAEEEFWQNQHPQPYIFPDSPGGNFLRRDMSAYKVPEWCLDYWHPSEKAMYPDYFSKREQWKKLRMESWDREVKQLQEETSPDGIMTEALPPARREGDLPPLWWHIVTRPRERPT

SEQ ID NO: 1016564 - protein, 75 aa, Homo sapiens
GSKYKPAPLHLPSTLDPAEYDVSPETRRAQVERLSIRARLKREYLLQYNDPKRVSHNRGSCLDSLDLCKISKYLS

SEQ ID NO: 1016565 - protein, 114 aa, Homo sapiens
CITAQDHQLTPDSCIISMVWPSSRLMKIPSGFPPDVSIKEHQRCLGAPMTCSGLPCTTSADLLLATVTLFPPPSSQSQLTPPDAPNIIHKRAGPRRERVQGASVTTVLCMMFGC

SEQ ID NO: 1016566 - protein, 110 aa, Homo sapiens
SPEMSCLPNKTYFPNFDLVCPGYRRKEGGDALTKAVAHVDDMPNACPPWATCTRSLGGPGQLQAPKPLPAGDPGRPPPRRVHPWVHASLDKFLASVSTVLPPNTVKLEPR

SEQ ID NO: 1016567 - protein, 150 aa, Homo sapiens
WKTPHFPGDSSGQPAPQMRAAPRRAPAAQPPAAAAPSAVGSPAAAPRQPGLMAKMATTAAGVAVGSASGTHPGSRHHWGLQRRWQCCSPQSPTSLTRSLREPSCRTSSLLDLALLEIKQFLECAQNQSDVKLCEGFNEVLRQCRIANGLM

SEQ ID NO: 1016568 - protein, 317 aa, Homo sapiens
HIVRLPFLGPPTGLAMMHSFLGPRLMIRPSALSLYFWGPLPIPRSLRESLDFKWTRYISAPVATVHCSPVSVCASHTFLGPPFGDPRAPGSPLCLVRVSVLSVCSFLSPPVMSSCVTFRDLWDLCNSPGLKLPFCALFNWGRLFPEPPRFLPQFPPGRAPGPRFDRGFGSGRPFGPFSQVRCALLSAFPAPDFPFTCPGLDAPDTDLIGGTRAAREMGRSPLRVVLLPARPFLRAVAEARFPRGPLGGARGWDPHGKPGQPGFHGLVTRFNHPAGPAEGRLRFPPAIKFPFAFGTSGPRRLANVLFERSVELFKRVF

SEQ ID NO: 1016569 - protein, 104 aa, Homo sapiens
TSLSAYFVVSTIPPSRWGLELSIKFFPVSVSLSSFAWLCLSQGEISHLQALQGVLGSGKFVIRVSGTSYCCPKGKKKSETKNSPGPFRLHSEALERCRRTWKGS

SEQ ID NO: 1016570 - protein, 164 aa, Homo sapiens
SERKFRTGSGAGEKAVTEFADCAKGVRACSRNLVEQPGACTPAEKPYACPECGKAFNQRSNLEPAPAALHSSAKRYAVPTVRKGLQGPLGPGATPARAHRRAALWLLRVRKDLPRLLLAPARAPALGREALQSRLAARPSCATAALANLRTHTGERPYACGDSV

SEQ ID NO: 1016571 - protein, 167 aa, Homo sapiens
WTPVTMRFLILFLALSLGGIDAAPPVQSRIVGGFNCEKNSQPWQVAVYRFTKYQCGGILLNANWVLTAAHCHNDKYQVWLGKNNFLEDEPSAQHRLVSKAIPHPDFNMSLLNEHTPQPEDDYSNDLMLLRLKKPADITDVVKPIDLPTEEPKLGSTCLASGGAALPS

SEQ ID NO: 1016572 - protein, 38 aa, Homo sapiens
MCLWWLILCVTFAWPWFPETWSATVESFYDGAVNMWAK

SEQ ID NO: 1016573 - protein, 332 aa, Homo sapiens
RRDGGGFGLRSGRRQSLGLGLGLGLGLGLGLGLRLRLPWERVPADAEVALTLAPRLPFQVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKGHQYLSLCVSGSGTGYHFPELVKITQATMATYCRLCPVLFGNRRELNEDKLEKLEELTMDGAKAKAILDASRSSMGIGTYLALTLINIRELLQS

SEQ ID NO: 1016574 - protein, 281 aa, Homo sapiens
FGLAAGAMVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKGHQYLSLCVSGSGTGYHFPELVKITQATMATYCRLCPVLFGNRRELNEDKLEKLEELTMDGAKAKAILDASRSSMGIGTYLALTLINIRELLQS

SEQ ID NO: 1016575 - protein, 158 aa, Homo sapiens
MRNHLLLLFKYRGLVRKGKKSKRRKWLEFVIRPATAADCSDILRVIKELAKYGYLEEQVILTEKDLLEEVSGEHPLLPLTVFAEVPKEHDSGAGLRKVTVSSCAMYMAFRVQVDGRGGKLREILYSNEVDDHENEDTAFVGFGHVTIVTYDPWIGKLL

SEQ ID NO: 1016576 - protein, 136 aa, Homo sapiens
MAKFVIRPATAADCSDILRVIKELAKYGYLEEQVILTEKDLLEEVSGEHPLLPLTVFARMCRKSMTGKDTAFVGFGHVTILPMTRDVPVIVICEDFFVMSDDRGAGHRIRNLKNLSQVAMKVSVQHRMNFLDSRMD

SEQ ID NO: 1016577 - protein, 130 aa, Homo sapiens
LLNEHTPQPEDDYSNDLMLSSLKKPADITDVVKPIDLPTEEPKLGSTCLASGWGSITPVKYEYPDELQCVNLKLLPNEDCAKAHIEKVTDDMLCAGDMDGGKDTCAGDSGGPLICDGVLQGITSWALALR

SEQ ID NO: 1016578 - protein, 110 aa, Homo sapiens
LLIPKSSLNDPATEGIILIGEIGGHAEEKCAAFLKEHNSGPKAKPVVSFIAGITAPPGRRMGHAGAIIAGGKGGAKEKISALQSAGVVVSMSHAQLGTTIYKEFEKRKML

SEQ ID NO: 1016579 - protein, 198 aa, Homo sapiens
MEPPRGPPANGAEPSRAVGTVKVYLPNEQRTGGDCPGWRCVSTASLDKALKGAGLLKVTVLLCGLRERLSRRTQETVTAWVLQANSFPWMDDGAALMSMDPMKDVPSDAWQQSLSSGQTLFLQLCAVAVTCHAYKRLSRSHGFPVAQYLWRTRGSTQLLFLTRSATSAGVDMSTQATTSSTRVSEDLSWRLQDQHEAR

SEQ ID NO: 1016580 - protein, 166 aa, Homo sapiens
MEPPRGPPANGAEPSRAVGTVKVYLPNEQRTGGDCPGWRCVSTASLDKALQVRGPACCVVRLPGRPVPAWAAPLAGALLVAVLVPLPFVRPFFLAFCFCLPFLPGFRCPCGFPPCSSPVPVCVRPRPFSVLLSGGSPAPSRPLNELLPQGPSPRTQHCDPEHFPPA

SEQ ID NO: 1016581 - protein, 157 aa, Homo sapiens
VLRVSLQHFRCGVWRRRAEMAPRKGKEKKEEQVISLGPQVAEGENVFGVCHIFASFNDTFVHVTDLSGKETICRVTGGMKVKAERDESSPYAAMLAAQDVAQRCKELGYHRPYTSELRATGGNRTKTPGPGAQSALRALARSGMKIGRIEDVTPIPL

SEQ ID NO: 1016582 - protein, 157 aa, Homo sapiens; identical to SEQ ID NO: 1016581

SEQ ID NO: 1016583 - protein, 157 aa, Homo sapiens; identical to SEQ ID NO: 1016581

SEQ ID NO: 1016584 - protein, 151 aa, Homo sapiens
VLRVSLQHFRCGVWRRRAEMAPRKGKEKKEEQVISLGPQVAEGENVFGVCHIFASFNDTFVHVTDLSGKETICRVTGGMKVKAERDESSPYAAMLAAQDVAQRCKELGYHRPYTSELRATGGNRTKTPGPGAQSALKKPTFCGTLAFGAIN

SEQ ID NO: 1016585 - protein, 99 aa, Homo sapiens
RFTSGAKKPSLGNAFGVPILDGNQPPVCERHWSQSPDLWPPASLWLSGRAGFQEVDAQMLRDICSKYFYDQCPAVAGYGPIEQLPDYNRIRSGMFLLRF

SEQ ID NO: 1016586 - protein, 183 aa, Homo sapiens
MSSTPFDMSIQCIQSVYISKIISSDRDLLAVVFYGTEKDKTFSDIFKTSIYDLTGVCDNPGCTTQNSSSLTKSQRGSRDTTTFPRHGWAHGSDYSLSEVAAGSVANLFSDVQFKDELIRGSLLYTNEDNPHGNDSAKASRARTKAGDLRDNRHLSLTLMHLKKPGGPRPYPVPHITSQTKQRP

SEQ ID NO: 1016587 - protein, 193 aa, Homo sapiens
SEEDKKTPTSIENWFRCMDLNGDGALSMFELENFYEEQCRRLDSMAIKALPFQDCLCKMLDLVKPRTEGKITLQDLKRCKLANVFFDTFFNIEKYIDNEKKEQISLLRDGDSGGPELSDWEKYAAEEYDILVAEETAGEPWEDGFEAELSPVEQKLSALRSPLAQRPFFEAPSPLGAVDLYEYACGDEDLEPL

SEQ ID NO: 1016588 - protein, 120 aa, Homo sapiens
MHRGPSPGSIRGAWRPQPGARCWLSGLELKVGSGDCLVLEVGGLSSLCFPEKRPRACSALLATSSPSPRCRFEAELSPVEQKLSALRSPLAQRPFFEAPSPLGAVDLYEYACGDEDLEPL

SEQ ID NO: 1016589 - protein, 453 aa, Homo sapiens
MAAVVLENGVLSRKLSDFGQETSYIEDNSNQNGAVSLIFSLKEEVGALAKVLRLFEENEINLTHIESRPSRLNKDEYEFFTYLDKRSKPVLGSIIKSLRNDIGATVHELSRDKEKNTVPWFPRTIQELDRFANQILSYGAELDADHPGFKDPVYRARRKQFADIAYNYRHGQPIPRVEYTEEERKTWGTVFRTLKALYKTHACYEHNHIFPLLEKYCGFREDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKEGDSIKAYGAGLLSSFGELQYCLSDKPKLLPLELEKTACQEYTVTEFQPLYYVAESFNDAKEKVRTFAATIPRPFSVRYDPYTQRVEVLDNTQQLKILADSINSEVGILCHALQKIKS

SEQ ID NO: 1016590 - protein, 494 aa, Homo sapiens
ETLSFIYKLPQNPSPSTPGASLSGTQAADKLWVHPACAQLLGTVVVPVSCGRAGDFHSSVGVPPVPEGRRGLEGGWKLRDSSPREVSDSFRDFRARVGTVGGRRGTCEGHCDQSLEGLRGRKNLCAIVVLNAPGCEQEGVQWCRRYTGFSWVTVEPLKRCRYQIRLPEGSHKCVPVGRAVTPILSLQNLFEKRTTHVSPTRLHKTREQCDTEDQGATGMCVSQQAAVQQHGPSIYPPAVLRTCVANHPASIAQRRRAIPTRGTSRNNEQSRQSAINTPVETPRCQASVTFGAPNGGLPPGGGPSVTGGIPQDQRYGHLFSNHGARTQTSEQRLNPQARIHPTHGADPAGANTTGAAPTVYIRHHTAGKHTKFHTPRTIIVSTRWGLTKFPDSTKRAPRCCRHPNDMGYIHTATVNIAVLCVDHTNEVGGHHNDEGAGMWQDENTTRHLPYMIRGRYHTEKETLPWQCVCLMKHNNKAPYVAQLNRETIRQKRSY

SEQ ID NO: 1016591 - protein, 228 aa, Homo sapiens
GAGGFLGQRIVRMLVQEEELQEIIALFRTFGRKQEEELSKLQTKTKVTVLKGDILDAQCLKRACQGMCAVIHTAAAIDPLGAASRQTILDVNLKGTQLLLDACVEANVPTFIYSSSVLVAGPNSYKEIILNAHEEEHHESTWSNPYPYSKKMAEKAVLAANGSILKNGGTLHTCALRLSFIYGEECQVTSTTVKTALKNNSIIKKNATFSMANPVYVGNAAWAHILAC

SEQ ID NO: 1016592 - protein, 142 aa, Homo sapiens
MIVGFLWAGTQLLLDACVEANVPTFIYSSSVLVAGPNSYKEIILNAHEEEHHESTWSNPYPYSKKMAEKAVLAANGSILKNGGTLHTCALRLSFIYGEECQVTSTTVKTALKNNSIIKKNATFSMANPVYVGNAAWAHILAC

SEQ ID NO: 1016593 - protein, 145 aa, Homo sapiens
SFGQAKHQPTAIIAKTFKGRAITGVEDKESWHGISPSPYTWLSRSIQEIYSQIQSIKKILSNPPQEDAPSVDIANIRMPSLPSYKVGDKIATRKAYGQALAIVLAMPVTAIIVLDGHTFYSYLLGDLQKEYPDRFIDCCIVEAVS

SEQ ID NO: 1016594 - protein, 96 aa, Homo sapiens
TSLAADGGHHWTYEGPHGQDHWPTSYPECGGDAQSPINIQTDSVIFDPDLPAVQPHGYDQLGTEPLDLHNNGHTVQLSLPPTLHLGGLPRKYTAAQ

SEQ ID NO: 1016595 - protein, 59 aa, Homo sapiens
GVMLADPAESSSSPKPFAPEEAPQLQLNSQPPQAPPRESPEGSPINEGRTCPSCPNTAK

SEQ ID NO: 1016596 - protein, 101 aa, Homo sapiens
PGSPPRGPQNGGPATCPPALRSIPNTPPQYFKMEGDPLRFGFGGSNREKPYGQAQPKMQMVLENGYDPKILSRKVTPKHFLLSTLSVWPRNTVGTSMILSL

SEQ ID NO: 1016597 - protein, 113 aa, Homo sapiens
AGIKTELTQIKSNIDALLSRLEQIAADKANPDGKKKGDGGGATARAAGGGIGGDGSGGGGGSSGHQPPKRTQLLAGLPQGESTDPRRRRLKGRPHTARKELGTQPGTQTRFIT

SEQ ID NO: 1016598 - protein, 134 aa, Homo sapiens
MYNLYIQAETFPFVYSKPSPCVCGIEGHIIGTSERVVSSHFLGKGGVVWPKWGWMLPIVHAWWQIHHSGQSSSGVSTFPGSGRLFPGKPVHSLSASWCHFFFSCFLPSWRCSSPGWGNDHSVFRFLGSPLGLSF

SEQ ID NO: 1016599 - protein, 200 aa, Homo sapiens
EHLAFKGTKNRPGNALEKEVESIGAHLNAYSTREHTAYLIKALSKDLPKVVELLADIVQNSSLEDSQIEKERDVILREMQENDASMQNVVFDYLHATLPKGTPLAQAVEGPSENVRRLSRTDLTDYLNRHYKAPRMVLAAAGGVEHHSKLLDLAQKHLSSVSRVYEEDALPGLNSMSLHWAVEIPAIGMTPLPLGHVGHF

SEQ ID NO: 1016600 - protein, 118 aa, Homo sapiens
LFSKPLSEELEGPSQQVMNPTGKEALLQLLLLLLLAKHCRSPNPVTRQDGGTPPPPVGRATPPPGIMAPPPGMRPPMGPPIGLPPARGTPIGMPPPGMRPPPPGIRGPPPPGMRPPRP

SEQ ID NO: 1016601 - protein, 229 aa, Homo sapiens
GFLLQQCLNGTRCSTPPTPAGRFEPEPFATSSFRRSSVATAPRPAATMTTASPSQVRQNYHQDAEAAINRQINLELYASYVYLSMSCYFDRDDVALKNFAKYFLHQSHEEREHAEKLMKLQNQRGGRIFLQDIKKPDRDDWESGLNAMECALHLEKSVNQSLLELHKLATDKNDPHLCDFIETYYLSEQVKSIKELGDHVTNLRKMGAPEAGMAEYLFDKHTLGHGDES

SEQ ID NO: 1016602 - protein, 153 aa, Homo sapiens
MLGVFGEEPKAHGASCARKWLGHRCIMAHRATARGRAAGSGLGPGLSSSCVRRSARLGPGLSVSPRADQSTRSNEGPRRKAGAARFSSAVSGEVTSSPQPWAGGYISGRAGAEARARAYCWASNNGVRVGTWARAYGRRRELAHAKCFDRSPP

SEQ ID NO: 1016603 - protein, 89 aa, Homo sapiens
VIAGLTRCAVHHMSYAAESGTLEYRTLEMSPSQFLKGLASRSPLVLCGDLHVAPEDVTFATPRGTNKDAGFTPHRRPGFGELLQAVPPG

SEQ ID NO: 1016604 - protein, 100 aa, Homo sapiens
NSAGRKELLSVYPSIHLLVGPHSVDRGICEGQDLDEHLVGGPLFHGVKQPWGCSWGLAGPPQTKLGGFCSFRTIRRMHTTPRLTPTSTNTHGHQRMYVLR

SEQ ID NO: 1016605 - protein, 343 aa, Homo sapiens
AVREHFGSERLGDRRVVRGCGGASLKEGARGWQLRLKHIDRRQQPGVMSDRAEQNYGERESRSASRSGSAHGSGKSARHTPARSRSKEDSRRSRSKSRSRSESRSRSRRSSRSIIPGHGLAPASHRRSRSRSYSRDYRRRHSHSHSPMSTRRRHVGNRANPDPNCCLGVFGLSFVHTDRDLEKCSLIWSHCRCVYVYDQQSRRSRGFALYLSTTVDDAKGSYSTCHGKDADGRRTAQSTTPKTNRHTRHHWGDHHETMPTETRPRKRPGNRPRQKSTPPEPTPAGRRDPNDKVETGHTTHGATKHTRQTQTTSTDPTRTREISQRRRVTHQDDTGCQLFPASR

SEQ ID NO: 1016606 - protein, 299 aa, Homo sapiens
AVREHFGSERLGDRRVVRGCGGASLKEGARGWQLRLKHIDRRQQPGVMSAQSRAELRRAGLDPEEAPEGIIPGHGLAPASHRRSRSRSYSRDYRRRHSHSHSPMSTRRRHVGNRANPDPNCCLGVFGLSFVHHRRDLEKCSLIWSHCRCVYVYDQQSRRSRGFALYLSTTVDDAKGSYSTCHGKDADGRRTAQSTTPKTNRHTRHHWGDHHETMPTETRPRKRPGNRPRQKSTPPEPTPAGRRDPNDKVETGHTTHGATKHTRQTQTTSTDPTRTREISQRRRVTHQDDTGCQLFPASR

SEQ ID NO: 1016607 - protein, 85 aa, Homo sapiens
NSPSSCAGLFIASHIGFDWPGVWVHLDIAAPVHAGERAQWGGSPTGSFWPCSEDPLLNLVSPLDCEVDAQEGDNMGRDSKRRRLV

SEQ ID NO: 1016608 - protein, 156 aa, Homo sapiens
EQGYSARGMAHMSQLTACEEWAFSWTVLAHKQVTSSMKRPVSTLPSLTADSAMPLPRSAFEDCDLHQEVLLTPVGKISPSFCLECPVFDLAAGVEPSPRPPGTLPLWLSRNRMWLPWPNVVLLSPTPAPQLLSSSGPCVWLVFAGLSLCSGIALPL

SEQ ID NO: 1016609 - protein, 163 aa, Homo sapiens
CAVLSCGAFRPSASRLALSGPSGAARLPGKHGDESGEPVVLSGQITGLTEGQHGFHVHQYGDNTQGCTSAGPHFNPHSKKHGGPADEERHVGDLGNVTAGKDGVANVSIEDRVISLSGEHSIIGRTMVVHEKQDDLGKGGNEESTKTGNAGSRLACGVIGIAQ

SEQ ID NO: 1016610 - protein, 122 aa, Homo sapiens
GSGSAAETLPEIRVTPLGAGQDVGRSCILVSICGKCMLEVDEWAANDDRRFPDFSYSHPEPAAKQTFLDCVIISPLPPGPLRGTYPYFMRDGGLTTKTQCYTDLTTIDMDILVDNSVCTNYR

SEQ ID NO: 1016611 - protein, 166 aa, Homo sapiens
DSHHISTRQYARIVKRWVAEIGLDPSAYGTHSMRRTKPTLIYRRTKNFRAVQLLLGHTKLESTVRYLGIEVEDALALADKQTSNAKIDRSSLRWPGLADFRHHMPLATRHYTSEGKACFNRNATKISAEIVLENHSSESNALPAPKKSKGPVWTIKILLFLMRPGS

SEQ ID NO: 1016612 - protein, 140 aa, Homo sapiens
ADLRPELFVLGAGGAVQALKNERLGRGLVSGDCDLQGPPWSPEQMLEGQTAGGENPHSEYGLTDNVERIVENMRRLMHEKSSKQKVDLQSLPTRAYLDQTVVPILLQGLGCACKGKDHQIPCEFLASYLLKNKAQFEDRN

SEQ ID NO: 1016613 - protein, 146 aa, Homo sapiens
LLLPCSFAVLLLGTSPREVKTPEQEPSTPMFIVALFRIAQKENSLNALQLVNGLINHGTFIQPSPTKQYKRMNARDIHLHGRDSSDGILQLKWNSFQESFHIAVIDSVFNNRKTDGMIARVREGAPLRERDFEERLGSGGVMAVAT

SEQ ID NO: 1016614 - protein, 123 aa, Homo sapiens
MRVNGLELSGPSLKRQLSETFPKHLLFSMAIHYCKRSWAKGPIEELRDSSWLKHYPSDFLIQNPLARELIGQIPGGQLGYPRSIPLDSSKFFLSPRGIPQGLRRDNSPGDLLLTPIITDTCTR

SEQ ID NO: 1016615 - protein, 70 aa, Homo sapiens
LLKRLGGSAVEPLWLLSAEWKRVLLFVSLAMALQLSREQGITLRGSAGNRGRVLLIRHQQHFISAWHISI

SEQ ID NO: 1016616 - protein, 109 aa, Homo sapiens
RALLCPLWAPNWPALPVILPRGMQGAKSNPLAGGAPEIVAEFFSFGINSILYQRGIYPSETFTRRLPRNTLTWGTFKPLWPFGKTLTWESLEDLPIKKLTLKINVRVGK

SEQ ID NO: 1016617 - protein, 58 aa, Homo sapiens
GKGGCGQTGAALWPGRHHAALLCALTGLALLRAGLFGRCRTLQPSARELSSEHSVVTD

SEQ ID NO: 1016618 - protein, 98 aa, Homo sapiens
PYQLEITLLRNKTAPPVRPLYTSGSPGCRNRHEVVRLRIFGRTLLLLLTFSPRNKRSEPARSTMLLRIPENTRGAEVELPNRITLTSRNVNLGKGVSA

SEQ ID NO: 1016619 - protein, 73 aa, Homo sapiens
RFAVFSPFFVLHRSGQGLRTPESKAWVRLVPQVPGPRQPYPVAQWVSSEDFTGAPSPHLDEGNLGIQTKVEVT

SEQ ID NO: 1016620 - protein, 86 aa, Homo sapiens
QVINKFGDQVTLAVLQNRHQPKGILLKEPLGLILQVDIDDFVPDSLGLQDHQRPLSEGAEPHAVDADSGSGTGPGGALPFPRLLED

SEQ ID NO: 1016621 - protein, 107 aa, Homo sapiens
LVISSTQARPAAEKSRWQIEIEDYFPEFARYTLCRDATPEPGEDPRVTRPSTFIRDEFLRISTASGDGRHYCYPHFTCAVDTENIRRVFNDCRDIIQRMHLRQYELL

SEQ ID NO: 1016622 - protein, 183 aa, Homo sapiens
GQSSALLSTSLIQNSVGIGLKVQKRCCLPQKSLESIFSRKVRVLLCFRSQTLPQTCNEPQASNMAIVAVKMVSGFIPLKPTVKMLERSNHVSRTEVSSNHVLIYLDKVSNQTLSLFFTVSARCPSKRSETSHSESYDSYQPDEFAIAEVNAPCSKDLENLKDPKAEKSFAGVLSQSSPEDTCF

SEQ ID NO: 1016623 - protein, 107 aa, Homo sapiens
VPMSCKVSLSPSGGPEFEGQQEPPFLSPALIGPPGTTRSKREDQGPCRPSNPHCHCSWPQVLPLPRVPTSTAHLIFCSHFTELYKERTQHGRVGSLVLFVCLFVCLI

SEQ ID NO: 1016624 - protein, 134 aa, Homo sapiens
MDTSHTTKSCLLILLVALLCAERAQGLECYQCYGVPFETSCPSITCPYPDGVCVTQEAAVIVDSQTRKVKNNLCLPICPPNIESMEILGTKVNVKTSCCQEDLCNVAVPNGGSTWTMAGVLLFSLSSVLLQTLL

SEQ ID NO: 1016625 - protein, 230 aa, Homo sapiens
MREGGPPRPFRMKAAVLTLAVLFLTGSQARHFWQQDEPPQSPWDRVKDLAFFFFFKDSGGDYVSQFEGSALGEQLNLKLFDTWDSVTFTFSKLLRTARPCDPRSSGITLKKETEGLRQEMSKDLEEVEGQVAALPWTTSRRSGRRRWSSTARRWKPARRAPRGARQKLHELQEKLTHWARRIATRAPMWTVARIWPPTATSWPSLAARLEALKENAAPDWPSTTQGHRAF

SEQ ID NO: 1016626 - protein, 155 aa, Homo sapiens
MREGGPPRPFRMKAAVLTLAVLFLTGSQARHFWQQDEPPQSPWDRVKEAARAAREADPLGEEMRDRCPNVDASHASGPLQRRAGPAWPRALRLSRRTRRQTGRVPPKATEHSEHAQREGQARARGPPQSLLPVLESFKVSFLSALEEYTKKLNTQ

SEQ ID NO: 1016627 - protein, 118 aa, Homo sapiens
MELYRQKVEACAQSSKRRAPEAARAAREADPLGEESHASGPLQRRAGPAWPRALRLSRRTRRQTGRVPPKATEHSEHAQREGQARARGPPQSLLPVLESFKVSFLSALEEYTKKLNTQ

SEQ ID NO: 1016628 - protein, 157 aa, Homo sapiens
MSKDLEEVEGQVAALPWTTSRRSGRRRWSSTARRWKPARRAPRGARQKLHELQEKLTHWARRCATAQQQPNVERSHASGPLQRRAGPAWPRALRLSRRTRRQTGRVPPKATEHSEHAQREGQARARGPPQSLLPVLESFKVSFLSALEEYTKKLNTQ

SEQ ID NO: 1016629 - protein, 111 aa, Homo sapiens
MSKDLEEVEGQVAALPWTTSRRSGRRRWSSTARRWKPARRAPRGARQKLHELQEKLTHWARRIATRAPMWTVARIWPPTATSWPSLAARLEALKENAAPDWPSTTQGHRAF

SEQ ID NO: 1016630 - protein, 262 aa, Homo sapiens
EMREGGPPRPFRMKAAVLTLAVLFLTGSQARHFWQQDEPPQSPWDRVKDLAFFFFFKDSGGDYVSQFEGSALGEQLNLKLFDTWDSVTFTFSNCANSSALLPQKFWDNPEKGDEGQVAALPWTTSRRSGRRRWSSTARRWKPARRAPRGARQKLHELQEKLTHWARRYSERARAHVDTLSHASGPLQRRAGPAWPRALRLSRRTRRQTGRVPPKATEHSEHAQREGQARARGPPQSLLPVLESFKVSFLSALEEYTKKLNTQ

SEQ ID NO: 1016631 - protein, 70 aa, Homo sapiens
PPEREGAKFPIKWTAPEAINFGCFTIKSDVWSFGILLYEIVTYGKIPYPGRTNADVMTALSQGYRMPFLV

SEQ ID NO: 1016632 - protein, 278 aa, Homo sapiens
AEVARSADGWAAAGRPRGSGGRRHSGPRRSPSPLLLAPAASPADGDGRHPRRLGRDRVGREDEDGWETRGDRKPGSPWWRRSGARGINESLQEAGAAAGRAPRVQAKLENAEVLDADGAAVSQGVAAGPGRARREQAAWRKRGERFAAGYIQLLHKVHTFVSTSQGPFDATVRCRAPEPSARGPLPAGGERQQASQRSCWGDALGGGPPRATSSPNIAWVRPPSGHYTVGILQGALPAKHVAAEPRDPLGRRRKNASVDQSGARKPSEARGIWDLTQK

SEQ ID NO: 1016633 - protein, 148 aa, Homo sapiens
ARRLRPFGVQRFLYTGRQQGPEEAAEFQAEFVSTPELAAQSDFIVVACSLTPAPEGLYNKAFFQRMRDTAVFINISRGDVVNQGALYQAWASGKIAAAGLDVTSPAPLTNPLLSLSCVIHIGSATRRTMCLLAKLLAGLRGERMPSLL

SEQ ID NO: 1016634 - protein, 108 aa, Homo sapiens
MRCPCVFRYLVLLLVLRASDGMASAVVRGTECLLTVHERCSSNVGYVELHKMVERFLGLSSLNLSSYNQISLVLPQKHREKPPSGSKWCFEEESHSQAGPGGFHNSGS

SEQ ID NO: 1016635 - protein, 108 aa, Homo sapiens; identical to SEQ ID NO: 1016634

SEQ ID NO: 1016636 - protein, 108 aa, Homo sapiens; identical to SEQ ID NO: 1016634

SEQ ID NO: 1016637 - protein, 108 aa, Homo sapiens; identical to SEQ ID NO: 1016634

SEQ ID NO: 1016638 - protein, 125 aa, Homo sapiens
MFYNFYENSKSQLKYFNIVSCRIRVCDWAAMDSGFGSDFGGTGGGKLDPGAIMEQVKVQIAVANAQELLQRMTDKCFRKCIGKPGGSLDNSEQKCIAMCMDRYMDAWNTVSRAYNSRLQRERANM

SEQ ID NO: 1016639 - protein, 185 aa, Homo sapiens
GLRPGSPMAAEDNPGRGATGGTESLPYDQGHVAGVISKDPRGTRRAAKKYNMRVEDYEPYPDDGMGYGDYPMLPNRSQHERDPWYQWDHSELRIELGVNRYTGNLDMYIRESVWTRHLPPVVLGDVMCKHLFGFGGPFMVFMFWVGHVFPSYQPVGPKQYPYNNLYLERGGDPTKEPEPVVHYDI

SEQ ID NO: 1016640 - protein, 95 aa, Homo sapiens
FVRPEALAELMIDEALFQAVRTQWPMEDALAELMIDEALLQAARMQWPMEDALAEFMIDEALFQAVSTQWPMKDALAELIIDQALFQAARTQWPM

SEQ ID NO: 1016641 - protein, 100 aa, Homo sapiens
PSSMTPRVIHRTQHPRSARACSFLHDTQGHSQNTASQQCSRLLLPRHPGSFTQHGFPGALAPAPSSLTPRVIHRTRIPRRARACSFLHDTQGHSQNTAGH

SEQ ID NO: 1016642 - protein, 139 aa, Homo sapiens
LLGNLEPEEAKLIRVPLQRIHLGHRILNPLNGWEQLALSRTSTSGANPSFVPLSKFMNTQYFGTIGLGTPPQNFTVVFDTGSSNLWVPSTRCHFFSLACWFHHRFNPKASSSFRPNGTKFAIQYGTGRLSGNPEPGQSD

SEQ ID NO: 1016643 - protein, 165 aa, Homo sapiens
EADAQRCREKVTSRPSLSARNADTAALPPCCCRSLGRRDGSCRRPRPAGTYHRLMDKVELLLPKKLRPLYNHPAGPRTVFFWAPIMKWGLVCAGLADMARPAEKLSTAQSTVLMATGFIWSRYSLVIIPKNWSLFAVNFFVGSAGASQLFRIWRYNQELKSKGIQ

SEQ ID NO: 1016644 - protein, 205 aa, Homo sapiens
APRPCPGQCAGQGSVAGAGMRQSAALPRSPCSVPSQVPTSLGFFSRATAGVLPGDPSLWGSAERPGLVPPAWHVGCLERSGYYSLRVVLRGVFSVKRRIRTTASEEERSPSSSLELRGRYVLFGSNRLPPVKSAIRGQAPVVPYMRYGHSTVLIDDTVLLWGGRNDTEGACNVLYAFDVNTHKWVHTPECQGQFLGPGMDIQPVS

SEQ ID NO: 1016645 - protein, 139 aa, Homo sapiens
MLRWTVHLEGGPRRVNHAASGCRASGILLRGLLLWLKTTETAAVRVDVHIFNAVVLAYGQRLPPVKSAIRGQAPVVPYMRYGHSTVLIDDTVLLWGGRNDTEGACNVLYAFDVNTHKWVHTPECQGQFLGPGMDIQPVS

SEQ ID NO: 1016646 - protein, 95 aa, Homo sapiens
ANHSQSQEEMNALVLPGGEAGPAEIRYDHSQEILMEKGTQRGRGHILGEEDCGYSGMGVWGGVAHQRRDLSVGVTVLMWKRGGGVFEGRMQIREA

SEQ ID NO: 1016647 - protein, 110 aa, Homo sapiens
DPRVRSRVAALLFVFWSDILTGCGVCCYSPSFAMPPKDDKKKKDAGKSAKKDKDPVNKSGGKAKKKKWSKGKVRDKLNNLVLFDKATYDKLCKEVPNYKLITPAVVSERD

SEQ ID NO: 1016648 - protein, 97 aa, Homo sapiens
YFKPAGSGAMTYHPWPGWLLPITNDKASKLDAGKSAKKDKDPVNKSGGKAKKKKWSKGKVRDKLNNLVLFDKATYDKLCKEVPNYKLITPAVVSERD

SEQ ID NO: 1016649 - protein, 107 aa, Homo sapiens
PEIRPFMAGASFSVIFDEAVEIAGDLLAFECRLIDDKYKKDAGKSAKKDKDPVNKSGGKAKKKKWSKGKVRDKLNNLVLFDKATYDKLCKEVPNYKLITPAVVSERD

SEQ ID NO: 1016650 - protein, 103 aa, Homo sapiens
MPPKDDKKKKDAGKSAKKDKDPVNKSGGKAKKKKWSKGKVRDKLNNLVLFDKATYDKLCKEVPNYNLYPAVSLRDLRFEAPGQAAFRAPSKAYQLFKPSSVFT

SEQ ID NO: 1016651 - protein, 142 aa, Homo sapiens
TCLWLQSINVTARIPTAQAFKITPCHFQGTALKVSFGLGSATNYVTLDKSPHSQAHFPKLQNEVRGGGPLVLSRVLQFLCPWSPLVSLCKSDLGQHGVFAQSGSHSLLRQCLSLMPFGSWGSYVDSDLRAIRPVSSYPIEVS

SEQ ID NO: 1016652 - protein, 140 aa, Homo sapiens
SKKGGLGLPGSRFPKGQDPWPTNGGEPSLFHGAHQAAEDLGRDEAGAPKGEVAEVEVPQVQVRLGSGDGPRGHVGAAGAQGLEEGGEQGTPHHVGHGVHVGPPRGGLQGLWEVSGAPGKADVRPQSPQGLVLRARKGINR

SEQ ID NO: 1016653 - protein, 227 aa, Homo sapiens
FSLRWMRLVEQGLLEKPVFSFYLNRDSEGSDGGELVLGGSDPASLRTSPHPSYQSPSLPTGGPNMEECEGRHRAELLCQGCSAILDTGTSLITGPSEEIRALNKAIGGYPFLNGQYFIQCSKTPTLPPVSFHLGGVWFNLTGQDYVIKILQSDVGLCLLGFQALDIPKPAGPLWILGDVFLGPYVAVFDRGDKNVGPRVGLARAQSRSTDRAERRTTQAQFFKRRPG

SEQ ID NO: 1016654 - protein, 93 aa, Homo sapiens
FLETESCCVAQAGLEPLASSDPPTSASPGVGITGVRHCTWSFLGFLKQALQEILVCTKVGEGFVCLNPERGGGQGRLESVQASGKRVLSLSFS

SEQ ID NO: 1016655 - protein, 147 aa, Homo sapiens
AATMVRMNVLADLSRASTTLRREANARSSSGHVLKSSVRFLTVMMKHGYIGEFEIIDDHRAGKIVVNLTGRLNKCGVISPRFDVQLKDLEKWQNNLLPSRQFGFIVLTTSAGIMDHEEARPKTYRRENPWDSFFKRKAEIKSLSCRI

SEQ ID NO: 1016656 - protein, 286 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRQNVMGNGLSQCLLCGEVLGFLGSSSVFCKDCRKVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 1016657 - protein, 315 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 1016658 - protein, 210 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSETSRIYTWARGRVVGRKC

SEQ ID NO: 1016659 - protein, 210 aa, Homo sapiens; identical to SEQ ID NO: 1016658

SEQ ID NO: 1016660 - protein, 210 aa, Homo sapiens; identical to SEQ ID NO: 1016658

SEQ ID NO: 1016661 - protein, 95 aa, Homo sapiens
GNWTEITPSWFEIHGAQTLFPTGGSVEAPRMGFTHPPGHLSGCQSSLASGETGTGSADPPGGPRPGLTRRAPVKDTPGRAPAADAAPAGPSSCLG

SEQ ID NO: 1016662 - protein, 210 aa, Homo sapiens; identical to SEQ ID NO: 1016658

SEQ ID NO: 1016663 - protein, 315 aa, Homo sapiens; identical to SEQ ID NO: 1016657

SEQ ID NO: 1016664 - protein, 232 aa, Homo sapiens
MADTIFGSGNDQWVCPNDRQLALRAKHCCTAVNRTNTVPGLKAQVEQRLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQREVWKRSGAWFYKGLPKYILPLKTPGRADDPHFRPLPTEPAEREPRSSETSRIYTWARGRVVGRKC

SEQ ID NO: 1016665 - protein, 286 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKVWKRSGAWFYKGLPKYILPLKTPGRADDPHFRPLPTEPAEREPRSSETSRIYTWARGRVVSSDSDSDSDLSSSSLEDRLPSTGVRDRKGDKPWKESGGSVEAPRMGFTHPPGHLSGCQSSLASGETGTGSADPPGGPRPGLTRRAPVKDTPGRAPAADAAPAGPSSCLG

SEQ ID NO: 1016666 - protein, 161 aa, Homo sapiens
MADTIFGSGNDQWVCPNDRQLALRAKLQTGWSVHTYQTEKQRRKQHLSPAEVEAILQVIQRAERLDVLEQQRIGRLVERLETMRRNVMGNGLSQCLLCGEVLGFLGSSSVFCKDCRKKVCTKCGIEASPGQKRPLWLCKICSEQRELFYFTIYRVEPSVFL

SEQ ID NO: 1016667 - protein, 133 aa, Homo sapiens
MVHLTPEKKSAVLPLWGKVNVHEVGGEALGRLLVVYPWTQRFFESFGDLSTPDAVMGNPKVKAHGKKVLGAFSDGLAHLDNLKGTFATLSELHCDKLHVDPENFRLLGNVLVCVLPHHLAKEFTPSERAVKDL

SEQ ID NO: 1016668 - protein, 118 aa, Homo sapiens
SNRVEWNGMEWNHTEWNGVEWNGMEWNGMEWNGMESNPESQLNGIERNGMEWNGFNPNGVERNGINPSGMAWNGMECNGMEWNGMVGNRMEWNEMEWNGMEWNGMEWNGMEWNGIIPS

SEQ ID NO: 1016669 - protein, 111 aa, Homo sapiens
SNRVEWNGMEWNHTEWNGVEWNGMEWNGMEWNGMESNPESQLNGIERNGMEWNGFNPNGVERNGINPSGMAWNGMECNGMEWNGMVGNRMEWNEMEWNGMELNGMESFRVE

SEQ ID NO: 1016670 - protein, 97 aa, Homo sapiens
MNDLQKRLGPRGLVVLGFPCNQFGHQENGKNEEILNSLKYVRPGGGFEPNFTLFEKCEVNGEKAHPLFTFLRNALPTPSDDPTCAHDRPQVHHFGLR

SEQ ID NO: 1016671 - protein, 38 aa, Homo sapiens
MGEKAHPLFTFLRNALPTPSDDPTALMTDPKYIILVSG

SEQ ID NO: 1016672 - protein, 127 aa, Homo sapiens
MNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRNDVAGTLRSSWWALTVCPYAGTAALPDH

SEQ ID NO: 1016673 - protein, 127 aa, Homo sapiens; identical to SEQ ID NO: 1016672

SEQ ID NO: 1016674 - protein, 225 aa, Homo sapiens
MNELQRRLGPRGLVVLGFPCNQFGHQENAKNEEILNSLKYVRPGGGFEPNFMLFEKCEVNGAGAHPLFAFLREALPAPSDDATALMTDPKLITWSPVCRKPGKIKFFLGPPAMLAGTFEKFLVGPDGVPLRRYSRASRPLTSSLTLKTCCLKGQLCYGAPSTPVVWQLQCCCLGGVFIYEGVSSKPTREEQLILQKIHLEMGAGPVDPSLCQTKASFPPNKVPGV

SEQ ID NO: 1016675 - protein, 326 aa, Homo sapiens
QCLFGALRWLLGQLRHVCCSASGGGGPVGVCLLGAPAGRRGACEPGLPAGQGTTYRECGVPLRHHGPGLHPDERAAAAPRTPGPGGARLPVQPVWASVLRRADSGRGGGRTVREMAGGLPAGVHSVGAVRLHSGGAVWADYSSFSFRSSCGSIASKFRLRRLGIAAWQGTNPVVTHRKISPGLVVKKLSHPYLFDPVFRKHGLLSCRRENAKNEEILNSLKYVRPGGGFEPNFMLFEKCEVNGAGAHPLFAFLREALPAPSDDATALMTDPKLITWSPVCRNDVGWNFEKFLVGPDGVPLRRYSRASRPLTSSLTLKTCCLKGQLC

SEQ ID NO: 1016676 - protein, 370 aa, Homo sapiens
RTTDDVMSCGPVGNFRHRTMATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARVWDFFSSNKRSVILITNPMVNLDKLKERAQRFGFELSLPISRKSEDDEKLEKEERSDLGLSQVQLELEPQRIQRAKKQANEQSALGLLDDQSLILLFSSDPMSLLLLVTYMRKCTVMCYVWLRKEGTLTPGTSMKRRNKTTMEVKIKEEEQRTEKRYKVTKNRQQQRAGHYRKTQGDQDQITNLTTGSQRETKDNSTPKTTIERRRGNNPGTEQTKNKRIQKSAT

SEQ ID NO: 1016677 - protein, 366 aa, Homo sapiens
MARRRRGLIGRGGYKMATETVELHKLKLAELKQECLARGLETKGIKQDLIHRLQAYLEEHAEEEANEEDVLGDETEEEETKPIELPVKEEEPPEKTVDVAAEKKVVKITSEIPQTERMQKRAERFNVPVSLESKKAARAARVWDFFSSNKRSVILITNPMVNLDKLKERAQRFGFELSLPISRKSEDDEKLTKEERSDLGLSQVQLELEPQRIQRAKKQANEQSALGLLDDQSLILLFSSDPMSLLLLVTYMRKCTVMCYVWLRKEGTLTPGTSMKRRNKTTMEVKIKEEEQRTEKRYKVTKNRQQQRAGHYRKTQGDQDQITNLTTGSQRETKDNSTPKTTIERRRGNNPGTEQTKNKRIQKSAT

SEQ ID NO: 1016678 - protein, 42 aa, Homo sapiens
MGFWQWPTSQVLVFPHKYPLLTLWHGFYLVLKLDPNKELIIA

SEQ ID NO: 1016679 - protein, 113 aa, Homo sapiens
RGHTGKIEACPQDIPVKQQPLLEATELTASGNFCLFRSETQGTFCSEMTQYVWPKLHDRNTYEKYLGEEYVKAVGNLRKSPPHHLLKPALPGDLKISEVGLAPQGEDGNPDDP

SEQ ID NO: 1016680 - protein, 221 aa, Homo sapiens
SARWEDGGGGGDNRGLPLPVLRRNQDNEDEWPLARILSVKDISGRKLFYVHYIDFNKALDEWVTHERLELKKIQFPKKEAKTPTKNGLSWVPSWLSRERGETEGGGGFTERYSSAHAETSPGVRFCPQNVEPPVGQWQRPAGTDAKSRIVWALMRTPRTGSDGIPSVPRMTGSLVSDRKPRRRRHPDEEQLSAIERGAAPTQAVVHSPQYPRGTHHIACAL

SEQ ID NO: 1016681 - protein, 103 aa, Homo sapiens
MLIKVKTLNGKEIEIDIEPTDKVERIKERVEEEGIPPQQQGFIYSGKQNDEKTAADYQIVVQSSLVLALEESWHDGPPFDSYLSLMSYISHLWDTIAMPSLDA

SEQ ID NO: 1016682 - protein, 194 aa, Homo sapiens
EDSVDSDESDESHHSDESDETVTASTQADTFTPIVPTVDVPNGRGDSLAYGLRSKSRSFQVSDEQYPDATDEDLTSHMKSGESKESLDVIPVAQLLSMPSDQDNNGKGSHESSQLDEPSLETHRLEHSKESQESADQSDVIDSQASSKASLEHQSHKFHSHKDKLVLDPKSKEDDRYLKFRISHELESSSSEVN

SEQ ID NO: 1016683 - protein, 82 aa, Homo sapiens
PSRLYSLLFRRTSTFALTIAVGALFFERAFDQGADAIYEHINEGKLWKHIKHKYENKENTLPLWDPKEQSPVSCLPGVGASA

SEQ ID NO: 1016684 - protein, 97 aa, Homo sapiens
EVNVEKAHPSSLPFCGMPCQHPVTTPTALMTDPKYIIWSPVCRNDIAWNFEKFLVGPDGVPVRRYSRRFRTIDIEPDNRNPVLSSLATPKAALALAW

SEQ ID NO: 1016685 - protein, 231 aa, Homo sapiens
ADQAQIMAGSRLETVGGIFSRTRDLVRAGVLKEKPLWFDVYDGFPPLREPVFQSASSANIANAKAPHPMTVWYHEPWIREKLLFMCMGLVKRVYGSIQSKSSSLPVNGFVARTYICVYTNTWATRRLNEAKLLSAGNEGPRLYLRRKGVMFIRRSKAEATDSTSGGSHGFPRKSRTLELSEPTALAVGHRKTEGTSMKQERFRLGNPGHFWEVATLPGTQGPQTGPSMPLP

SEQ ID NO: 1016686 - protein, 116 aa, Homo sapiens
VVLYAQRGPERPGRELGRVHRPSLLPEPALRTKPPIPGPGVSRAPTAPGRQRAETHGAPYAPAPPPPPPRRKRVERATGGPGAASDPLATCAPEGEAVKRQTRGPRRFAPPPCLPR

SEQ ID NO: 1016687 - protein, 211 aa, Homo sapiens
DHASLFPRLVPGADVRGSLLYAESVGTMASLSLAPVNIFKAGADEERAETARLSSFIGAIAIGDLVKSTLGPKGIGQNSPKQWTRRRSDGDQRRCYHSQEHWCGQPRSKGSKLICQGFKDDEVGDGTTSVTCLSPQKLLREAESLIAKKIHPQTIISGWREATKAAREALLSSAVDHGSDEARFWQDLMNIAGTTLSSKSLSPKGPFTKLA

SEQ ID NO: 1016688 - protein, 193 aa, Homo sapiens
MPVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 1016689 - protein, 221 aa, Homo sapiens
ILNEINLPPPGDLGLPGPSLQPSLASSACAVWGGGNKCGACGRTVYHAEEVQCDGRSFHRCCFLCMVCRKNLDSTTVAIHDEEIYCKSCYGKKYGPKGYGYGQGAGTLNMDRGERLGIKPESVQPHRPTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQ

SEQ ID NO: 1016690 - protein, 87 aa, Homo sapiens
GRLLLLNSRPVNVAIHDEEIYCKSCYGKKYGPKGYGYGQGAGTLNMDRGERLGIKPESVQPHRPTTNPNTSKFAQKYGGACRRGREF

SEQ ID NO: 1016691 - protein, 132 aa, Homo sapiens
ILNEINLPPPGDLGLPGPSLQPSLASSACGTCSRLRLKMPVWGGGNKCGACGRTVYHAEEVQCDGRSFHRCCFLCMVCRKNLDSTTVAIHDEEIYCKSCYGKKYGPKGYGYGQGAGTLNMDRGERLGIKPER

SEQ ID NO: 1016692 - protein, 102 aa, Homo sapiens
MKRSTTNPNTSKFAQKYGGAEKCSRCGDSVYAAEKIIGAGKPWHKNCFRCAKCGKSLESTTLTEKEGEIYCKGCYAKNFGPKGFGYGQGAGALVHAQVRCKA

SEQ ID NO: 1016693 - protein, 375 aa, Homo sapiens
AAANRSRSCCDAASEAAKVEAGLAPEPGRLELVWGLRSRARHGRPGRSGRCLCPGCGRMSKWTSKRGPHVQGPQGEGAKGIGFLTSGWRFVQIKEMVPEFVVPDLTGFKLKPYVSYLAPESEETPLTGTAQLFQRSRGLPAIEEGLSKDGTFDPDNLEKYGFEPTTGGKAFPALPQELPALAGRGRGWPALIVHFYYFKTALLAQAKEREEEGRRKRTRSLAKVKKRIRAETYYKAECGREKEGDIEGRAGGKKRGGDRGGAAEKLEKKRGGGAEQAGAETTNKKRGGRRRDGRDSGARNSARKQGGGGEKQGRNKEHTEKRERRGEEKSSVERATGEGGRTGEEPEAREEAKHEEGTHRPQRRSKWEREAKEDD

SEQ ID NO: 1016694 - protein, 188 aa, Homo sapiens
MRLAVICFCLFGIASSLPVKVTDSGSSEEKLYSLHPDPIATWLVPDPSQKQNLLAPQNAVSSEEKDDFKQETLPSNSNESHDHMDDDDDDDDDDGDHAESEDSVDSDESDESHHSDESDETVTASTQADTFHSNPSLQVDVPTAEVILGLWTEVKSRSFQVSDEQYPDATDEGLTSQMKSGESKESPM

SEQ ID NO: 1016695 - protein, 177 aa, Homo sapiens
MSLLMISENVKLAREYALLGNYDSAMVYYQGVLDQMNKYLYSVKDTYLQQKWQQVWQEINVEAKHVKDIMKTLESFKLDSTPLKAAQHDLPASEGEVWSMPVPVERRPSPGPRKRQSSQYSDPKIHMVNRPKYNCQKFTRSFWPECSHDEGKAVRCREKKDRIRRRKENSRWGKNRK

SEQ ID NO: 1016696 - protein, 113 aa, Homo sapiens
ESCSRKQHPSKPKAPCNERIKASDVNFMFDPKTRVDLACLGCSPRVGLSSTRPKPYWGCLGTSHAVGRVLIVTESCIPCGKQSCSRGTGGARLESNTNSPGAEGTFPGTCAPE

SEQ ID NO: 1016697 - protein, 156 aa, Homo sapiens
MSFSSFQIGSTSAPGQGGLAQREFRRLSPFLDWAPFGVMTPPIIPLLWYSSKRKYTPKTKKNKLGLPQPPKKTKPPRKKAMCFPDSKGYLKCNLFSLSPWFHREAINRNAFGNSLEPRGPSDAPLRCCWFIAGNVNSLRGLGGAFWRLPDTTPIPP

SEQ ID NO: 1016698 - protein, 55 aa, Homo sapiens
TQKYQVKHYIIFSFVLFSKQHCNNTITIKGACCGLSFMTQDTCGSRGSPAGRAGT

SEQ ID NO: 1016699 - protein, 211 aa, Homo sapiens
VHARVCTHVHMPPAPPSNPSVPPGQGPLLAIRVWPDRPFLPSTLQALGQAGPPGCCCVGARVPPGPCRLGIRWGGALLRNQTDAHSGLPKHPEHGAHPKASDACVGQGSPMPAGLPDCARGPAPTLSGWPRLGEQSRVGVAARSVCQRHQVERARHRPTLVQTLTLQKTPMVLKLSPGHAWPSPPRREVALLNLYRFIVPRDSPRPCIISL

SEQ ID NO: 1016700 - protein, 189 aa, Homo sapiens
VHARVCTHVHMPPAPPSNPSVPPGQGPLLAIRVWPDRPFLPSTLQALGQAGPPGCCCVGARVPPGPCRLGIRWGGALLRNQTDLTLGFPSTLSTEPTPRPPTRGWDRAARCQLAYLTVPGALPPPSQDGLDLGNRAGWGLQPGVSSKDKAQAEQDGAEESESSSSTRWRGPGTGPPWSKPSHYRKPQWC

SEQ ID NO: 1016701 - protein, 179 aa, Homo sapiens
TALPPFCGVLSQRPRREDGSLATFLGRRQFAFAEMRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEG

SEQ ID NO: 1016702 - protein, 95 aa, Homo sapiens
DGAAAILWGVCRSGRGGKTAVWRHFSAEGSLLLRRCGIPKELTVLIGIAEKAGDMKAIVEVTSGRGDLIVAHKRTGIVNHITSLKNLIVLHVHPS

SEQ ID NO: 1016703 - protein, 214 aa, Homo sapiens
DGAAAILWGVCRSGRGGKTAVWRHFSAEGSLLLRRCGIPKELTVLIGIAEKAGDMKAIVEVTSGRGDLIVAHKRTGIVNHITSLKNLIVLLCIPLEASHSVEEDTHPSHYLEARSLNERDYRDRRYVDEYRNDYCEGYVPRHYHRDIESGYRIHCSKSSVRSRRSSPKRKRNRHCSSHQSRSMNIVDTLGEGAFGKVVECIDHGMDGMHVAVKI

SEQ ID NO: 1016704 - protein, 151 aa, Homo sapiens
RRHTFDLAERWTQHVCSNDYSEMRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSI

SEQ ID NO: 1016705 - protein, 130 aa, Homo sapiens
DGAAAILWGVCRSGRGGKTAVWRHFSAEGSLLLRRCGIPKELTVLIGIAEKAGDMKAIVEVTSGRGDLIVAHKRTGIVNHITSLKNLIVFHWDCLPDCLSKLASWGYFKKQTCVGYNECPYPQSVFGYKG

SEQ ID NO: 1016706 - protein, 83 aa, Homo sapiens
MVGFSASSPTEEEQEQGEIGACSDEGTAQEGKAAATPESQEPQAKGAEASAASEEEAGPQATEPSTPSGPESGPTPASAEQNE

SEQ ID NO: 1016707 - protein, 83 aa, Homo sapiens; identical to SEQ ID NO: 1016706

SEQ ID NO: 1016708 - protein, 107 aa, Homo sapiens
SRRSFLLRALGQAASSPEPTGCLLSQRRPLITVAMPGGLLLGDVAPNFEANTTVGRIRFHDFLGDSWGILFSHPRDFTPVCTTELGRAAKLAPEFAKRNVTVDVPFQ

SEQ ID NO: 1016709 - protein, 169 aa, Homo sapiens
QGPSVMLSTEAFLYVGTMLDGGDLSRFVLLMTNCYATPSSNSTDPVKYFIIQDSCPRTEDTTIQVTENGESSQARFSVQMFRFAGNYDLVYLHCEVYLCDSTSEQCKPTCSGTRFRSGNFIDQTRVLNLGPITRQGVQASVSKAASSNLRLLSIWLLLFPSATLIFMVQ

SEQ ID NO: 1016710 - protein, 77 aa, Homo sapiens
GKMAEVEQKKKRTFRKFTYRGVDLDQLLDMSYEQLMQLYSARQRRRLNRGLRRKQHSLLKRLQRPRRRRRPWRSRKW

SEQ ID NO: 1016711 - protein, 294 aa, Homo sapiens
MRSGKASCTLETVWEDKHKYEEAERRFYQHQGTQGAAFGPAAGQPEGPAMNGPGQDNPEDPDEAEAPDGGSRRDPRKSQDSRKPLQKKRKRSPKSGLGPADLALLGLSAERVWLDKSLFDQAESSYRQKLADVAAQAAWASLPWPLGASAPMENQVALPPRDLGGFWVNKSSFRPGLERGLLWMCVSCACCCAPDGACLQARVTPHMAMQVCLSPDLCPPCPSPPGQWPCPLLVHACMALGSGGVAVRSPVYDAAERGFYEALFDGHPPGKVRLQERAGWPRVPGGAAETAGRN

SEQ ID NO: 1016712 - protein, 197 aa, Homo sapiens
EELAERTETKRPDIGGHQLRGRWISGMVAATLTLTFDVVKTQRQMSLGAVEAVRVKPPRVDSTWLLLRRIRAESGTRGLFAGFLPRIIKAAPSCAIMISTYEFGKSILPEAQPGAASGPLESRGATGSCTGGIRRLKPSAFPPSPVTPGCPQTWIPAVSLPRIAPLPPEFKTKSDDRPFLYPHVCYSLARGAWARQY

SEQ ID NO: 1016713 - protein, 135 aa, Homo sapiens
MACGLVASNLNLKPGECLRVRGEVAPDAKSFVLNLGKDSNNLCLHFNPRVQRPRDANTIVCNSKDGGAWGTEQREAVLSLPAWKCCRRLCITFDQANLTVKLPDGYEFKFPKRLKLEAINYMAADGDFKIKCVAL

SEQ ID NO: 1016714 - protein, 222 aa, Homo sapiens
PVTVSDAARCSTFISEGVRGNVVQNKLDPLIYPDAYGEKRCMDNPTLYLEEIRPGADSSCDDLDIVSRQLCLRPECGQVTGHSETFGVRLVGPDLQAFLAQPLTSIQSRITKTFTKSWVDEKTPERLVYGSIAGLDELGHECYQDSEFCRRLQQEGERIRRCAGRPCAEQSLYRIGADHVQSLLLKHCAPVLAELAHRLTIRTPIGQKFGSLGPSLCYQVVK

SEQ ID NO: 1016715 - protein, 151 aa, Homo sapiens
LARRGWLWKLPLATRREFWSRSRKEKEPVVAETVEEVKKEPVLVCPPLRSRAYTPPSDLQSRLESHIKEVLGSSLPNNWQDISLDDGHMKFRLLAGLADGLGHAVPNSRLHQMCRVRDVLDFYNVPVQDKSKFDELVASNLPPNLKISWSY

SEQ ID NO: 1016716 - protein, 141 aa, Homo sapiens
CLRRCTAAASPKPAPRLGSQPAAAVCSIRCYSHGSHETDEEFDARWVTYFNKPDIDAWELRKGMNTLVGYDLVPEPKIIDAGIAKHVDGEMILLVLFASWRFVKDKAGPHKEIYPYVIQELRPTLNELGISTPEELGLDKV

SEQ ID NO: 1016717 - protein, 144 aa, Homo sapiens
SGVQSFDEEEGEATTEFPPPMPCLPLPPEGHGCDPYPPSPQLVQLKLGRQHWGTQGASRSSPGNGGPGWDFIQAYTLETHRPGQLRPGQLDGRELGVAVEKDLGCGLLGLCRQSLQCVHPEDGGSACSRLDLSSSRPDFVFQEP

SEQ ID NO: 1016718 - protein, 204 aa, Homo sapiens
MGKRQHQKDKMYITCAEYTHFYGGKKPDLPQTNFRRLPLDHCSLSLQPFVYPDLHPDGIVLTLREHCCHGLKKYGTNPEMEEKLDGRSLIKAELFQEQWGEVPMTSACLPELHRTTPTNVDCERRNGERLQPMRQRQQLNIKGKNFRDLLTDEAFYRQDIINHPGPHQFGTSSNVSNFYHVTNTMKIHDPDDETATQDRSSLSD

SEQ ID NO: 1016719 - protein, 89 aa, Homo sapiens
FDDTLGSLTARPGFLRLYGNDSLNSTFTQSTVARRWQHFAFRAETRMEFSPVHFQQRRGADLLLNSKNWSYCFVDYEGGPGTQFPISEY

SEQ ID NO: 1016720 - protein, 73 aa, Homo sapiens
VINPPSMEIEHNRESSGVLTANYMTRYCHIIVALFATGGARATGICAYPIHLFIQPLKAQTMHRQSLCQRKWL

SEQ ID NO: 1016721 - protein, 771 aa, Homo sapiens
FWCENVKPMLRMNAEAPNLEPGTRCFTLIKSLLKSQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 1016722 - protein, 838 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVCAPAAVATSPPGAIPKEACGGAPLQGLPGEALGCPAGVGTPVPADGTQTLTCAHTSAPESTAPTNHLVAGRAMTLSPQEEVAAGQMASSSRSGPVKLEFDVSDGATSKRAPPPRRLGERSGLKPPLRKAAVRQQKAPQEVEEDDGRSGAGEDPPMPASRGSYHLDWDKMDDPNFIPFGGDTKSGCSEAQPPESPETRLGQPAAEQLHAGPATEEPGPCLSQQLHSASAEDTPVVQLAAETPTAESKERALNSASTSLPTSCPGSEPVPTHQQGQPALELKEESFRDPAEVLGTGAEVDYLEQFGTSSFKESALRKQSLYLKFDPLLRDSPGRPVPVATETSSMHGANETPSGRPREAKLVEFDFLGALDIPVPGPPPGVPAPGGPPLSTGPIVDLLQYSQKDLDAVVKATQEENRELRSRCEELHGKNLELGKIMDRFEEVVYQAMEEVQKQKELSKAEIQKVLKEKDQLTTDLNSMEKSFSDLFKRFEKQKEVIEGYRKNEESLKKCVEDYLARITQEGQRYQALKAHAEEKLQLANEEIAQVRSKAQAEALALQASLRKEQMRIQSLEKTVEQKTKENEELTRICDDLISKMEKI

SEQ ID NO: 1016723 - protein, 220 aa, Homo sapiens
PTAAREKMAAPAASGLSRQVRSFSTSVVRPFAKLVRPPVQVYGIEGRYATALYSAASKEKKLDQVEKELLRVRELLKDPKVSLAVLNPYIKRTVKVKSLNDITKREKFSPLTANLMNLLAENGRLGNTQGIISAFSTIMSVHRGEVPCTVTTASPLDDAVLSELKTVLKSFLSPNQILKLEIKTDPSIMGGMIVRIGEKYVDMSAKSKIQKLSKAMREML

SEQ ID NO: 1016724 - protein, 308 aa, Homo sapiens
RAGSRAHRRHRVYKLVEDTKHRPKENLELILTQRGGEFLKSVGDLVFSWKKIFRPEIDSFPQGLAVYASPENKKLCEEEKWLRQEGQSEKIQTKAGEATVKSLKSCPPGGRDEGHNCSNWELNPEDSVPAILIRILAGEWYAPAYVKVTSRDYHTVGRTYRCAGDRYNWAVNCEQWPMSVVNFETAKSRRDERSVKAQERLPKGHGPQASPPDQKASLAFQGQHNADSRAAGGEKRKGLDHNPGRTESMKEMEDYDGAETGTPTGLTGNGRGGTGRGRTHEQADRGQREEAGKDEPQTSAKKTAAYRE

SEQ ID NO: 1016725 - protein, 84 aa, Homo sapiens
SLTLDWSSSVVVPRRHVCPDATAAEELTGSARRLMVPGSRSTRKPARDKLGVLDITIGLTSCFVCCLLPAGWVLSHLESYKKRE

SEQ ID NO: 1016726 - protein, 593 aa, Homo sapiens; identical to SEQ ID NO: 829663

SEQ ID NO: 1016727 - protein, 61 aa, Homo sapiens
ADQHMRLQTAPYEGGKREPEKVVDPFSRKIGIIVKAPPMFQYKKYWKAVRQPGPRNQIASM

SEQ ID NO: 1016728 - protein, 70 aa, Homo sapiens
MDRRNDYGYRVPLFQSKHLNGDERSGSNYRRIPERQPPRDVAILQRANKLVRYLLVKDQKIPIKRSDMLR

SEQ ID NO: 1016729 - protein, 172 aa, Homo sapiens
RLLDSRRRGSPVTRPPRKMDRRNDYGYRVPLFQGPLPPPGSLGLPFPPDIQTETTEEDSVLLMHTLLAATKDSLAMDPPVVNRPKKSKTKKAPIKTITKAAPAAPPVPAANEIATNKPKITWQALNLPVITQIKPGFTYHWGNQYFKAFLVTGPKGHMKKRYWPKPQFPTGP

SEQ ID NO: 1016730 - protein, 306 aa, Homo sapiens
MASSGSVQQLPLVLLMLLLASAARARLYFRSGQTCYHPIRGDQLALLGRRTYPRPHEYLSPADLPKNWDWRNVNGVNYASVTRNQHIPQYCGSCWAHGSTSAMADRINIKRKGAWPSILLSVQNVIDCGNAGSCEGGNDLPVWEYAHKHGIPDETCNNYQAKDQDCDKFNQCGTCTEFKECHTIQNYTLWRVGDYGSLSGREKMMAEIYANGPISCGIMATEMMSNYTGGIYAEHQDQAVINHIISVAGWGVSNDGIEYWIVRNSWGEPWGEKGWMRIVTSTYKGGTGDSYNLAIESACTFGDPIV

SEQ ID NO: 1016731 - protein, 143 aa, Homo sapiens
SGASACVFQHEEESWPGGQHEVSGGLLVPAGLAWGPPMLTQDFQSETACWGLQKSLYQEGPPRGHFGCVNAIEFSNNGRPVGWSQEEIDLPGVLLMGPLGTNAHPTPRVKAHNSKRTTISNIFLAFNIGNTKFSGGDEQFNPP

SEQ ID NO: 1016732 - protein, 123 aa, Homo sapiens
PRIEKILKVKIMDWRPRHLTRWNRYCTSTLRHFLPLLEKSQGEDVEDDHRAELLKQLGDYRFSGFPLHMPYSEVKPLIDAVYSTGVHNIDVPNVEFALAVYIHPYPKNVLSVWIYVASLIRNR

SEQ ID NO: 1016733 - protein, 250 aa, Homo sapiens
MGDQALSFLKDFLAGGIAAAVSKTCGAQIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGSSQREFNGLGDCLTKIFKSDGLKGLYQGFSVSVQAIIIYRAAYFGVYDTAKGMLADPKNVHIIVSWMIAQSVTAVAGLVSNPFDTGRRRMMMQSGRKGADIM

SEQ ID NO: 1016734 - protein, 180 aa, Homo sapiens
HRARFRAVRLAPPSPAVTMIIYRDLISHDELFSDIYKIREIADGLLLEVEGKMVSRTEGAIDDSLIGGNASAEGPEGEGTESTVVTGVDIVMNHHFTRNQLHKRGFTKSYIQRLTLKSTSKGKLGRSRNPERVKAFYDWSCRADLSTSLLIFNNYQFFYLVNMDPDGYGLLSLDYRLKMV

SEQ ID NO: 1016735 - protein, 313 aa, Homo sapiens
MPVPRCSYRPARTAPAGTPGAPSLAGMAFVKEEETEAVIGAPPTATVGPEDQSCAYGSWEGPGAEGPRWGLTLVAAPAQGLEGVAPEGYLSPQVVARGALDDSATHLQCLPEAQAIWLLCNQCESWCHLDCHLPALQDVPGEEWSCSLCHVLPDLKEEDGSLSLDGADSTGVVAKLSPANQRKCERVLLGPIPPHHTPPPPPPPRPPPPPPSPPPPPSPPPPPRLQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 1016736 - protein, 304 aa, Homo sapiens
PALKKPLVCPNLYWGVVNVDGCKELLRGLLAINELPFRDCTCIYYLVSLFEVCIKDSAWKSFPTDADAFQHVTPQLVEDKLMLHGPRSFCLIGDDTPKVRMGTPEVGHQLVQILSEKGRPCEKRALFLTPTPWWPHPPVPHDMVFTSVDLIKTSPVQQKKKKKKKKHRADEQEHEGHRQNTNNWLRPRALSRPSKEGALPTPTEPGRARSATNWSRRRTLGRANRSSSQQTSGEKKRGEVPPKIKSTPGGRNDVVEQTPRGDSRGTTRGHTTERKRGDKKNQPCGTTSATQQHTSERTQPHGDG

SEQ ID NO: 1016737 - protein, 317 aa, Homo sapiens
MPVPRCSYRPARTAPAGTPGAPSLAGMAFVKEEETEAVIGAPPTATVGPEDQSCAYGSWEGPGAEGPRWGLTLVAAPAQGLEGVAPEGYLSPQVVARGALDDSATHLQCLPEAQAIWLLCNQCESWCHLDCHLPALQDVPGEEWSCSLCHVLPDLKEEDGSLSLDGADSTGVVAKLSPANQRKCERVLLGPILSRSLPPPASAGYRLHLLLEQPGGNLDLTRDPVTRAAQEKLSPPYSSPQEFAQDVGRMFKQFNKLTEDKADVQSIIGLQRFFETRMNEAFGDTKFSAVLVEPPPMSLPGAGLSSQELSGGPGDGP

SEQ ID NO: 1016738 - protein, 203 aa, Homo sapiens
IPQEWESGHQGVGHQEWSQATREWGWGDSHSLVAPSPSSSRYGFYFCGFNKNFTSSTKKKKKKKKTQGGRTRARRTQTEHKQLVAAARVKPPLQRRCSPNTHRTGEGEERHKLERRRTLGRANRSSSQQTSGEKKRGEVPPKIKSTPGGRNDVVEQTPRGDSRGTTRGHTTERKRGDKKNQPCGTTSATQQHTSERTQPHGDG

SEQ ID NO: 1016739 - protein, 297 aa, Homo sapiens
GFIEWLRERAVLTGEPQPIEFTDRVVAVVRYRDGSVIDVVHQVKEEAMHLLPELASHHAVSIPELLVSRDERQARQHVWLKRHPVSTGSPFNRGLRLGPIKDSEVTRRIFNHGVTALRALSRKTGLANSGAGCTGFRQRAGGHVEHCRPGSRLKLATIELEHSHPLGRLWDIDVLTPEGENSLPPDYSLPPRRCCCANKAQRLRAWKNHQLTDLLNRMEALLKRMSECLETINKEHKSLRRTFQSMSTPWWDWAAPADWKQPVPRTRLGIALTARRTRSWRGRFNEGADITGITGTD

SEQ ID NO: 1016740 - protein, 265 aa, Homo sapiens
FRGTTPSKKEDHHQEVGVLLLRDLHLQDQFACSSGMGRNELLYHVEEIRYGGRPRRERAALSEQMSICPQEMMGIYVTDSYSSRDDPSARDTRDYAPPPRDYTYRDYGHSSSRDDYPSRGYSDRDGYGRDRDYSDHPSGGSYRDSYESYGNSRKCSDPTKKGPAPLLMDGKQVDYDDYTQLTVTDMVEVEDKLTQAARSDLYFKWSVIRVGQPRTEVLRTFYGKGVPTLHVDYRNRKYQAVENREVVGRGGSRSDRGGRQKQILD

SEQ ID NO: 1016741 - protein, 103 aa, Homo sapiens
MSFCHVNGLCYLSGGNCVEARREMTILYSSSTLEEDQDGERLSAVKSSDLINKMDLQRAAIILGYRTQGVIAQRKSLRCCLSCAVLGTKARLVLTVSSECKAF

SEQ ID NO: 1016742 - protein, 155 aa, Homo sapiens
VSSSSGLACSLLSRTFLLQQNGIRHGSYTASRKHIYIDKNTKIICQGFTGKQGTFHSQQALEYGTKLVGGTTPGKGGQKHLGLPSFNTVKEAKEKTGATASVIYVPPPFAAAAINEAIDAEIPLVVCITEGIPAAGYGAGQAQTDTPGNDEANAN

SEQ ID NO: 1016743 - protein, 132 aa, Homo sapiens
TEGAKDFTGGNASPEGPEGEGTESTVVTGVDIVMNHHLQETSFTKEASKKYIKDYMKSLKGKLEEQKPERVKPFMTGAAEQIKHILANFNNYQFFIGENMNPDGMVALLDYREDGVTPFMIFFKDGLEMEKC

SEQ ID NO: 1016744 - protein, 87 aa, Homo sapiens
LPQTLSTSHRHCPPPTDTIHLPQTLPTSHRHCPPPTDTVHLPQTLSTSHRHCPPPTDTIHLPQTLSTSRHPPPTDTVHLPQTLSTSH

SEQ ID NO: 1016745 - protein, 283 aa, Homo sapiens
GFLSLLLRGPRRFLSPVPGGLPTQSVQGNVINNMEQGSRTHLSTRLAAARLHPPSGKTRSSLANFEVLRMNPACQACKGDPKSTERRSRVFCLPKDELAVKELGFQRLLRCRAVFGEAVLCSHERFCNPMPVAKVQDRRGDLNRYYGPDQSGLRKLEGAEAQRPSNTSARGNWACAHGGRTGPTAVLGAHGSGLCSLTGLSIALDSAAAWTGPQRLPDKPTDGLQTHMHFAEGMSGQSRLPLGVLGDALHQTCPEVTAEKTKGIRPHAARQKYPLVSIREELQ

SEQ ID NO: 1016746 - protein, 173 aa, Homo sapiens
DFGLSRVLEDDPEAAYTTRGGKIPIRWTSPEAIAYRKFTSASDVWSYGIVLWEVMSYGERPYWEMSNQDVIKAVDEGLSLANLPLGFAQLAFVISLMVGLAWQEKDQGTTDPKFRSKIVSILGQTHPGIQASLKIITSAAARPSNLLLDQSVDIATFHTTGDWLNGMRTAPVR

SEQ ID NO: 1016747 - protein, 170 aa, Homo sapiens
SVVLTFTTPETDIMVHLTDAEKAAVSGLWGKVNADEVGGEALGRLLVVYPWTQRYFDSFGDLSSASAIMGNAKVKAHGKKVITAFNDGLNHLDSLKGTFASLSELHCDKLHVDPENFRLLGNMIVIVLGPPPWARISPPLHKLAFQKGWWLGVAACPGSQVPLNPLSCSC

SEQ ID NO: 1016748 - protein, 236 aa, Homo sapiens
MHANNTSRFRQLSILVHPDKQSRCMLTAAPTRLFEAVDNTLTSCYLDSGRKQTDGPCDVIHGTDTEYVEPAPVKEGDKNKPYLTERTRTQPSNLVRRNGLIPDDWFNQPTLALLQPGPTEYLLLARRLAHLSRLGHDDDDTPTTTIALTHGNTDPTRPRPDASQAHSQTPAAHHAATIDAGGQQTTITLCLVTCSDTLALVLRPLLASWKRSHNVHIANRCECTTSRRSTLREPVP

SEQ ID NO: 1016749 - protein, 72 aa, Homo sapiens
LPGKDQDYFIIPVITFEKSFTVTELRTMIYKDVPENLHKMAEHNLLLHLRKLEKDGKIFYTTTPVKKWKAVL

SEQ ID NO: 1016750 - protein, 76 aa, Homo sapiens
MAYYADGSKEGLLALLEFAEEKMKVNYVFICFRKGREDKSSTPEDFSFLGFEIVLSRPSLCPLSARCDVHGYPLDQ

SEQ ID NO: 1016751 - protein, 71 aa, Homo sapiens
MGATEGLLALLEFAEEKMKVNYVFICFRKGREDKSSTPEDFSFLGFEIVLSRPSLCPLSARCDVHGYPLDQ

SEQ ID NO: 1016752 - protein, 111 aa, Homo sapiens
LNLATFCKKRCLDSFPSGLLKMSILCLSVLNPRGRSHGAYRCTQGQQPVGREVLPAWEHLQPAASSLSLHSGPDRKCSVFLYPTPGLLEWWANTCELVFWGKGLSLRPFRS

SEQ ID NO: 1016753 - protein, 81 aa, Homo sapiens
MDLAAAREACTCRLQRQVFDWVMLRRTAGSPMHMSLALRAHTQSPSPGLPGRADRVQTAATPGPERTVVPVAASLRPPCCG

SEQ ID NO: 1016754 - protein, 79 aa, Homo sapiens
APVSGFRCRLVLLCACLFAARWLGPAPLPLVPCPSRGDSTQSPSPGLPGRADRVQTAATPGPERTVVPVAASLRPPCCG

SEQ ID NO: 1016755 - protein, 114 aa, Homo sapiens
FLQRIEQLSSRVVRVLGCNPGPMTLQGTNTYLVGTGSRRILIDTGEPSVPEYISCLKQALVEFDTAIQEILVTHWHSDQSWKALYDNFVKTSINDTTYCIKKLRPESPRGERNY

SEQ ID NO: 1016756 - protein, 67 aa, Homo sapiens
NGRAKKGRGHVQPIRCTNCARCVPKDKAIKKFVIRNIVEAAAVRDISEGTSSTPTCFPSSMSSCIIA

SEQ ID NO: 1016757 - protein, 154 aa, Homo sapiens
MTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPFRATQKTYFRNNYNYVIRAVK

SEQ ID NO: 1016758 - protein, 183 aa, Homo sapiens
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPI

SEQ ID NO: 1016759 - protein, 136 aa, Homo sapiens
RLHALSYGVRDQAILALHVLLFLCVGGRKKILIKHVTVIGGGLMGAGIAQVAAATGHTVVLVDQTEDILAKSKKGIEESLKRMAKKKFTENPKAGDEFVEKTLSCLSTSTDAGIRGFTAKNLVVEAIVENLKLKNE

SEQ ID NO: 1016760 - protein, 87 aa, Homo sapiens
MAGASLGARFYRQIKRHPGIIPMIGLICLGMGSAALYLLRLALRSPDVCWDRKNNPEPWNRLSPNDQYKFLAVSTDYKKLKKDRPDF

SEQ ID NO: 1016761 - protein, 114 aa, Homo sapiens
MQATASQPIHFFHSSPQAPRHHSGHPVPLLLTQAGFPRRGEAAPPLLSSLAPSSGSASDPWLESHVGEEEAGSTSRGPPRAQTSPSALLPGPRRVWHRLRVERGLREPTRSRGL

SEQ ID NO: 1016762 - protein, 176 aa, Homo sapiens
MAGASLGARFYRQIKRHPGIIPMIGLICLGMGSAALYLLRLALRSPDVWKRHGLELTGAWVRQDGVEIGGPSGDPVPCCMHLRLYRPASTGLEPTAALGDPRIPSSPPGGSLLSLARPEMRTRASPGLVAMTTPLSQRWDRKNNPEPWNRLSPNDQYKFLAVSTDYKKLKKDRPDF

SEQ ID NO: 1016763 - protein, 114 aa, Homo sapiens; identical to SEQ ID NO: 1016761

SEQ ID NO: 1016764 - protein, 214 aa, Homo sapiens
YISNSARGAMVIKTGRAAAKQLVGYIMANADDHPATSATQHGSPCDLVASQSPVLLVEIIRLQEPSCRSKIEVATYAYLLTLTSSKGHLSAILAIKGKLSNSEVKRIRSILDVQHGGAGALPAPIFPYKAQGRRERDSAMVEWKTELEEKEGKDELSSGRGFEGPVASCEHRQRYDVTSGGPRPYRLPCNWGPEPSLFIPQGSTRGWSPRAGVY

SEQ ID NO: 1016765 - protein, 127 aa, Homo sapiens
IPGHLCPEPLHSRPHDCPPRGMARALFSSLETGPSLTHLPSAPRAAVSGIQQWWNGRQNWKRKNGKDELSSGRGFEGPVASCEHRQRYDVTSGGPRPYRLPCNWGPEPSLFIPQGSTRGWSPRAGVY

SEQ ID NO: 1016766 - protein, 298 aa, Homo sapiens
SGTRLCCQNPVTSVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESSE

SEQ ID NO: 1016767 - protein, 126 aa, Homo sapiens
STGAKALKVIPRAERGSSNGMAFRFLPPNVSVVDLTCPPGETCPSMMTFKKVVKQASEGPLKGILGYTEDQVVSCDFNSNSHSSTFDAGAGIALNDNFVKLISWYDNEYGYSNRVVDLIAYMASKE

SEQ ID NO: 1016768 - protein, 75 aa, Homo sapiens
MLVEAYGNQTEVARRLKCSRGTVRKHVDDKDGKMHAILTTFSWFIADGVKEMRYYEKIDGSKYRNIWVVGDLHGC

SEQ ID NO: 1016769 - protein, 135 aa, Homo sapiens
MVKVGVNGFGRIGRLVTRAAICSGKVWRFVAINDPFIDLNYMVYMFQYDSTQGKFNGTVKAENGKLVINGKPSPSSRSETPLTSNGVKAGAEYVVESTGVFTTMEKAGAHLKGGKKVIISAPSAVPPWFVIGFNH

SEQ ID NO: 1016770 - protein, 103 aa, Homo sapiens
RASRKFATSAEQGRVERGVRWYGHFFRLPCLRPSQNFQQRHVGPEYPEFTTSVVRRSHYEEGPGKNLPFSVENKWRLLAMMTVYFGSGFAAPFFIVRHQLLKK

SEQ ID NO: 1016771 - protein, 125 aa, Homo sapiens
FITRKKLGVDFVNRGVIFPVGNKDAVEGHIRHRATRRLDHLADSFQNVAGLRLWVIGKQHVIMLIKSQRTGDIHHAISQRAGNEGGQRCAACQRGIIYGILGIVKLLKAILSKGRGRARRRMFRR

SEQ ID NO: 1016772 - protein, 114 aa, Homo sapiens
PSGVVHWWSCGDEMLHHIGLLVKETAPAAADGTVITGGIRYQKYPTHPLNSGADSYRSPGLHCPDDRIAVRQTCPAITFIQRIVPRHAVYGAVATVLHVIANPTTVTEGSEIDR

SEQ ID NO: 1016773 - protein, 77 aa, Homo sapiens
NNRAKMLRNLLALRQIAQRTISTTSRRHFENKVPEKQKLFQEDNGMPVHLKGGASDALLYRATMALTLGGTAMPSIC

SEQ ID NO: 1016774 - protein, 47 aa, Homo sapiens
MAKLPLLPPRGPCGGMNASARLAASRGPGWGVYNTSPPRLLLSSSGT

SEQ ID NO: 1016775 - protein, 196 aa, Homo sapiens
GLPHAPQVAPPPAAQSALRQQQLPDKRRAAEMTAEEMKATESGAQSARMPMEGVDISPKQDEGVLKVIKREGTGTEMPMIGDRVFVHYTGWLWSGTKLLAPVWDRRDKFLLLTCGTRGGHSRLGTLAIATHEGGGRWCHITPAKPEYAYRFKPGQSSKDSPQMPRLYNEVRACTEFNGRTIVPRNEEDGGKSFRRT

SEQ ID NO: 1016776 - protein, 143 aa, Homo sapiens
LLSTEITARELLLCKLIPYYFLGMLAMLLCMLVSVFIHRRAVSRVAADSVFYLQPVSTQYPGDGAADFHDYPQPVQCRSGRPERRFSAVDYAFRLYFSDRQYAPVIRAVDVHSSRSLFRQHPAKPVPRREYSSGAGGFIFEQI

SEQ ID NO: 1016777 - protein, 730 aa, Homo sapiens
HSSPGLTQTMHFPKSSTASGRSEESRTSHSSTTHTISSPPSTTSALVEERTSYYSSPGSIATTHFPESSTTSGRSEESTASHSSPDTNGITPLPAHFTTSGRIAESTTFYISPGSMETTLASTTTTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLIEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 1016778 - protein, 579 aa, Homo sapiens
MTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 1016779 - protein, 87 aa, Homo sapiens
PLHSDLTPESRLNARSSVAPASTPACGGLLLRSLLFRGPAGGSPDQNLRESRFGLENAYNNFRPTLETVDSGTELHIQRPEMVASTV

SEQ ID NO: 1016780 - protein, 596 aa, Homo sapiens
DLEDPADSRKNTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 1016781 - protein, 705 aa, Homo sapiens
HSSPGLTQTMHFPKSSTASGRSEESRTSHSSTTHTISSPPSTTSALVEERTSYYSSPGSIATTHFPESSTTSGRSEESTASHSSPDTNGITPLPAHFTTSGRIAESTTFYISPGSMETTLASTTTTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLIEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHRDQNLRESRFGLENAYNNFRPTLETVDSGTELHIQRPEMVASTV

SEQ ID NO: 1016782 - protein, 191 aa, Homo sapiens
RVPAHSSDEKWRGLLSWWSLTLHGTRSSRWHREPGLGLRHSPRRLSGALHLEAGCDRNATTVRPLRAKARGRSAVRRSGSPLCEMRSGLFESAVQENISINGQAWKEASDNCLMEFVTVKATLKISLDESSSIDIASKDVSQYPSERSCECVFNEHNKENYEILERSDLALCVTSHLDLNNSDPDAKSLIW

SEQ ID NO: 1016783 - protein, 206 aa, Homo sapiens
SRREIGSTPTPGSSSSNTFGSPTRVQARPSFCFIPPESLPASVPVNGPRDVNSSRRAKVCLRASPVTLRKSAYRFEVLPFTVRSFITDQISAGILTEHGVKARRSFLIGSKPITVALPLSGFSNPANIRISVVLPAPPAPPTPSHNRREWYNRAADGGLVHARKPFSQAVHRDNGIIHVLPRHRIVPSLHSLRNASSASVTTIRRR

SEQ ID NO: 1016784 - protein, 145 aa, Homo sapiens
ITPGTVLIILLGATGAKRVVFLKQLDSGLLLVTGPLVINRVPLRRTHQKFVIANLLQKVDISDVKIPKHLTDAYFKKKARKPRHQEGEIFDTEKEKYEITEQRKADQKAVDLQILPKIKAVPQLQGYLRSQFSLTNGMYPHKLVF

SEQ ID NO: 1016785 - protein, 187 aa, Homo sapiens
MEEHYVAAVYRVELSNGDKNDVANRGPPPSVGVVALEMIIVGGVLHLVADSPSCLFSAPSESALASQLALSASLVTSGGPFSLAGVVSHDPVLGKSVTVAQTLGSRACCNSQPSLQLNQIGSTAPRPTHKFWQTAHLIIYHIVSHNNHSTRLPRNNKHEQITKTPFASQLNPRTFSYKLDTKSPGPT

SEQ ID NO: 1016786 - protein, 129 aa, Homo sapiens
MEEHYVAAVYRVELSNGDKNDVANRGPPPSVGVVALEMIIVGGVLHLVADLQEGEASLAAGAGPFLEIGEERDRCLGREITSRPDPSSRSRSRSRSNEREMEEQFAGEVVYRTLLHFDQEYVPENSSFV

SEQ ID NO: 1016787 - protein, 134 aa, Homo sapiens
QHPNSTGSGNSPPSSSLTPPSHVNLSPNTVPEFSYSSSEDEFYDADEFHQSGSSPKRLIDSSGSASVLTHSSSGNSLKRPDTTESLNSSMSNGTSDADLFDSHDDRDDDGEAGSVEEHKSVIMHLLSQVRLGMD

SEQ ID NO: 1016788 - protein, 177 aa, Homo sapiens
RSLQRWQNVGFQSADLIGKRAISTSVCLRAHGSVVKSEDYAFPNLRLIGVTTPCLMWPHVTMLSASQKRLKEKEKADWSSLSRDEKVQLYRIQFNESFAEMNRGTNEWKTVVGMAMFFIGFTALVLIWEKSYVYGPIPHTFDRDWVAMQTKRMLDMKANPIQGFSAKWDYDKNEWKK

SEQ ID NO: 1016789 - protein, 274 aa, Homo sapiens
SGAPTPDAAWHQAQPPLPHFPLVLITSQPRAAGSPERTAAARQPLAAPEQSGSGRKLLGSALSGVPSALCSVFLSAWEEEEEEEEEEEEEEEEEEEEEEEDVWSRLGGGAAAAAAAAAPPPLPPPPERERQESPRLGNPKVSATLHGRLPSSFMGKVWKQQMYPQYATYYYPQYLQAKQSLVPAHTPWPLPVPSSTSSNNNSSSSSNSGWDQLSKNETLYSEDCLPKTNDQELEKTLNNHMGKIVSTKARKDKTTNKCKGYGKVDYDSPAAAQQ

SEQ ID NO: 1016790 - protein, 123 aa, Homo sapiens
FENHGVGTSGVRSGRVDASAIAVEPCDLYGRFLIPRYPPGRLSEYLRRVQIEAAQCPDVVVAQIDPKKLTKEAKCEYFSFRMPTLPLQVIPQHFNVQQQQVAQFSLFDMNVNNMKSLEITTVG

SEQ ID NO: 1016791 - protein, 317 aa, Homo sapiens [sequence omitted]

SEQ ID NO: 1016792 - protein, 324 aa, Homo sapiens
GGSRCGAWLSELSGAILVAAATLASTAAMTEQMTLRGTLKGHNGWVTQIATTPQFPDMILSASRDKTIIMWKLTRDETNYGIPQRALRGHSHFVSDVVISSDGQFALSGSWDGTLRLWDLTTGTTTRRFVGHTKDVLSVAFSSDNRQIVSGSRDKTIKLWNTLGVCKYTVQDESHSEWVSCVRFSPNSSNPIIVSCGWDKLVKVWNLANCKLKTNHIGHTGYLNTVTVSPDGSLCASGGKDGQAMLWDLNEGKHLYTLDGGDIINALCFSPSIVDELKQEVISTSSKAEPPQCTSLAWSADGQTLFAGYTDNLVRVWQVTIGTR

SEQ ID NO: 1016793 - protein, 284 aa, Homo sapiens
THDLQEMKEESRQMMREKKVTILELFRSPAYRQPILIAVDAAGDPRQTDLAVNSWSSSVLPTTRSLEKAGGACEPCVMPASRHPDIVSDRAIQLLQVSPDIDEWKLSRAVLDPDSLSRAFLGIGVDCRHSFMSHRAYATCSETDKPVDVPLDHACATLGLSVASLWNVGSCAPLPLDSVVGLNLFRPGSTVHADYCQLAGFQSKLDSQEFHSRAVLRSQICGSKVMWNPYDLSSVFHLVHPWVPDSYHYCYLTFKRFLEQRSGRNLRIEDRFRVPGKGGSQSKS

SEQ ID NO: 1016794 - protein, 161 aa, Homo sapiens
VGVVNPILASPPTLGLLEPKEKEEEELFPESERPEMLSEQEHMSISGSSARHMVMQKLLRKQESTVMVLRNMVDPKDIDDDLEGEVTEECGKFGAVNRVIIYQEKQGEEEDAEIIVKIFVEFSMASETHKPSSLNGRWFGGRKVVAEVYDQERFDNSDLSA

SEQ ID NO: 1016795 - protein, 99 aa, Homo sapiens
KRRPEKSQGHEHREAMPFLDIQKRFGLNIDRWLTIQSGEQPYKMAGRCHAFEKEWIECAHGIGYTRAEKECKIEYDDFVECLLRQKTMRRAGTHQEAAG

SEQ ID NO: 1016796 - protein, 99 aa, Homo sapiens; identical to SEQ ID NO: 1016795

SEQ ID NO: 1016797 - protein, 192 aa, Homo sapiens
AGNFPRSFAEIVRLFPQPLLAVIEVLRIVNKVAPVNLRRPEDFFIAIPGKHQVILRLCHRNTRFRLHQGNLIRLVIQFAQHLARFDSITFVHRQRFNGPPNTETKIYRTNIHGAIQRQAVILAALIPPVASATTAASTTTANPITTGFFITTNSFAIILAKSGRYDKVTVWLTVRSFFIDVPVRNRIVSLQG

SEQ ID NO: 1016798 - protein, 136 aa, Homo sapiens
RIPYVSMLGVVGEWARQHVAQVWNESLDQVEAEGSALQAGEKDESKGQVQAQNVWKAFLVRDCQFGDVDSGKQGDRGQQSELSCCPQSRLHCPEAKRYHQAADNWQVRKKCHSSLDNRVRPHLLRKRKKQHQNCAP

SEQ ID NO: 1016799 - protein, 102 aa, Homo sapiens
QSPMHRECGFIRLKPDTNSGLCQCPEPQGLWKVEEGEVNGQELCVSSHSVSRISFAKEPHVEQITRKFRLNSEGKLEQTVSMATTTQPMTQHLHITYKKVTP

SEQ ID NO: 1016800 - protein, 112 aa, Homo sapiens
MSLEVYVVSTVVLLRDHKYVIWREVWKSVLQHPGRLIDFLECGKTNPEKDNPTLSLDEADRDALKWALNPNYSKIVDSNTAPDRQTLMWSATWPKEVRQLAEDFLKDYIHIN

SEQ ID NO: 1016801 - protein, 459 aa, Homo sapiens
ADPSFARQPARTTMATVQQLEGRWRLAGTATGFAGYTDTELASWELALAKTLAALAKPDLYHSTVLTGYKTVTTNTHLQQPPLANSKHSFFLCYPCARATLCNEDHQPDWHATNLTTLLLHTSYQHCVHSGLHAIQARWRLGDRDTANKITNGHTLCTHDLGAQLYACAGTLAAPMQPNWSTRAHLGALPTCNNTRYRHLTPTSQLNLQPSLRTTGTALNFYTEGHVERQRPSTALNRWKPTSFLRRLACTIQSLRSSHRAPRATTTLGWLLPQPPSSFTILQITHRTSLRTKVANAPYLFPHKPAWLRELLPSHAHSNSPYGGLLHTSHNLTRGAFKTAPTLNQPPDAHHQNQHDHATHTDSGARTRASTTTRRTHPHNTRGAAPTTPEARPPDHQGGPPHTPPHSATTTDTYNCAHTPGRATTEDHRAPLSKQQAQPTARPHATNTNPQHKRQQTPR

SEQ ID NO: 1016802 - protein, 144 aa, Homo sapiens
KDGRGAGNHWLVDDRGFLYHHQGVYFLHHPGCVRLSLEITLTSVFKKKGQMQWLMPVILALWKAGAGGSPGVGSSEPAWPTGRNPVSAKGARISQAWWWAPITPATWGLGQENCLNLGGRGCSEPRPLCCTPAWATRVKLCLKK

SEQ ID NO: 1016803 - protein, 283 aa, Homo sapiens
MGRLNHGARRSSSAIGGPQRLGPAQARYGLTEPDTAPLPGSRNSRAPGAAGAGLGGRKRRPLREPAGPSLNPTLAATAALIPLHRRAGDIRPGPLPGGSDAPSQLPVQETRPRLCAGQLKGTTTPRRIEGDREAAGVDRGKAGLGLGGRPPPQPPREERAQQLLDAVEQRQRQLLDTIAACEEMLPAAWAAGARSLAGGGNVSAKPGAPPQPAVSARGGFPKDAGRWSLREPLTIPEQTSPDFSRSPGPVPGPLNNFPSSKKGPGLHWQWLVPWLSALSGSSA

SEQ ID NO: 1016804 - protein, 196 aa, Homo sapiens
GRGRSLLNALTQRWEWVAGRKGGGGRAAQAEMEWCALGSDWSRGEAAGVDRGKAGLGLGGRPPPQPPREERAQQLLDAVEQRQRQLLDTIAACEEMLPARLGRRRPEPGWWRERLSQTWSAPPAGCLRQKAAFQRIAGRWSLREPLTIPEQTSPDFSRSPGPVPGPLNNFPSSKKGPGLHWQWLVPWLSALSGSSA

SEQ ID NO: 1016805 - protein, 75 aa, Homo sapiens
IAYRGLFIIDAKGVLRQITVNDLPVGRSVDGALRLVQAFQYTDEHGEVCPACWKPGSDTIKPNVDDSKEYFSKHN

SEQ ID NO: 1016806 - protein, 217 aa, Homo sapiens
SGGAAAGSGAQSSGGRRRTRGNSGSSPGGGSNSGGGIGPSRRPPSQPSPTRGSPSSLHLAPLVPLARPGAALCFISLILQRQDPAPGTEQPTPWGRGLDVISMSLQLFTEQGDKKGKKGKKDRDMDELKKEVSMDDHKLSLDELHRKYGTDLSRGLTSARAAEILARDGPQKTLNSTLPTYSMKWITVCRQLFGGSPMLLWIGANLVSWLIASKLLH

SEQ ID NO: 1016807 - protein, 205 aa, Homo sapiens
SGGAAAGSGAQSSGGRRRTRGNSGSSPGGGSNSGGGIGPSRRPPSHLADYPYAPAVADALCFISLILQRQDPAPGTEQPTPWGRGLDVISMSLQLFTEQGDKKGKKGKKDRDMDELKKEVSMDDHKLSLDELHRKYGTDLSRGLTSARAAEILARDGPQKTLNSTLPTYSMKWITVCRQLFGGSPMLLWIGANLVSWLIASKLLH

SEQ ID NO: 1016808 - protein, 221 aa, Homo sapiens
MSKMLTEEFEWIAYRRVNNTLSSQKLAVYRISGIPWKRRGNLAEAKRVAHVENTERLIERSHPENLRKQKSRCCQVCRVDSARIYEGDPDKPGLFGQKRLESLLNVINRKLMTCSSGKDSQMMTSTEAYNLRVVRTRQEKIKQHLRLKSLIGSMNKRRTSHQDLEKQAARVHEEAKRAGDKAVEIYASCGSAEPVGTLRHLENEANNMKMEAGNRNNDDQN

SEQ ID NO: 1016809 - protein, 166 aa, Homo sapiens
GEKAPDTKEKKPAAKKAGSDAAASLAPAPKVAKKVHPKGKKPKKANPIAAETLSLVRGIGRYSRSAMYSRKALYKRKYSAAKTKVEKKKKKEKVLATCHQNSWLGTKNGGTRVVKLRKMPRYLSHPEDCFLGNLLEATAKKALSGQHVKKGYAPSITSRNCPDYPH

SEQ ID NO: 1016810 - protein, 318 aa, Homo sapiens
MSSLPGSREPLLRVAVTGGTHGNEMCGVYLARYWLQNPGELQRPSFSAMPVLANPAATAACCRYLDRDLNRSCTLTFLGSTATPDDPYEVKRARELNQLLGPKGTGQAFDFTLDLHNTTANTGVCLISESNISFNLHLCHYLQRQNPGMPCRLFLYEPAGTETFSVESISKNGICLEMGPQPQGVLRADLFSRMRALVASILDFIELFNQGMDLPAFEMDIYRNLGSVDFPRTADGDLAGTVHPQLQDHDFEPLRPGEPIFKLFSGEDVLYEGDSIVYPVFINEAAYYEKHVAFLKSEKIRVTVPALLRLTPRSTQTP

SEQ ID NO: 1016811 - protein, 318 aa, Homo sapiens; identical to SEQ ID NO: 1016810

SEQ ID NO: 1016812 - protein, 275 aa, Homo sapiens
ALANVIIMLCMTVWALYLIFRNKKEITQHLLNFAEHSLAFFSLFNAAFALVWHWLASAYFIVLFFFSLFDPGNSLKFMMGATVRSLAIIGIAAFVSGMFSRWLAKTITLSPHTQRNYPELQKRLNGWLSAALKTARILTVCVAVMLLLSAWGLFDFWNWLQNGAGQKTVDILIRIALILFFSAVGWTVLASLIENRLASDIHGRPLPSARTRTLLTLFRNALAVIISTITIMIVLSEIGVNIAPLLAGAGALGLAISFGSQTLVKDIITGVFIQF

SEQ ID NO: 1016813 - protein, 103 aa, Homo sapiens
TSTHLLRFWQQPLPAPGHRTTTCLETSSCIRLLITGRRPVSQPVWTPDRPVTLCSPLALCELLPVSWLSVQSPEWGGRYGGPPPPICEPSLPCPWPLDPGKGF

SEQ ID NO: 1016814 - protein, 137 aa, Homo sapiens
PFRKAGLLVGLLTRTQQRERFPKPTENCICPQLRPLQAISTKGPCPTNPQPPSGRGVFSHSEERREPRKGTGRKKKKSKACAIVITGFVLPRLPSPNPFKTSDLQSLKKPGPVARSKEARLGGKEAKPLGALPFQAL

SEQ ID NO: 1016815 - protein, 92 aa, Homo sapiens
FRGPSLQSRKNEDLKYEAMAKHLKFIARTVMVQEGNVEGAYRTLNRILTTDGLTEVISRRRYYEKPCRRRQRKSYETCRRSTTWKWLERLTS

SEQ ID NO: 1016816 - protein, 88 aa, Homo sapiens
FREPREATPLHRCLIAAASPRDEIFLTPNLSLPLWEWRPDWLEDMEVSHTQRLGRGMPPWPPDSQISSQRSQLHCRMPKAGASPVDYS

SEQ ID NO: 1016817 - protein, 88 aa, Homo sapiens; identical to SEQ ID NO: 1016816

SEQ ID NO: 1016818 - protein, 137 aa, Homo sapiens
TRIIDVVYNAIQPTEFVPHPRPLVKNCIVLYLTSTPYRQWYRVPLMHFPWARKKGAKLTPEEEEILNKKRSKKIQKKYDERKKNAKISSLLEEQFQQGKLLACIASRPGQCGRADGYVLEGKELEFYLRKIKARKGK

SEQ ID NO: 1016819 - protein, 184 aa, Homo sapiens
GAPEHLLASSRPEPANERKMADNFSLHDALSGSGNPNPQGWPGAWGNQPAGAGGYPGASYPGAYPGQAPPGLILDRHLQAPTLEHLELIPEHLHLESTQGHPAALGGLPNLLGTAKVPPEPTLPTGPYGGPVGPLICALYNLPLAGESGGLECVITNSGAAVKPHVQQNCFRFPKEGIDVGLPL

SEQ ID NO: 1016820 - protein, 134 aa, Homo sapiens
SPLPQPWGPPILRLGKAHPEVLLPSWWYQLPAVSTLPSPVAMGPCPLSRLSRGRQVLGIPSLQAEAGQLPSSAHRDTWHLLLMKKCTRHKCVHFPWDHRPSSALLKTKHKGLEEWTFPGPWHLPLSQLHCYLFM

SEQ ID NO: 1016821 - protein, 102 aa, Homo sapiens
KSEMGVKLEVFRMSLYLTFPVVMFWISNQAEWFEDYVVQRKRELWPREKEGQRQELEEFKQKIRKQKEERLLQSCQKAPETFSFLKSQGPFPNTENNTHSTL

SEQ ID NO: 1016822 - protein, 157 aa, Homo sapiens
MSLLTSCRWTMLDVKGKRVVHESRLQCSYDKNNQITNNQRIKAAVPSIKFCLDNGAKSVVLMSHLGRPDGVPNALTSSSLEPVSVELTSLLGQGMFCLFEVTVLRPMEVDNSCANPAAGSIHTCWRPPFHVEEEGGKGLLEQVKPPQNGASGSLPAR

SEQ ID NO: 1016823 - protein, 80 aa, Homo sapiens
SGIPVCLYPEFAGQRSLPSVLPLSHEHMVITGPASENVDNLGFFIYRLCHDKETYKLQRRETIRGIQKREASNCFTIRHI

SEQ ID NO: 1016824 - protein, 153 aa, Homo sapiens
DLPLLTKMNSLVSWQLLLFLCATHFGEPLEKVASVGNSRPTGQQLEFPCLLAPGEQSLPCTERKPAATARLSPPGNFVVPTPRELREPPAAGPVRPPQPPEFPHPRARCWCSGRRTCRTTTGTSSACASASGRRPQGTTAEALGGAEGAGAGQ

SEQ ID NO: 1016825 - protein, 75 aa, Homo sapiens
DEADDISDENQEKVNDQAKLIVGIVVGLLLAALVAGVVYWLYMKKSKTASKHVNKDLGNMEENKKLEENNHKTEA

SEQ ID NO: 1016826 - protein, 129 aa, Homo sapiens
MASGRWASPGPAWASRRPLQAQVVLKSASPGPVPASQQASSFGSAPAQLPPAFVDPELSPAKLLSPTSCLPVACTGPGLAGEQPLQAPLLPPRGVSRPSSGLTAASRDQVPACLPAACVRPSSSVTVAC

SEQ ID NO: 1016827 - protein, 304 aa, Homo sapiens
TGVDESGPSSLFVVSTCTQYLMTKGFTNILYRRCTIDDTLKKQLEKDFKSMEEVLPVIRIIAHTQMRLRSIYSQKKAHLMEIHGEWRHCVPEKLDWARERLEQQVPVNQVFGQDEMIDVIGVTKGKGYKGVTSRWHTKKLPRKTHRGLRKVACIGAWHPARVAFSVASSWDRQATITEQRLTSKIYKIGQGYLIKDGKLIKNNASTDYDLSDKSINPLGGFVHYGEVTNDFIMLKGCVVGTKKRVLTLRKSLLVQTKRRALEKIDLKFIDTTSKFGHGRFQTMEEKKAFMGPLKKDRIAKEEGA

SEQ ID NO: 1016828 - protein, 84 aa, Homo sapiens
GRISASEGDSRRSRLLVREFEAMQAWYSKLGEEWRSRRPEVALSSKTSVVEIERLGMEASSQKRNIGIFSFEADRIPELYSSGI

SEQ ID NO: 1016829 - protein, 212 aa, Homo sapiens
MAREITTELLCKGKERTDGRSGNTDTGLNEFQNSRVLNLVDSQSGERKRTSKKPTRSNMQRSTNAEGPPQDKKTAGPQHAKILNQISQEDGVVSSEGEPPFKDPCKEDQKRNQQKTPWKSEMVAVTSEGPPEPPRKKRAGADPTWMKVTEASHTIEMEGQRDEDLTTADQGSRGTGTQATQPEQPDQPSQDNSTRQPEAVANCSNAAKMCNS

SEQ ID NO: 1016830 - protein, 234 aa, Homo sapiens
MSFSISHFTLLNLIPEDLYRLSWLREITTELLCKGKERTDGRSGNTDTGLNEFQNSRVLNLVDSQSGERKRTSKKPTRSNMQRSTNAEGPPQDKKTAGPQHAKILNQISQEDGVVSSEGEPPFKDPCKEDQKRNQQKTPWKSEMVAVTSEGPPEPPRKKRAGADPTWMKVTEASHTIEMEGQRDEDLTTADQGSRGTGTQATQPEQPDQPSQDNSTRQPEAVANCSNAAKMCNS

SEQ ID NO: 1016831 - protein, 138 aa, Homo sapiens
RCGSEAPVFLLVLPQARTPDGIQLRVKSGRCICLRMPPKKQAQAGASKKAEQTKRREKIIEDKTSGGKNQRKEQTQQKVSSGPAHPFHVTIGVQTNFHVRRHQEVTACTTQIRKRADKKGKGLQGAKVRWYKLCSCWL

SEQ ID NO: 1016832 - protein, 87 aa, Homo sapiens
TDVLLSVTGEQYGRPISGQKEVHGMAQPSQNNYWKAMEGIFMKPSELLRAEVPSCRAVTLNTLSHCRHTVFVDICCCFTAGSLLQVL

SEQ ID NO: 1016833 - protein, 231 aa, Homo sapiens
MCHSRSCHPTMTILQAPTPAPSTIPGPRRASGPEIFTFDPLPEPAAAPAGAPASSRGHRKRSRRVLYPRVVRRQHDQSRNRTQPKGFSFCVLTIVFCQILMAEEGVPAPFASRGSAPKRRIPWVHPPRVVPASFEALKSLDLRSPRSTLVDLSTFLQQHPGRLSNCDSPRISPKKNPKNHKETPGVPGARERIPKWDFRGNVNSEHYSRRRHPVLEAGPRRTETEAHRDRG

SEQ ID NO: 1016834 - protein, 130 aa, Homo sapiens
SARGYFMEKLAFIPAAATNGFLGEAWRLQCCVDSAYEVIKLKGYTNWAIGLSVADLIESMLKNLSRIHPVSTMVKGMYGIENEVFLSLPCILNARGLTSVINQKLKDDEVAQLRKSADTLWDIQKDLKDL

SEQ ID NO: 1016835 - protein, 50 aa, Homo sapiens
MLHGQLNHTPFTPRSRAFYRCSDTVGGYVVCLAYWVTGVNSLCWARHLLY

SEQ ID NO: 1016836 - protein, 192 aa, Homo sapiens
PPPRRRHDGLASTPGSRAFWAARCRGIPLYWAPLAVVLKEPFGNWGIGAISSVVGAAWGIYITGSSIIWRSEGPPGFKTQEWSCIILSVRAVAILRSIGNLSLGNIGLSCATPQGPFGPFTTAGSMFGAGLTRKACLLVKLRWAGGHVGAPGRCSEPQPLVKDLIVEIFGSAIGLFGVIVAILQTSRVKMGD

SEQ ID NO: 1016837 - protein, 167 aa, Homo sapiens
AGAFDHPLFQGLVEFAQGLFGFAQGRDVPGHAEDFFRQAVTAHDRADVHVPPFQVAGQGVGGADKAGVATGLGGIHGGLGVEIALVLPEVGPRTAANRIEVADFHDLLAAFAHEGQAGVQVQHLDAVIDAGKHALSEGFTVSEARGGQITLARFRWAICIGALPDSA

SEQ ID NO: 1016838 - protein, 256 aa, Homo sapiens
PADFAVAPLPQRRRASSFLDKMATLKEKLIASVADDEAAVPNNKITVVGVGQVGMACAISILGKSLADELALVDVLEDKLKGEMMDLQHGSLFLQTPKIVADKDYSVTANSKIVVVTAGVRQQEGESRLNLVQRNVNVFKFIIPQIVKYSPDCTIIVVSNPVDILTYVTWKLSGLPKHRVIGSGCNLDSARFRYLMAEKLGIHPSSCHGWILGEHGDSSVAVWSGVNVAGVSLQELNPEMGTDNDSENWKEVHKMV

SEQ ID NO: 1016839 - protein, 137 aa, Homo sapiens
MAAMSLLRRVSVTAVAALSGRPLGTRLGFGGFLTRGFPKAAAPVRHSGDHGKRLFVIRPSRFYDRAFLGSSWRFYIGIDWGFHVAIFHNSGECIHVVKAELAEIPEGYVPEHWEYYKHPHINDGFARNFYDSPEKII

SEQ ID NO: 1016840 - protein, 442 aa, Homo sapiens
RIIVAIMETNPSILEVKRGRKVQPELDSGLQHPGVVPSDHEEPRPAGPTADSAQSMQGTLVQLSWGRQRPGLPKGQRVVERRGRKGSPRARGPQRMRVVAGPSISADLPGAQSFPALSQAGHERYTSVQQDGLESLSVQRCGVSPAVASLWWSLFPRAALLGRKEENRSLQGCCCLSHPHKYAGAVSPMLSRSCWLTGSQTLTSDMVVGEGRVGKAGAFPSSPYAARAIAQPDVVTSVQLWGLQAMWLFPRPSPRCSNPWGLLTTYGGRAGASGASTPTSGPGDDRCVALSPWAGWMPQAPLAPRCCFSTGAAWPGLLKATPSPRTSQARIQTSGTLFSSGCVSLRNRGSSPRVHVAGGRGPGKTHSRAGGGLRFSGSAPQAQRCHPAGPRACPNPQHSRVGPDPITKTGHPLRVWCARVCVRACVRACTCGPTSAAFHARM

SEQ ID NO: 1016841 - protein, 442 aa, Homo sapiens; identical to SEQ ID NO: 1016840

SEQ ID NO: 1016842 - protein, 312 aa, Homo sapiens
FSLAEVRVGYQSQNISCFFRLVDRDSVWGYDLGLRSLIPAVLTVSMLGYPFILPDMVGGNAVPQRTAGGDVPERELYIRWLEVAAFMPAMQFSIPPWRYDAEVVAIAQKFAALRASLVAPLLLELAGEVTDTGDPIVRPLWWIAPGDETAHRIDSQFLIGDTLLVAPVLEPGKQERDVYLPAGKWRSYKGELFDKTPVLLTDYPVDLDEIAYFTWAPDPAQGPVTAKPPVFMQTLNPPSHPHHVLPGTSTSIPPIKWLLTSMCWNQLLKVGPREGALKQSPAPTHNPYCALSTPTLTPICRNLFPGAGSQRA

SEQ ID NO: 1016843 - protein, 185 aa, Homo sapiens
DPDTTFNSRALTQGPGGEAPSLDHLWTAAAEVNKNKNSIVDPKVIVEIHVVARMWPSRQTAVITNNGFNPRWDTEFEFVVAVPDLALVRFMVEDYDSSSKNDFIGQSTIPWNSLKQGVPPIVPPLGLRMETCIHQPLSFVKISIQGLSLGGLTQPLSGRKLVVHNCLGNVAPLARSLRPLNCLQL

SEQ ID NO: 1016844 - protein, 177 aa, Homo sapiens
MVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPNRVLWTSGEPCIPEGFNSSPIPYQIVQ

SEQ ID NO: 1016845 - protein, 78 aa, Homo sapiens
IQFVQTPRGSPFLNGCPLSKASPVTEHLVVQARATVLPKSIIPDLCQASVVMHKEKGTAHYLQQRVREKQLEKGASTS

SEQ ID NO: 1016846 - protein, 503 aa, Homo sapiens
ADQFLPGREDLAAGSLLQQLYLEGLHALCHPDAAWVPEVLLPAVVCPPVCLMMGVALDGKMRWWGVLPLAPDALCVLCAMVTCAVPVCAVPLCCADTDTVLCDNGWGCAYPAAAGLRDDSASPPWLPVQLTAEPGLTQELAWVLQCVTCVVVRGQVERQALLVSSPAMGCKSFFKRSIRRNLSYTCRSNRDCQIDQHHRNQCQYCRLKKCFRVGMRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHALLPRAAGGRPGGAAAPELERALRAERGAGGLTPAHWRRYWPPPASTPRHMAAERAVAFMDQGARLPGARCYKLGRLQVDSGEYGCSRHRATSQPEGLLDFSRTGPTFESLQETAQVAITIRAGQNRQASARGMQVEPRPEGRVQLPGTQGGGEPGNKTGKENRQVEDQGGREGNQRGRRKHAPKKTVEK

SEQ ID NO: 1016847 - protein, 353 aa, Homo sapiens [sequence omitted]

SEQ ID NO: 1016848 - protein, 230 aa, Homo sapiens
FRAARCCGSRMMETERLVLPPPDPLDLPLRPWSSDARGTGSCLNLPGAPESSLPHGLPPCCPKSAARMHEQLFLVIPSLADSAWCGALSPENGRVKTVIPVSLFGCPGDAPVPSDTTCAQMTPNHMCQILVLQRGLAWRTQISRAYNLLVSSPVPPVASLPVLMGKSNSCIPSGQWGMDEHHHNMICNTREEAEEEIDYRQRSFLLFHLGFKKGMDFAPKDCPNSSSLDY

SEQ ID NO: 1016849 - protein, 147 aa, Homo sapiens
SSLPIFIFYKTSYKYFFLLPPPQGKTTQHSRTPICEREVGWSDSKLLHKGGFSVHISFWPGNGTGVCWEGHPAPACCVRCFCSRLQEKVFFPPYHAGQGYWSSWDSMCDFHQDSGNLLELRLHRIKLREGYVHMWAALCGPCLPDPK

SEQ ID NO: 1016850 - protein, 67 aa, Homo sapiens
MTSALGQPLKEADQIVQTPEVAVLTVALCPRQPVTEHLVVRQGHCLAEVNHPDLGQAVWSCTKRREL

SEQ ID NO: 1016851 - protein, 97 aa, Homo sapiens
LQDSARGNLRDFLLVYNRMTELCFQRCVPSLHHRALDAEEEACLHSCAGKLIHSNHRLMAAYVHLMPALVQRRIADYEAASAAPAVKKNCCEPRGRR

SEQ ID NO: 1016852 - protein, 98 aa, Homo sapiens
LQDSARGNLRDFLLVYNRMTELCFQRCVPSLHHRALDAEEEACLHSCAGKLIHSNHRLMAAYVHLMPALVQRRIADYEAASAAPGIPAEQTRDSPSGS

SEQ ID NO: 1016853 - protein, 70 aa, Homo sapiens
EDTTMFYSKILGMEVTTFKGNRKALCFGDQKFNLHEVGKEFDPKAAHPVPGSPGCLFDHRSTPGGGDRGA

SEQ ID NO: 1016854 - protein, 83 aa, Homo sapiens
IMDTSRVQPIKLARVTKVLGRTGSQGQCTQVELEFMDDTSRSIIRNVKGPVREGDVLTLFGVRKRSSKVALILQLVGFWISTT

SEQ ID NO: 1016855 - protein, 38 aa, Homo sapiens
MIIVDPAAPIQPCSLTPEKHLLKTSTKTPSASVYYSTE

SEQ ID NO: 1016856 - protein, 97 aa, Homo sapiens
RFRHPYHLTSMSQAEFDKAAEEVKRLKTQPTDEEMLFIYSHFKQATVGDVNTDRPGLLDLKGKAKWDSWNKLKGTSKESAMKTYVEKVDELKKKYGI

SEQ ID NO: 1016857 - protein, 77 aa, Homo sapiens
HWDQNERYLVVLNFRDSGRSARLGAPTSLLAKLPASAKLLLSTDSARKAVEEDTSLKLENLSLNPYEGLLLQFPFVA

SEQ ID NO: 1016858 - protein, 135 aa, Homo sapiens
MLERVQPLVSFTKPPHLFLLRPSLKSSLLYLVKWDALFPIQLKQKLLTMRRMRMHLCICSAWLIPSKISHYSCLAVSFSSFASKSTVVALITDLFTLLIPAISPISVLRKFCSQNYLLNPHLEIEIVLCGHFFPL

SEQ ID NO: 1016859 - protein, 192 aa, Homo sapiens
MADDAGAAGGPGGPGGPGLGGRGGFRGGFGSGLRGRGRGRGRGRGRGRGARGGKAEDKEWIPVTKLGRLVKDMKIKSLEEIYLFSLPIKESEIIDFFLGASLKDEVLKIMPVQKQTRAGQRTRFKAFVAIGDYNGHVGLGVKCSKEVATAIRGAIILAKLSIVPVRRGYWGNKIGKPHTVPCKVTGRCGSVL

SEQ ID NO: 1016860 - protein, 95 aa, Homo sapiens
MRVSSGERWIKGDKSELNDIKDNQRSPVRVKERQITDHRNVSQSPNRKPDKEKKLSHNSNSKERDIRGHSDKDDRFITTVRKGQFYSGVEQGSHG

SEQ ID NO: 1016861 - protein, 125 aa, Homo sapiens
PQVQLGAHQDDEEDYDRLRPLSYPQTDVFLICFSLVIPASYENVRAKWFPEVRHHCPSTPIILLVPTKLDLRDDKDTIEKLKEKKLGSITLPSGPWHLAKKIDSVELPGVLSSHPMMRSCKPVFD

SEQ ID NO: 1016862 - protein, 208 aa, Homo sapiens
LNCFVSVQFYSIYTHPICWVVISFYASLQLFFFFTQYFTNLFEILSGIDKSTSLSVPTTNTSVSYTAMQATSALDLASSLHMDSRADMRNVTTILSPRLLIFNGEGGIALVAMIPLKSQHFGMLTWEGCLRPRVRHQLGNESEIPFSTKNLKSIQVWYTPVVPATQEPEARGSLEPEEFDAAVTYDHTTALQLGRQNKTPSRPQLIPL

SEQ ID NO: 1016863 - protein, 150 aa, Homo sapiens
AEQAQLGMAMVKRFFESYHEVPDGTQCHRKTYITTALGGICGIIGSAYSVSLNPADSTLEAVARVGRYTFTAAAIGAMFGLTTCVSAQVREKPDDPLNYFHWWLRGRPDIGSSHSQLWDSTMGCVYMGTAAALFKIGKLEGWELFPTPKV

SEQ ID NO: 1016864 - protein, 190 aa, Homo sapiens
FPHKRPHFLYPKSRLVRSLMSPSHYGPPSFHNMFQPFFEMIHQAQQAMDVQLHSPAFQFPDVDFLREGEDDRTVMEIRRNSTGCPEDEGPVLKSAKEILSVDCSTNNPAQANLRQELERLAPGGRDVQEQYKELLQSFQSKMLNTSSLLEQLNQFNWVFQLANLTQGEDKYYLRVSTVTIPLTQRSLPCY

SEQ ID NO: 1016865 - protein, 56 aa, Homo sapiens
MDRVLGLLTPARWWPRLEQGLRRQKSSFTVDCSKAGNNMLLVGVHGPRTPCEEEKQ

SEQ ID NO: 1016866 - protein, 204 aa, Homo sapiens
RAALPSTHFSLPDSAVATNALSQPSESVPKPNQKGGEQTRLQPATENREAARLGERGPEAIRANTGQCRRKLSPLPARPRPPCFRRRNPRRYGTPPGSNCAARLLPEARPPPRPNPRAATHSGEQGAARVSTAPPKAPAFLKPKSTPGTWNQQLRTDSGKTTKDQADGAHQASRPPPRAGPNGDRVDRTATRGLVNTAGGVAAH

SEQ ID NO: 1016867 - protein, 230 aa, Homo sapiens
MCTGGCARCLGGTLIPLAFFGFLANILLFFPGGKVIDDNDHLSQEIWFFGGILGSGVLMIFPALVFLGLKNNDCCGCCGNEGCGKRFAMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGRWTRLNLRDELLRLYSMTTTISFLKPSLFLGL

SEQ ID NO: 1016868 - protein, 212 aa, Homo sapiens
MCTGGCARCLGGTLIPLAFFGFLANILLFFPGGILGSGVLMIFPALVFLGLKNNDCCGCCGNEGCGKRFAMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGRWTRLNLRDELLRLYSMTTTISFLKPSLFLGL

SEQ ID NO: 1016869 - protein, 170 aa, Homo sapiens
MSTNQEERPQEKPTLPWRLDLAFPASRTMFTSTIFAVVGFLGAGYSFIISAISINKGPKCLMANSTWGYPFHDGDYLNDEALWNKCREPLNVVPWNLTLFSILLVVGGIQMVLCAIQVVNGLLGTLCGDCQCCGCCGGRWTRLNLRDELLRLYSMTTTISFLKPSLFLGL

SEQ ID NO: 1016870 - protein, 160 aa, Homo sapiens
MVLPFHASSLRNEATPPHNLEEEAWNGRRQQALSLERWPLWTSHPLRTPPLMPVAVARRCILPGLWPLLCPPSCSVSPVSERPRCLLVWLNIFYEDHFPVHQGDTSWKSGVMTVSLSKPVSAGLVTVLVTLELLSSIRVSAREASSVSMFHLMRGVDLLE

SEQ ID NO: 1016871 - protein, 256 aa, Homo sapiens
QPSCLEPEKGRRDRRNRRQWSQWPLRGASRTGGSPGAAAWRTRQRRKAGEWPRCWQQVLAVDARYNAYRTPTFPQFRTQYIRRRKQLAAGECQGWAPPSACVGSTLRLSGGSCFGQRYGPLFRARAVFVPISNSIVSAVTALTLERIEDFEDEFLRALGGPWAPSFCQGEGPNRCRRRLNRGVYEDRAPFSVVATSAAEGKSGHGRGTRLLSENYGFAGMYHVFEQHVDEAVPRGALRNDDRHGWAVVTRREIFLC

SEQ ID NO: 1016872 - protein, 356 aa, Homo sapiens
KSDQSKARGIKVEKQIFGEATKQPGIVFVAAKFEGTMALGYHHISVNNVLPVFDNLMQQKLVDKNIFSFYLNRDPEGQPGGELMLGGTDSKYYHGELSYLNVTRKAYWQVHMDQLEVGNELTLCKGGCEAIVDTGTSLLVGPVEEVKELQKAIGAVPLIQGEYMIPCEKVSSLPTVYLKLGGKNYELHPDKYILKVSQGGKTICLSGFMGMDIPPPSGPLWILGDVFIGSYYTVFDRDNNRVGFAMLSYSNLLLLHCQGTGSESSRGSQAAPSSTAPLTHSHTRYVAGPWGETWLELVQLFCSVVPHPGFRLLPSACLKEAKATQYTRLPSKAPTGLIAAEMDCLVLPAFAVWAVL

SEQ ID NO: 1016873 - protein, 167 aa, Homo sapiens
HTVRSPQGALVDGSLCISQSFRHNLHQMRNSSGVWLINYFKFRVKVFSFLEDLISLDQDLGSYGSVDIYMCDLKYLAFQPSSGHLHFNHAACSVSIPLLLSVPAELGFSWVILHVALVLPIPVSTIPLCLRPRFLNFWYEFYGHLAGALVGMRKPMALVLNKTQKLK

SEQ ID NO: 1016874 - protein, 200 aa, Homo sapiens
MEARDKQVLRSLRLELGAEVLVEGLVLQYLYQEGILTENHIQEIKAQTTGLRKTMLLLDILPSRGPKAFDTFLDSLQEFPWVREKLGEGERGKSQPSCLQGDWMAGIPSHILSSSPSDQQINQLAQKLGPEWEPVVLSLGLSQTDIYRCKANHPHNVHSQVVEAFVRWRQRFGKQATFLSLHKGLQAVEADPSLLQHMLE

SEQ ID NO: 1016875 - protein, 134 aa, Homo sapiens
RGSRGGAGRRGRATSCPAREQLQRQRQHPAAAPAVPVRCFTFCFTDIVIMPKRKSPENTEGKDGSKVTKQEPTRRSARLSAKPAPPKPEPKPRKTSAKKEPGAKISRGAKGKKEEKQEAGKEGTAPSENGETKS

SEQ ID NO: 1016876 - protein, 136 aa, Homo sapiens
RGSRGGAGRRGRATSCPAREQLQRQRQHPAAAPAVPVRCFTFCFTDIVIMPKRKSPENTEGKDGSKVTKQEPTRRSARLSAKPAPPKPEPKPRKTSAKKEPGAKISRGAKGKKEEKQEAGKEGEAQKTESVDNEGE

SEQ ID NO: 1016877 - protein, 120 aa, Homo sapiens
RGSRGGAGRRGRATSCPAREQLQRQRQHPAAAPAVPVRCFTFCFTDIVIMPKRKSPENTEGKDGSKVTKQEPTRRSARLSAKPAPPKPEPKPRKTSAKVILCISWGQLLKAIFTKYLCKC

SEQ ID NO: 1016878 - protein, 134 aa, Homo sapiens; identical to SEQ ID NO: 1016875

SEQ ID NO: 1016879 - protein, 260 aa, Homo sapiens
EALGTRPCSAGKMGKVRGLRARVHQAAVRPKGEAAPGPGPLPRRRPLRRLGRGKDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARSEEERTRFQELLASPAYRASPLVAIGQTLARQMQLEDGGSSDQGSGHATNPQDTCGPSRERRPLKDHGLSLVDALPSGQVVGLNKWLCELPLHCQGRS

SEQ ID NO: 1016880 - protein, 283 aa, Homo sapiens
EALGTRPCSAGKMGKVRGLRARVHQAAVRPKGEAAPGPGPLPRRRPLRRLGRGKDWAFINTNIFARTKIDPSALVQKLELDVRSVTSVRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGSSDQGSGHATNPQDTCGPSRERRPLKDHGLSLVDALPSGQVVGLNKWLCELPLHCQGRS

SEQ ID NO: 1016881 - protein, 230 aa, Homo sapiens
MGKVRGLRARVHQAAVRPKGEAAPGPAPPAPEATPPPASAAGKDWAFINTNIFARTKIDPSALVQKLELDVRSVTSVRRGEAGSSARSVPSIRRGAEAKTVLPKKEKMKLRREQWLQKIEAIKLAEQKHREERRRRATVVVGDLHPLRDALPELLGLEAGSRRQARSRESNKPRPSELSRMSAAQRQQLLEEERTRFQELLASPAYRASPLVAIGQTLARQMQLEDGGQL

SEQ ID NO: 1016882 - protein, 92 aa, Homo sapiens
NHGCKGGLPSQAFEYILYNKGIMEEDSYPYIGKDSSCRFNPQKAVAFVKNVVNITLNDEAAMVEAVALYNPVSFAFEVTEDFLMYKSGVYSK

SEQ ID NO: 1016883 - protein, 140 aa, Homo sapiens
DGVVLPKDPKEILAEKNFNTVPYIVGINKQECGWLLPTMTGFLPADVKLDKKKAIALLEQFASMTGIPEDIIPVAVEKYTKGSDDPDQIREGVLDAMGDVAFGVPSVIVSRGHRDTGAPTYMYEYQYYPSFSITPKDPRM

SEQ ID NO: 1016884 - protein, 102 aa, Homo sapiens
MSHKIRQSRPSSPAALSTYRSLMTSHSLLDTTETPYLMKSIDCIRAFREEAIKFSEEQRFNNFLKPFKEKVEIKQLNHSQGNCCSRMELPLITKGGGLWSSF

SEQ ID NO: 1016885 - protein, 76 aa, Homo sapiens
TRAPTRQWRRTALASLPGRGTRRERAGRSRLRPGDPVLSSVISLSTTSVEHVHQGPDDVYRRKASERQYQRRLEDE

SEQ ID NO: 1016886 - protein, 84 aa, Homo sapiens
TDPSTPGFPAHAPREMLWSFLATSTGFPTKFLFPAQNRSPLAFLLLRSVFRARTHTRLCSGSGGGRPSSRGPCRRGASWARVVF

SEQ ID NO: 1016887 - protein, 120 aa, Homo sapiens
LVRLPDSGGGRRSLVSQVAVHGENGRGGLGCVRAIQCLVPSYPSPRPRSSMFTRAQVRRILQRVPGKQRFGIYRFLPFFFVLGGTMEWIMIKVRVGQETFYDVYRRKASERQYQRRLEDE

SEQ ID NO: 1016888 - protein, 87 aa, Homo sapiens
LVRLPDSGGGRRSLVSQVAVHGENGRGGLGCVRAIQCLVPSYPSPRPRSSMFTRAQMMSTVEKPQKDSIREGWKMNETELQQSIKSI

SEQ ID NO: 1016889 - protein, 97 aa, Homo sapiens
LVYIDFRDEDGLLRQSREAAMGFTGKQVIHPNQIAVVQEQFTPPQEKIQWAEELIAAFKEHQQLGKGAFTFRGSMIDMPLLKQAQNIVTLATSIKEK

SEQ ID NO: 1016890 - protein, 82 aa, Homo sapiens
EDKVAVKGSRKERKKEVVEEEENGAEEEEEETAEDGEEEDEGEEEDEEEEEEDDEGPALKRAAEEEDEADPKRQKTENGASA

SEQ ID NO: 1016891 - protein, 123 aa, Homo sapiens
MGKEKTHINIVVIGHVDSGKSTTTINLIYKCGGIDKRTIEMFEKEAAEMGKGSFKYAWVLDKLKAERERGITIDISLWKFETSKYYVTIIDAPGHRDFIKNMITGTFQACWAVLIVGGGVGEI

SEQ ID NO: 1016892 - protein, 69 aa, Homo sapiens
SPKLLHKFNDVVWHVSWSITANILAVSGGDNKVTLWKESVDGQWVCISDVNKGQGSVSASITEGQQNEQ

SEQ ID NO: 1016893 - protein, 87 aa, Homo sapiens
ITPLNLTQWLMVLKISLPVILMDETLKFVARNYLEQPGKECVQPATKSSCSLSACTDGISWPFVLLIMPLVVWVYSTDTNFSDMFWS

SEQ ID NO: 1016894 - protein, 208 aa, Homo sapiens
MLSSQPFHIHAAPTTHLSALANANPPPWPARPTRPTRTSPTPTKGAVAHPNLQHTAHPAETSPYDNPLHPTTAHGHTYPTPDIPYTPAPHNRAHGPCNPHRNQPTPQRNYPSAPRDHNTPPANMAPAPAKPGHNLQNGPDKTWRTALTPPPRATWGHYYAAPTGGPPTPPTGPPPPRTTPPPNPPPTYSTTTPPHTPAQHTPPAPPAP

SEQ ID NO: 1016895 - protein, 208 aa, Homo sapiens; identical to SEQ ID NO: 1016894

SEQ ID NO: 1016896 - protein, 108 aa, Homo sapiens
GSSSGQNGDGTNVRTPGASALATVRASGPQRRRALAMAWETADHTVLFPVAPCCCRQTTSSLRVPGPRSLSTSAISLCRSPGSGPSCWFAAIPSPTAVPEVVLERLQM

SEQ ID NO: 1016897 - protein, 84 aa, Homo sapiens
TGILKDAGVNNLTIQVEKEAYFQHMSGLSTGFHDVLAMTKQMESLKYCKDGTYIMLRRSPAAMNSEQRRSDEVDNVRARVKVAH

SEQ ID NO: 1016898 - protein, 207 aa, Homo sapiens
TDRHECTRSSRDGAMLRVRCLRGGSRGAEAVHYIGSRLGGSLTGWVQRTFQSTQAATASSRNSCAAEDKATHPLPKDCPVSSYNEWDPLEEVIVGRAENACVPPFTVEVKANTYEKYWPFYQKNGGLYFPKDHLKKAVAEVEEMCNILSMEGVTVKRPDPIDWSLKYKTPDFESTGLYSMPRDHPDGCGETEIEAPLALRSTLLSYR

SEQ ID NO: 1016899 - protein, 99 aa, Homo sapiens
SRTRRSTSIVKRWRGVTGHGGDRCVPLTYSWIENQVYFKYEGMWDQGRTAVGQPVVPLEPAIQVDAVIPAPTGSKARLIGLPWPKLGLPKEKLQDSKAW

SEQ ID NO: 1016900 - protein, 142 aa, Homo sapiens
RGMQGGSPLEAVPGLSHIQCHPQPHPSCHRLCLHPAVSSPISASSLIRKPGLDSGPLVLFVFCFLFFVFLRQGLALLPRLECSGVISAHCNLHLPGCSSTASASLVAGIARCPPPLLAGFSVFSGDGVSPRWPGWSRTPDFR

SEQ ID NO: 1016901 - protein, 86 aa, Homo sapiens [sequence omitted]

SEQ ID NO: 1016902 - protein, 299 aa, Homo sapiens
ACFKMAVQESAAQLSMTLKVQEYPTLKVPYETLNKRFRAAQKNIDRGDQPRHHEMVAELEKTVERLSRRWNSVVSLLDMAWWRSSASSRGMCGRNPYQARGRAADQDCARAGSRHLKEHSRRPARGGQSVAEEAHGSHDGGAPDCVADTYKTGMFQAWRMQRRNQRTYSEYRQLLLTEPTRGGGQSLVEAVKDHTVHIGPECHMTTQSRNPDSMKELTWQYKHHKKSRTVHLNIIRHALPIHGNAKWRTMEQQSDNSTKAGKGRPTRNEEERTRTMETRMAQARPDNEAPPQQRTQLGT

SEQ ID NO: 1016903 - protein, 205 aa, Homo sapiens
NIKDWPELGALTLNIVLKVCSKILDEVTTTDELIPSGETSSYRSNPIGLAEFTLSRRDPGYVSRSKATAELENQRLAGNVSELTEVFARIKQIAGQEHIDPLQTEIGSMVYAVKPGDGSAREQAASCQRVIGGLANIAEEYATKRYRSNVINWGMLPLQMAEVPTFEVGDYIYIPGIKAALDNPGTTFKGYVIHEDAPVTEITLY

SEQ ID NO: 1016904 - protein, 54 aa, Homo sapiens
MGSTEALAHAPRKVYDTRDDDRTAGIHGDCDDDKYRRRPCSGLAGPAAQEPGWV

SEQ ID NO: 1016905 - protein, 77 aa, Homo sapiens
MRTYEREALKKKFTRVHDAESSDEDGYDGVRPMTFDLLAGCQLVPPPSPTLGLGLSFPYRTHNLTSLRLVFNKQSIF

SEQ ID NO: 1016906 - protein, 180 aa, Homo sapiens
KVENGRLKVQQGIIAGCSGGNYENVIAAANALRGQSCGNDTFSLAVYPSSQPVFMDLAKKGVVADLIGAGAIIRTAFCGPCFGAGDTPINNGLSIRHTTRNFPNREGSKPANGQMSAVALMDARSIAATAANGGYLTSASELDCWDNVPEYAFDVTPYKNRVYQGFVKGNSATPDLRADK

SEQ ID NO: 1016907 - protein, 62 aa, Homo sapiens
KAFARHRIRLEKGPGYKEWSDINLTVSFLAAIFFFLYGMSLAVCLLFWCWIPEFFIDKSSYK

SEQ ID NO: 1016908 - protein, 270 aa, Homo sapiens
MQALVLLLCIGALLGHSSCQNPASPPEEGSPDPDSTGALVEEEDPFFKVPVNKLAAAVSKFGYDLYRVRSSMSPTTRVCLSHVQASALEATCSCLLSDVATALSALSLGAEQRTESIISPGLSHYDLISSPDIHGTYKELLDTVTDPQKNIKSASRIVFEKKLRIKSSFVAPLDKVIWDQAQSPDGQPSLWTCKRSTHWVQAQMKGKLAASTKEIPMEISILLLGVAHFKGQWVQSLTPKDFLEDFYLDEETVRVPMMSGPAVLRYGLDS

SEQ ID NO: 1016909 - protein, 256 aa, Homo sapiens
MQALVLLLCIGALLGHSSCQNPASPPEEGSPDPDSTGALVEEEDPFFKVPVNKLAAAVSKFGYDLYRVRSSMSPTTNVLLSPLRCGHGPLGPLAGSGAANRIHHFTGLSQYDLISSPDIHGTYKELLDTVTDPQKNIKSASRIVFEKKLRIKSSFVAPLDKVIWDQAQSPDGQPSLWTCKRSTHWVQAQMKGKLAASTKEIPMEISILLLGVAHFKGQWVQSLTPKDFLEDFYLDEETVRVPMMSGPAVLRYGLDS

SEQ ID NO: 1016910 - protein, 76 aa, Homo sapiens
QGSNLCLMMQRLSPNSRMPPDKIPVKYLEFISECIIQVLQRSIPGTLVLMPRAHEQGLELFRKTMASNYKELGFQG

SEQ ID NO: 1016911 - protein, 90 aa, Homo sapiens
QGSNLCLMDAEIKPLQSHATRYFTGILCLVACDCHKIPVKYLEFISECIIQVLQRSIPGTLVLMPGRIEQGLELFRKTMASNYKELGFQG

SEQ ID NO: 1016912 - protein, 132 aa, Homo sapiens
SVPPAPASPQHAAPPAALGACIMPSLLVALDICSKNPMPQRWFMRGDFQEVRGDVFPSYTCTCLKGYAGNHCETKCVEPLMENGNIANSQIAASSVRVTFLGLQHWVPGAGPPDPSQCMVNAWTPSSNDDHP

SEQ ID NO: 1016913 - protein, 241 aa, Homo sapiens
YVRSRCEAWLLGDPSAVTQWMSMARGRKMSKPRAVEAAAAAAAVAATAPGPEMVERDGALGDVPRTDGGELYLPVQSKIYSYMSPEQMLWNAFPPSGRELSYTLRIQMPGGKPISLESTCETEKKKRNAGNCSTDAATEVLRNRRSNDCQERSPVYLFQSKNLKQQNLQKLHPHLVNSTNCSHSPSNALKKPIMVQTVPPKNSSRKNCNRIANLRISTLSEGAPVKSKAELQSEERNRIDE

SEQ ID NO: 1016914 - protein, 175 aa, Homo sapiens
KQAVSASGKWLDGIRKWYYNCCTDSHYTLGLKCENDTIYAGLEMLNRSHNEDFLSNLYYMTGCSRIKQGTGTCNLQALQTLALTRATCDQNTERANTFPTPWQPATHATRSAYFRGNTHTMHNARQQPGATPATLTPLLRLWTRSCCRFATPLPLLHTNCAFKHVCHTPTHRSSL

SEQ ID NO: 1016915 - protein, 93 aa, Homo sapiens
ISPFSYTPPFPPTGGAALSARGIGPEEPAAAAVARGKREEAATGEKKRSRHRREVDTQAAAAARARPPRPSPRPVHKAARLRKGVRTKGQSLQ

SEQ ID NO: 1016916 - protein, 114 aa, Homo sapiens
ATALRMLFSQIKEVDMGLAADFKHCQRLPKVIGNQSLVNELTFSARKMMADEALDSGLVSRVFQDKDAMLNAAFAWRLIFPARALWLCRGQKSISSTPETILWTRALTTWPPGT

SEQ ID NO: 1016917 - protein, 118 aa, Homo sapiens
KSWEASNRLAAPLLRNLVDSPRGLQEFRATEGNFILGPVTFLEIGAQWSILCKDIPSFERYMAQLKCYYFDYKEQLPESAYMHQLLGLNLLFLLSQNRVAEFHTELERLPAKDIQTNV

SEQ ID NO: 1016918 - protein, 66 aa, Homo sapiens
FTVIRPFPGLVINNQLDDQSESKGPVIQESAEPSQLEVPATEEIKETDGSSQISKNQTPRGRPLPS

SEQ ID NO: 1016919 - protein, 139 aa, Homo sapiens
PTLTTVPGPALGAHPPQGPCCFHWLCSPYAPCSEGAGPTSPQWTASSPPFVAHHRAAHTQGRGPGNFQQEQKFAICLACIWNPPWARFLALLYSLVIALWPAGFSLGQARHRLHRFPKHLIFLPNIFSRPCNLHGTFQI

SEQ ID NO: 1016920 - protein, 126 aa, Homo sapiens
FFKMFFVRDRVSLPFPKLFLKLVASQMILSPWPPKVLGLQWYEPPHPATGRFCNRWQCLRQEAPSPVCSKEPLSSGSLLLSNSCLLSSSLLFCPIFLPLNPALSFFYFFETEFHCVAQAGVRPYLY

SEQ ID NO: 1016921 - protein, 137 aa, Homo sapiens
MDILVSECSARLLQQEEEIKSLTAEIDRLKNCGCLGASPNLEQLQEENVYITCIEREIFFERGLPAQKGDRKRTKQLCINIISRHTERSIGHAYLEACISQHLEESSLCYMTPRSDRTTWWGLSGVIGDYGVFVRMM

SEQ ID NO: 1016922 - protein, 286 aa, Homo sapiens
MDILVSECSARLLQQEEEIKSLTAEIDRLKNCGCLGASPNLEQLQEGNLKLKYRLNILRKSLQAERDKPTKNMITFISAYKQVFGPCQLGCISRFGKSSSASDTKSAAKFGDYQCNSAMGISQMLKTKEQKVNQEKLLNKHYQTPTQTMTVLKNVEIAGPGSDYCPTYGRGYEYQNNVTSLLVHMGVQNNLSLGTRIHNTVIARQDSAYVIAQQRCIVGRQRSKKHRQQSIRPTIRQLARDDRAPGYIEKETGGRQNDMGKRQRQTSTKTYTGTPPTGEQGNNRNQ

SEQ ID NO: 1016923 - protein, 180 aa, Homo sapiens
MDILVSECSARLLQQEEEIKSLTAEIDRLKNCGCLGASPNLEQFPQHSTHIFKHIQQSSALDIIRSQSSSSSASTHVQPEPETHTHIIAFNHSLAAYKQVLWSMPIKAAYPDLENPPLLVTPSQQAKFGDYQCNSAMGISQMLKTKEQKVNPREIAEQTLPNTYPDNDCIEKRGNCWSWF

SEQ ID NO: 1016924 - protein, 108 aa, Homo sapiens
ERELSTMTQSYRAMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 1016925 - protein, 99 aa, Homo sapiens
VNFLEEYYSEDLEEVAAALKNGNDFYIVYNIMKEGLLNCSTNLNLVTDCMEHALTSVHPRTRYSAGWDAKFFFIPLSYLPTSLADYILTRSWPKPAQAV

SEQ ID NO: 1016926 - protein, 108 aa, Homo sapiens; identical to SEQ ID NO: 1016924

SEQ ID NO: 1016927 - protein, 346 aa, Homo sapiens
LELTDDNFESRISDTGSVGLMLVEVLRVPGVDTARDLHLSMKLQYQIRGIVPLAKVDGELRTLTPVINMESGISNPEDIYEMVKKRGAYDGPRTADGIVSHLKKQADQLQCLSGLRKNLQKFISDTDASIVGFFDDSFSEAHSEFLKAASNLRDNYRFAHTNVESLVNEYDDNGDGIILFRPSHLTNKLEDRLWHIQCKKMTSGKIKKFIQENIFGICPHMTEDNKDLIQGKDLLIAYYDVDYEKNAKGSNYWRNRVMMVAKKFLDAGHKLNFAVASRMLSELLKERSLHAGGFSRDGNALEKVLQDTLMASEEIPEAETIPESNDGPVKVVVAEKYDEIVNEICV

SEQ ID NO: 1016928 - protein, 369 aa, Homo sapiens
ASELTDDNFESRISDTGSVGLMLVEVLRVPGVDTARDLHLSMKLQYQIRGIVPLAKVDGELRTLTPVINMESGISNPEDISEMVKKRGAYDGPRTADGIVSHLKKQADQLQCLSGLRKNLQKFISDTDASIVGFFDDSFSEAHSEFLKAASNLRDNYRFAHTNVESLVNEYDDNGDGIILFRPSHLTNKLEDRLWHIQCKKMTSGKIKKFIQENIFGICPHMTEDNKDLIQGKDLLIAYYDVDYEKNAKGSNYWRNRVMMVAKKFLDAGHKLNFAVASRKTFSHELSDFGLEKHCWRDSCCAIRTAKGEKFDMQEDSRVMGMLWRRSCKSTLMASEEIPEAETIPESNDGPVKVVVAEKYDEIVNEICV

SEQ ID NO: 1016929 - protein, 267 aa, Homo sapiens
TSTINLYFGSKVLSRVSGILFNDEMDDFSSPNFINQFRVAPSPANFIKPGKQPLSSMCPSIILDKDGQVRMVVGASGGTQITTSVALAIINSLWFGYDVKRAVEEPRLHNQLLPNTTTVEKDIDQVVTAGLKIRHHHTEVTPTFIAVVQAVVRASGGWAAASDSRKGGEPAGYCVPGRGKIDPQPRDENGNRSKSGTLENMPPLGWDKRERNKLEATAKAAGKPLRADKKTDTSDPPTTTHNINQNTGGRPKHPAGAQSTAHFFTGP

SEQ ID NO: 1016930 - protein, 206 aa, Homo sapiens
MTVSSKLRGLLMQQLRGTSQLYFNISLRSLSSSAQEASKRAPEEVSDHNYESIQVTSAQKHVLHVQLNRPEKRNAMNRAFWRELVECFQKISKDSDCRAVVVSGAGKMFTSGIDLMDMASELMQPSGDDAARIAWYLRDLISKYQKTFTVIEKCPKPVIAAIHGGCIGGGVDLFLPVTFRYCTQDAFFPDQGGEIMGLAADVGTLQ

SEQ ID NO: 1016931 - protein, 140 aa, Homo sapiens
GFHGESRSCCVSAAAAGPSRQDKYSVLLPTYNERENLPLIVWLLVKSFSESAINYEIIIIDDGSPDGTREVAEQLGRDLWARQNSPKTTREKAGSRNLPTFIGIKHATGNYVIIMDADLSPPSQILFLNLSGNKKEGNFD

SEQ ID NO: 1016932 - protein, 147 aa, Homo sapiens
PWCGMWSAAFLFVAEQASTVRVDCMLFFRASVDGRLGWWLPGAVLLGARMFGNSLGFCFQWSPFMPSFPSPLSLFSPPCPCAHPLCGCVCKPECVLWNFVASPKISGACKVLGSRYPCLLLLCDHGQAFESLVSGGCLSLHGRQRLQ

SEQ ID NO: 1016933 - protein, 164 aa, Homo sapiens
GGARGGGAGAGERGGRGVAGGGGGAGGGAGGAAGEAAGRRARAAGGAGRGGGGGWGGGGGGGGGRGRAGGGGRGWGVGAGGGWGVGGAGRGGTCGARGAAGGGRAAAGGRGALRGGVAGVGRVRGGACLVGGGQPCFSNKQTNKQPCFSSHIMCIQGSQEYRFS

SEQ ID NO: 1016934 - protein, 359 aa, Homo sapiens
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 1016935 - protein, 169 aa, Homo sapiens
MAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 1016936 - protein, 315 aa, Homo sapiens
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 1016937 - protein, 464 aa, Homo sapiens
MACRGGAGNGHRASATLSRVSPGSLYTCRTRTHNICMVSDFFYPNMGGVESHIYQLSQCLIERGHKVIIVTHAYGVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 1016938 - protein, 169 aa, Homo sapiens; identical to SEQ ID NO: 1016935

SEQ ID NO: 1016939 - protein, 484 aa, Homo sapiens
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 1016940 - protein, 219 aa, Homo sapiens
RVPPLARLTPGAPSSGLEASGFLPPGGGTAPPRARVVPGPSHSYPGSLGGIPRRLKPAAPSLPRLLPQAWHRASPHYGSSTDSTLDFMLGAKADGETILQRLQSIFQEQGMAESVHTWQDHGYLATYTNKNGSFANLRIYPHGLVLLDLRVMMVMRKAKEEIDSILPTARGKAMHQNRDQDQILERSAHALPHIVRGGASEDTGHARALVEYDIDEVAY

SEQ ID NO: 1016941 - protein, 505 aa, Homo sapiens
LVCWSSGGGAEARLGSPRRRRCQALVCGYPGRSAVPNAMSVVVQHVEEKAVHSWSRISTAGKKALEEALLVFNPMSQDLSATEAQLVAFLQGLRDDGFQPTILRSGDVYGYSSCTANPPSQTKLQARAPNPTATSPPASAPRTAMRLPAGRATLLPMPLSGRLAKASTPALAKHATTNLLLSSLKQSSASHARGAAVGFPTHLYPGVYPAMRLSVVLEALVPLKTPMPCLGAKHKAQSLQLSLADSPLKLRKSSGKGPGNPRPKAPRKTTSKGPKCLTRKGPGAGPRRGSGHQSKTNRATGSPSVRRMKGGSALGTKTAQAKVARTLAKAARAQAKVARTQAKAAKARAKAKAAQVKAKAKAKAAQVKAKAKVMAAWAKAKAKAKAVRAKAKVARTQPRGRGRPKGSAKARTTRKGQKNRPETVGQKRKRAEEAKDLPPKKRTRLGPRSPKAWLGPGTAKLLKFRAIKVDRRSSDDEVRQRAQRILRVNLSPVIRLQPLLPYSAV

SEQ ID NO: 1016942 - protein, 103 aa, Homo sapiens
KPYVLFYQRRDDECSSTSSLGSFPGSDGGVKLSSSHQGMGDEEAYNMDTNCCGLCDPATLPTPASSPRRISVALLKTAHINLKPDEDITSFYEKRKEKRNPAF

SEQ ID NO: 1016943 - protein, 104 aa, Homo sapiens
GRSISKRVSCQFGPDVTKAFLEENNLDYIIRSHEVKAEGYEVAHGGRCVTVFSAPNYCDHISTNPPTSTSRALTTASVPPVHSSASSQRQSHVLFQHPSPNHLT

SEQ ID NO: 1016944 - protein, 106 aa, Homo sapiens
TRFPAPRTIMALPLRPLTRGLASAAKGGHGGAGARTWRLLTFVLALPSVALCTFNSYLHSGHRPRPEFRPYQHLRIRTKPYPWGDGNHTLFHNSHVNPLPTGYEHP

SEQ ID NO: 1016945 - protein, 97 aa, Homo sapiens
VGGMRDDHIYFSQIHLELTLPGRPQPMGKNYVNGKTFLEKRYNEDLELEDAIHTAILTLKESFEGQMTEDNIEVGICNEAGFRRLTPTEVKGLPGLP

SEQ ID NO: 1016946 - protein, 104 aa, Homo sapiens
NVKARTCEKDVDFIQPPVLLTLGPKVGNVECGEGHFCHDNQTCCKDSAGVWACCPYLKGVCCRDGRHCCPGGFHCSARGTKCLRKKIPPLGHVFEGSGPKTAYL

SEQ ID NO: 1016947 - protein, 81 aa, Homo sapiens
WDGRGALFLSRLRAPFSSMAKSPLEGVSSSRGLHAGPPPKALHRRQHWPALPKVCGKFVDMMYGSQHDGVLHIPDYFPFER

SEQ ID NO: 1016948 - protein, 80 aa, Homo sapiens
WDGRGALFLSRLRAPFSSMAKSPLEGVSSSRGLHAGPPPKALHRRQHWPALPKVCGKLAGYDVPGASTMVSYTFQTIFLL

SEQ ID NO: 1016949 - protein, 82 aa, Homo sapiens
KPIADHIQRHLVWNPQRESSVSMGVTSDGNSYGVPDDLLYSFPVVIKNKTWKFVEGLPINDFSREKMDPDSKGADRGKGDRF

SEQ ID NO: 1016950 - protein, 79 aa, Homo sapiens
MPEVFFTAFGASTLDHELRLYVRELRDRSRTVDELNRTIDQLCRENDINIAFNQLEVHLHNEKGDEVTEVKRDYKGDDP

SEQ ID NO: 1016951 - protein, 78 aa, Homo sapiens
QPHQAFASPAEASFAAQFSDLRSPCQDCILTALLAVSFHQYRSCHHDFQLPSGTGCQMMWLETEAHSDCCCTTMEMPV

SEQ ID NO: 1016952 - protein, 48 aa, Homo sapiens
GTSFFAGDTDKLLHIRIEDSPEAQILPFLRHMCHFIEFTITLALSSDI

SEQ ID NO: 1016953 - protein, 103 aa, Homo sapiens
GGRMLPDCKLPATMPLVWVHVPMPLLPLWLHAQVQQHAPCARNGSSRSEARPWLSLEGHPETPSSSCAPMAAGDSAPELQQGGNKGWSCVCFAITMLTLLSNK

SEQ ID NO: 1016954 - protein, 229 aa, Homo sapiens
GNSDNYESLEVMQLIKGQTQNFKDAFSGRDSSITRLPLAFYYGMYAYAGWFYLNFVTEEVENPEKPFLSGYWEISALAVPIFVALSCFGSMNGGVFAVSSTLLTMIMLFSGDLDSLVNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 1016955 - protein, 114 aa, Homo sapiens
SGVRINCVAPGTIYSQTAVDNYGEMGQTLFEMAFDSIPAKRLGVPEEISPVVCFLLSPAASYITGQLINVDGGQALYTHAFSIPDHDNWPVGSWGPFYCQEDKRNLLRRKPSSN

SEQ ID NO: 1016956 - protein, 102 aa, Homo sapiens
DRRQNELLEPLQNLAFSPATMAHAFLPTMPEDLLAQARRWKGLERVHWYSKCWGLDDPHSFELQRVSRCYEALGSTWGPRGLCLRVQNHLHSTGGVCRRRMA

SEQ ID NO: 1016957 - protein, 139 aa, Homo sapiens
QAGCNQVDAILISTQMKLLDFCKSKDIVLVAYGVLGTQRYGGWVDQNSPVLLDEPVLGSMAKKYNRTPALIALRYQLQRGIVVLNTSLKEERIKENMQVFEFQLSSEDMKVLDGLNRNMRYIPAAIFKGHPNWPFLDEY

SEQ ID NO: 1016958 - protein, 264 aa, Homo sapiens
VKRLGKCRFIFAPLAFLPRLAGQVKRDCKTRQPCRLSRNRSRPEGVGVLVLRLLPQAPWDPRFRESLAQGPFPAVRRRPPSLCPRRPPSWAIPAVSAPCEAEWVGHKTPRRGSSGGTKDGDRPKILMDSPEDADLFHSEEIKAPEKEEFLAWQHDLEVNWINAPGQARPTVSRWTGGGHSDSYLSGSFNNWSKLPLTMKPPITFVAILDSCRKESIMYQVLRGLVSVDATNPLPEPISKPAKVVHTLNNNSVTVNDHLTFDVLE

SEQ ID NO: 1016959 - protein, 107 aa, Homo sapiens
ILWRPSRWSFHRTFTSPAWGRLRFSGSLARSWLALTSALWEAQTFPRNEEPVLDDCRLCPSVPPGPSLVGDMALLLEVHSLVPRGPHPDFLSLYTRAPVTFREALVK

SEQ ID NO: 1016960 - protein, 128 aa, Homo sapiens
MMDIQRTLNVNMVSNSEIPINNLSPGPKTLGTNDHGFLQNLMTMKKQELMIASCKDRVLEVRTLEKAMRVSPTLSTLSGRTIGLKHCLKKAECQDEENQKQCQDLGAFTGHGCLWVPQLTTPPFPHSR

SEQ ID NO: 1016961 - protein, 155 aa, Homo sapiens
MWLLRRRWPWPVALLLRRSKFISAPGLSCPTSGLRHPLLIPWPWPCSVATMDKILEGLVSSSHPLPLKRVIVRKVVESAEHWLDEAQCEAMFDLTTRLILEGQDPFQRQVGHQVLEAYARYHRPEFESFFNKTFVLGLLHQGYHSLDMVVFGCPN

SEQ ID NO: 1016962 - protein, 92 aa, Homo sapiens
SHLFPSKPQARAGTPWLLRTSDTSSSSYHGQVVPGWQCKGTENPFEYDYETVRKGGLIFAGLAFVVGLLIILSKRFRCGGGKKHRQVNEDEL

SEQ ID NO: 1016963 - protein, 92 aa, Homo sapiens; identical to SEQ ID NO: 1016962

SEQ ID NO: 1016964 - protein, 240 aa, Homo sapiens
MKGASMICINVFISLVHLREATLSSRAQMRRFAVGSLPRGVGKKILRVLIYFIQFVLRVWPQPSEQSDSRREMLRTSAAMRNVALGGREVLPMCPLTLSASRPGLSVTSYLSSLWGPGPQFNLVAPDATSLWYGNFGVTGKPPRTKAVFLRTSSEAGPLGWDQGWGMGQGLPKWEQRSKVSNLLIVYYVVQNAISGGILIYLTVKDIRILTSVSQFLVTVPPGASPSDDLSTVALDLFDA

SEQ ID NO: 1016965 - protein, 96 aa, Homo sapiens
AGCFMINNCTTLSPDSGDIANTLKSRHAMQERTLQQFLCQRQARGEIPPHCDVTHLAEFLNCIIQGMSISAREGASLEKLMQIAGTTLRLWPELVK

SEQ ID NO: 1016966 - protein, 238 aa, Homo sapiens
MALEGGMKCVKFLLYVLLLAFCACAVGLIAIGVAVQVVLKQAITHETTAGSLLPVVIIAVGAFLFLVAFVGCCGACKEELLSHDYICHLPVSYHACGGGCGIAGYVFRDQVKSEFNKSFQQQMQNYLKDNKTATILDKLQKENNCCGASNYTDWENIPGMAKDRVPDSCCINITVGCGNDFKESTIHTQGCVETIAIWLRKNILLVAAAALGIAFVEVLGIIFSCCLVKSIRSGYEVM

SEQ ID NO: 1016967 - protein, 96 aa, Homo sapiens
AVVAVLRGGRRGHRRRKDDAVGASSSRSGHRPGFVSPSSPVRVGGRHSGGPAHRSLSRCSRPRHGATAAHGLLGGIQVIIGRPKGGPREAGSRRRS

SEQ ID NO: 1016968 - protein, 121 aa, Homo sapiens
AEKALGKAASTIRSIKNVTELRLSDNPAWEGDKGNTKGDKHDDLQRARFICPVVGLEMNGRHRFCFLRCCGCVFSERALKEIKAEVCHTCGAAFQEEDIIVLNGTKEDVEMLKKRMEERRL

SEQ ID NO: 1016969 - protein, 122 aa, Homo sapiens
SYGLAGRGKLIAVIGDEDTVTGFLLGGIGELNKNRHPNFLVVEKDTTINEIEDTFRQFLNRDDIGIILINQYIAEMVRHALDAHQRSIPAVLEIPSKEHPYDAAKDSILRRAKGMFTAEDLR

SEQ ID NO: 1016970 - protein, 64 aa, Homo sapiens
QEDARPKMSVRMTGTGDLQRDADDFSDVTGSSTAGTNMTLDAWQSGARIRHEEREKRTSSLSTI

SEQ ID NO: 1016971 - protein, 168 aa, Homo sapiens
MKPAHSAVCPGHLASCRTKRICTPLRAHVVGALPWQGHPVLGGHLGHMAHPAPPLQNTAHAYLNHPGCGVCLNHAGALKGRFVCRDGARAQVLDVVCIERPKAGGKCTGHSGVCPVTRKFEGLGGGRLGLCISGCPAALPSTNIVTGDVSSRRQKAKHESLEIKLVNP

SEQ ID NO: 1016972 - protein, 66 aa, Homo sapiens
VARVAGLEIDPTCLLLVTTSYGTVDTTYLTHPTDLTAHMDSPHTPEGPARLQRESRNVPADTHPTD

SEQ ID NO: 1016973 - protein, 94 aa, Homo sapiens
VMCLPVAMDREGAPMSTGTGEQAFGIYRVTVCIFYPQAEGDSDNGQWIALTRECLMLQQTHQEGDKWLFRMEAFSADNVCTVNFSRVHLFSPEA

SEQ ID NO: 1016974 - protein, 157 aa, Homo sapiens
ELNDGHSIPVLGFGTYATEEHLKKKSMESTKIAIDVGFCHIDCSHLYQNEEEIGQAILSKIEDGTVKREDIFYTSKLWSTSHRPELVRPSLENSLRKLNLDYVDLYLIHFPVSLKPGNELLPKDEHGNLIFDTVDLCDTWEAMEKCKDAGLAKSIGV

SEQ ID NO: 1016975 - protein, 104 aa, Homo sapiens
MDLLFGKDQPIILVLLDITPMMGVLDGVLMELQDCALPLLQDVIATDKEEIAFKDLDVAVLSGLHAKKGRHGEEETYLKANVENLQIPGHSLGEIRQENQFKVI

SEQ ID NO: 1016976 - protein, 219 aa, Homo sapiens
RFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKTEAFALEKFYRFSDMDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 1016977 - protein, 138 aa, Homo sapiens
FLLYAHLTYVTLPLHRILTDILEVRQKPILMTYRVDLAQSPGRAHALGVLPSAYLSTATGVCDGTPVLEPQPGEATRLPGPGRLHEHQPKLKCLFPPLLALLRLCPPPGPHPESPHPKRTRDAELAMKRERKEQLIQS

SEQ ID NO: 1016978 - protein, 198 aa, Homo sapiens
FLLYAHLTYVTLPLHRILTDILEVRQKPILMTYRVDPAQAPHAARSSGWASCVRSLRRAPAGPMPSECCQVPTCPPPPGSAMARQCWSRSQARPLDSRGRGRLHEHQPKLKCLFPPPANARIRTKGAQNEGTRALRTPRTDNEKKRPTRQTHTQKRDVLPTYSCNPTSANPALTLDTTTNNNGPPGSPRQKNKRERPP

SEQ ID NO: 1016979 - protein, 328 aa, Homo sapiens
GGDCIYRSGSRERAKSRRVSRLKSESHVPALPSPTQAHRGARKPLPGHALPPASQRLLPPGGGPGRVGEETCSRSSSWHCGEVEPQGGHACRAQAGLAFSLYQAMAKDQAVENILVSPVVVASSLGLVSLGGKATTASQAKAVLSAEQLRDEEVHAGLGELLRSLSNSTVRNVTWKLGSRLYGPSSVSFADDFVRSSKAATTTGEQSKINFRDKRSRWQVHQRSGPLRPPTAKLPEVTKDVERTDRGPVVNAMFFQPHWDEKFHHKMVDNRGFMVTRSYTVGVMMMHRTGLYNYYDDNEIVEMPLAHKLSSLIILMPHHVEPLERLEC

SEQ ID NO: 1016980 - protein, 192 aa, Homo sapiens
RLSEHFQIMAFNIIAMFFVIAPDQQYLRFSRLAVLFRFVMTSPPASCRALSRQVFQLKLENIFDNRPFKAYRVILFSLWTVAGHMLGGVIQPANKGYTRVDHHNFAMHPAKHIGAHTKKARAGIVVAEHYASCRQFIDKLIAEIRRTVAIQQDFPLLTPALGLLASSSRMQLFAAVIPKPDKRFKNVRSCAS

SEQ ID NO: 1016981 - protein, 516 aa, Homo sapiens
MPTNGLHQVLKIQFGLVNDTDRYLTAESFGFKVNASAPSLKRKQTWVLEPDPGQGTAVLLRSSHLGRYLSAEEDGRVACEAEQPGRDCRFLVLPQPDGRWVLRSEPHGRFFGGTEDQLSCFATAVSPAELWTVHLAIHPQAHLLSVSRRRYVHLCPREDEMAADGDKPWGVDALLTLIFRSRRYCLKSCDSRYLRSDGRLVWEPEPRACYTLEFKAGKLAFKDCDGHYLAPVGPAGTLKAGRNTRPGKDELFDLEESHPQVVLVAANHRYVSVRQGVNVSANQDDELDHETFLMQIDQETKKCTFYSSTGGYWTLVTHGGIHATATQVSANTMFEMEWRGRRVALKASNGRYVCMKKNGQLAAISDFVGPPPRPAWTGKVAGGAAQQTLSPPGKDEEFTLKLINRPILVLRGLDGFVCHHRGSNQLDTNRSVYDVFHLSFSDGAYRIRGRDGGFWYTGSHGSVCSDGERAEDFVFEFRERGRLAIRARSGKYLRGGASGLLRADADAPAGTALWEY

SEQ ID NO: 1016982 - protein, 492 aa, Homo sapiens
MPTNGLHQVLKIQFGLVNDTDRYLTAESFGFKVNASAPSLKRKQTWVLEPDPGQGTAVLLRSSHLGRYLSAEEDGRVACEAEQPGRDCRFLVLPQPDGRWVLRSEPHGRFFGGTEDQLSCFATAVSPAELWTVHLAIHPQAHLLSVSRRRYVHLCPREDEMAADGDKPWGVDALLTLIFRSRRYCLKSCDSRYLRSDGRLVWEPEPRACYTLEFKAGKLAFKDCDGHYLAPVGPAGTLKAGRNTRPGKDELFDLEESHPQVVLVAANHRYVSVRQGVNVSANQDDELDHETFLMQIDQETKKCTFYSSTGGYWTLVTHGGIHATATQVSANTMFEMEWRGRRVALKASNGRYVCMKKNGQLAAISDFVGKDEEFTLKLINRPILVLRGLDGFVCHHRGSNQLDTNRSVYDVFHLSFSDGAYRIRGRDGGFWYTGSHGSVCSDGERAEDFVFEFRERGRLAIRARSGKYLRGGASGLLRADADAPAGTALWEY

SEQ ID NO: 1016983 - protein, 317 aa, Homo sapiens
SARSAAGEERSVNSSTMVAQQKNLEGYVGFANLPNQVYRKSVKRGFEFTLIVVGNLALESRINQSHYCLTAFVFCQSIQVLLIELRKTVQVEQSKVFIKEGGVQLLLTSSCIPQDLEMQWIIVMAGSLLTDYLDTLNFEELPKMQKSRVRHDVRCLIKRGASVVNTFIRLLQDMALDHVDIELMKRLHEERDYHPTYAKSRHTHTNEECLQVMTADMQASQERKGRCSNFRERCVAQLRANRIGPVHLRAGETMQLKFRDRPRRNPGVRTGRATEPHNSVKQREAIHETQHWYEVKRNPKKRPNAQTAFVASLFSFL

SEQ ID NO: 1016984 - protein, 68 aa, Homo sapiens
YEKGPHGSPSEEPANGEPGRKDHQQPASLCHPVTEEMILGSLVLGFKPFLVVTLGIPLPLAPHLALGN

SEQ ID NO: 1016985 - protein, 123 aa, Homo sapiens
MKLLTGLVFCSLVLGVSSRSFFSFLGEAFDGARDMWRAYSDMREANYIGSDKYFHARGNYDAAKQGTWGCLGCRKRSAMPERISRDSLAMVRRTRWLIRLPMNGAGVAKTPITSDPAGLPEKY

SEQ ID NO: 1016986 - protein, 107 aa, Homo sapiens
MKLLTGLVFCSLVLGVSSRSFFSFLGEAFDGARDMWRAYSDMREANYIGSDKYFHARGNYDAAISDARENIQRFFGHGAEDSLADQAANEWGRSGQDPNHFRSCWPA

SEQ ID NO: 1016987 - protein, 123 aa, Homo sapiens; identical to SEQ ID NO: 1016985

SEQ ID NO: 1016988 - protein, 106 aa, Homo sapiens
MTLVLSSPRIHEVQCCHHLLGSTMTLVLSSPRIHEVQLLSPPTRIHHNPGVIPESTATMCHHPPRAIILGAKYRDGLYFSCPLGPHGTYSCSLKGNQHNRPYSRFH

SEQ ID NO: 1016989 - protein, 126 aa, Homo sapiens
RIAEKRGPERLLFQNDSRGRALFQDVQKPSQDEWKTPGGHGSCLGHRRTLNQALLDLHALGSARADPHLCDFLESHYLDKEVKLHQEDGQPSDQPPQGAGPQPAQTGAPQGSLGEYLFERLTLKHD

SEQ ID NO: 1016990 - protein, 106 aa, Homo sapiens
MIALGISGSLFAITFCPAFCEKTTAFHWPQLWQIVVLQKAAFCGLLSDTFLCTKDGPSPNNYSYSKPNSCCSQVQLMRKFSFVFWSMVLWEVASTAGKQNEQSQQN

SEQ ID NO: 1016991 - protein, 121 aa, Homo sapiens
MATIGQIVLPQKAAFCGLLSDTFLCTKDGPSPNNYSYSKPNSCCSQVQLMRKDSLENPLLAEVFLDFSSSLLFFGAWFFGKWHPLQESRMSRASRTDGVAQIPSVWMVPHWRLITRLTSRN

SEQ ID NO: 1016992 - protein, 96 aa, Homo sapiens
FVRTNDALWPHTVDNLVAPLLRAIPGWALAWAITFVLIATKKIGTHLPQTNYSYSKPNSCCSQVQLMRKFSFVFWSMVLWEVASTAGKQNEQSQQN

SEQ ID NO: 1016993 - protein, 135 aa, Homo sapiens
TQVESHLYLNQSKLLAYCKMNDIVLVAYGALGTQGYKYCINEDTPVLLDDPVLCAMAKKYKRTPALIALRYQLDRGIVALAKSFNEERIRENMQVFDFQLASDDMKILDGLDRNLRYFPADMFKAHPNFPFFDEY

SEQ ID NO: 1016994 - protein, 121 aa, Homo sapiens [sequence omitted]

SEQ ID NO: 1016995 - protein, 121 aa, Homo sapiens [sequence omitted]

SEQ ID NO: 1016996 - protein, 343 aa, Homo sapiens
YVRGPGVYSACSPRHGGACVGTCVAAALLVGFILFLTRSRGRAASAGQEPLHNDGAGMEQAGVAQPGAPVMPDVMPEMLDGRPLAAWTVTWCMPAYMALAVLSPCWVAWARMQMTNEEECCHPSPGWRKVVGECQLETHLSGENWTLRNCGSSEEKQARKAQREADGELNVRMRKRLESQREAEWKKEEERLRLEEEQNGGGGEEVAGEEHVPEREHEEYLKLKEAFVVEEEGVGETMTEEQSQSFLTEFINYIKQSKVVLLEDLASQVGLRTQDTINRIQDLLAEGTITGGFDDRGKFIYITAEELGGVELAYDKRGEVSIAELAQSMKSLIAWAGVPRQPS

SEQ ID NO: 1016997 - protein, 149 aa, Homo sapiens
QGLMDPMGFNGNFRRLRVPRLAVKEYLKLKEAFVVEEEGVGETMTEEQSQSFLTEFINYIKQSKVVLLEDLASQVGLRTQDTINRIQDLLAEGTITGGFDDRGKFIYITAEELGGVELAYDKRGEVSIAELAQSMKSLIAWAGVPRQPS

SEQ ID NO: 1016998 - protein, 192 aa, Homo sapiens
MRYAEGGCFSFQYFFEAEEEIRVHLNNNPKLLATTNTWGKPQGKRLHEALDEMTTPQQTTPQTKKNDMMQSSGKEDILNKLTPEKFDKLCLELLNVGVESKLILKGVILLIVDKALEEPKYAHCMLSYVCDWQKMHQTLMAQQQMGQPGQKSTTFRRLLISKLQDEFENRTRNVDVYDKRENPSSPREEQRA

SEQ ID NO: 1016999 - protein, 79 aa, Homo sapiens
EVARDTAIETLPLYLFAPPIPGVSLGPQHSLGICSPQKPSLRNEYLVSILGLEVLQGSPLEVEYPGLSHRTGFTLSSDA

SEQ ID NO: 1017000 - protein, 120 aa, Homo sapiens
LQASPIFCVDFLMQNMQLPRCSGICKSNGCCFHHARISSFSKSDSSARYLIPGFGFSAFGSSALMPIHVVLIPSPEMGHHSIWVKGNEFLIWSVAGTAPPTYGELPYFFTISINGFRTGI

SEQ ID NO: 1017001 - protein, 119 aa, Homo sapiens
FEEVSVLGFEEFDKAVKEHEGKTIFAYFSGSKDTEGSWCPDCVEAEPVIREGLKHVTEDCVFIYCQVGDKPYWKDPNNDFRQKLKITAVPTLLKYGTPQKLVESECCQSSLVEMIFSED

SEQ ID NO: 1017002 - protein, 202 aa, Homo sapiens
PTPTPTPTPTVGNYSIRNGNTTCLLATMGLQLNITEEKVPFIFNINPATTNFTGSCQPQSAQLRLNNSQIKYLDFIFAVKNEKRFYLKEVNVYMYLANGSAFNISNKNLSFWDAPLGSSYMCNKEQVLSVSRAFQINTFNLKVQPFNVTKGQYSTAEECAADSDLNFLIPVAVGVALGFLIIAVFISYMIGRRKSRTGYQSV

SEQ ID NO: 1017003 - protein, 201 aa, Homo sapiens
PTPTPTPTPTVGNYSIRNGNTTCLLATMGLQLNITEEKVPFIFNINPATTNFTGSCQPQSAQLRLNNSQIKYLDFIFAVKNEKRFYLKEVNVYMYLANGSAFNISNKNLSFWDAPLGSSYMCNKEQVLSVSRAFQINTFNLKVQPFNVTKGQYSTAQDCSADEDNFLVPIAVGAALGGVLILVLLAYFIGLKRHHTGYEQF

SEQ ID NO: 1017004 - protein, 183 aa, Homo sapiens
WALLLMILLQSVQRVQQEIDEVIGQVHPEMADQAHMPYTNAVIHEVQRFGDIVPLHLPRITSRDIEVQDFLIPKGTILLPNMSSVHMDDTVWEKPLRFHPEHFLDAQGHFVKHEAFITFSAGRRSCLGDPWPEWSSSSSSCLLQRFSFSVPDGQPQPSDHRVFSIMVAPSPYQLCAVIREQGH

SEQ ID NO: 1017005 - protein, 102 aa, Homo sapiens
RWWRAWTQQALPAADTGSDTRDKGRGECSGRAADFDLLVIRWGIRWPSLCQGSCSSWERRWLWLTMWNLLPEAPSGALVAPVSTWVAYPKKLDASGFTAWGA

SEQ ID NO: 1017006 - protein, 430 aa, Homo sapiens
MELLKALLLLSGVFGALAEFCVIPRIDSQLVEKLGQRLLPWMDRLSSEQLNPSVFVGLRLSSMQAGTKEDLYLHSLKIHYQQCLLRSTSSDDNSSCQPKLSGGSLALYLLALRANCEFFGSRKGDRLISQLKWFLEDEKKAIGHNHEGHPNTNYYQYGLSILALCVHQKRLHDSVVGKLLYAVEHDYFTYQGHVSVDTEAMAGLALTCLERFNFNSDLRPRITMAIETVREKILKSQAPEGYFGNIYSTPLALQMLMTSPASGVGLGTACIKAGTSLLLSLQDGAFQNPLMISQLLPILNHKTYLDLIFPDCQASRVMLVPAVEDPVHISEVISVTLKVASALSPYEQTFFVFAGSSLEDVLKLAQDGGGFTYGTQASLSGPYLTSVLGKDAGDREYWQLLRAPDTPLLQGIADYKPQDGETIELRLVRW

SEQ ID NO: 1017007 - protein, 114 aa, Homo sapiens
NPVLGFLYLPPAGSIPIILALPIQHYVFHFSPLSIWYLSICTNYVGICPMSRFSTFDSVFKAKPCSVSQAGVLWRDFGSLQPPPSKFKRFSCLSFQVAGITGMWYHAWLIFLYF

SEQ ID NO: 1017008 - protein, 162 aa, Homo sapiens
MHLSLGLLTLRTNPTLRYKIYERLTGRGTNPRHPYTASPHPTTRHRRYHSAQHINAVSAVMAQQWNHVATQNHGPRWPPYYGNYDYGSLLREHHRVAQVHSSQCDPEAPRRPLPAFRPPSACHRPLLVPPARSRGVCAMGSSQGCHPYQPTASPHEGLPSPP

SEQ ID NO: 1017009 - protein, 92 aa, Homo sapiens
VVVYLPVLLPIGEDGPGDSAEGPAVICAACVLCSLVKTIDQFEYDGCDNCDAYLQMKGNREMVYDCTSSSFDGIIAMMSPEDSWVSKWQRVT

SEQ ID NO: 1017010 - protein, 92 aa, Homo sapiens; identical to SEQ ID NO: 1017009

SEQ ID NO: 1017011 - protein, 193 aa, Homo sapiens
KAKELTKIAIDAGFHHFDSASVYNTEDHVGEAIRSKIADGTVRREDIFYTSKVWCTSLHPELVRASLERSLQKLQFDYVDLYLIHYPMALKPGEENFPVDEHGKLIFDRVDLCATWEAMEKCKDAGLTKSIGVSNFNYRQLEMILNKPGLKYKPVCNQVECHPYLNQMKLLDFCKSKDIVLGAKVSRTHDMDG

SEQ ID NO: 1017012 - protein, 90 aa, Homo sapiens
KKGEKQIPGEEKGRKRRRVKEDKKKRDRDRLENEAEKISSVHAPFRLDLPPEKPLTSSLANKKSRQTPFRALITHETLQRKIQCFFHSCD

SEQ ID NO: 1017013 - protein, 81 aa, Homo sapiens
RLSSFAQSARLLPATMSDKPDMAEIEKFDKSKLKKTETQEKNPLPSKETIEQEKKLANRNEASAPICTVHSTSIAFLFYFF

SEQ ID NO: 1017014 - protein, 67 aa, Homo sapiens
RHCFGCTGVRKALIDTPLDGYETARYGTGVFGQNEYLRYQEALSELATAVKARIGALSDITSQQPKT

SEQ ID NO: 1017015 - protein, 67 aa, Homo sapiens; identical to SEQ ID NO: 1017014

SEQ ID NO: 1017016 - protein, 107 aa, Homo sapiens
MELVLVFLCSLLAPMVLASAAEKEKEMDPFHYDYQTLRIGGLVFAVVLFSVGILLILSRRCKCSFNQKPRAPGDEEAQVENLITANSNRAPESRELKCSHQVEASGT

SEQ ID NO: 1017017 - protein, 96 aa, Homo sapiens
EAAQKAVRAMAALTDHPYASLTLPDDAASDCLFLRPGLPGATPFLLHRGGGDLPNSQEALQKLSDVTLVPVSCSELEKAGAGLSSLCLVLSTRPHC

SEQ ID NO: 1017018 - protein, 279 aa, Homo sapiens
LGLIGEAELSHYYQTQGEGYAKPNEGAIVEVALEGYYKDKLFDQRELRFEIGEGENLDLPYGLERAIQRMEKGEHSIVYLKPSYAFGSVGKEKFQIPPNAAAEYMNYTSRVLKQARGVLGDEFRSSKLEHQSHPSVAQAAAGHWCHFPLDRSQSPQPQLSLTVHTARIVSWLAIMSLVFFQVSEAPGKQQCPFDWALSAYNLAMCPSDNIAGLLCLTIGKLYTEALTTGQASNEKGLFRRGEDHLAENDYEPGTACIPERACSIYPKQGQAPRPSMDDV

SEQ ID NO: 1017019 - protein, 269 aa, Homo sapiens
LGLIGEAELSHYYQTQGEGYANPNEGAIVEVALEGYYKDKLFDQRELRFEIGEGENLDLPYGLERAIQRMEKGEHSIVYLKPSYAFGSVGKEKFQIPPNAAAEYMNYTSRVLKQARGVLGDEFRSSKLEQSTIVKERGTVYFKEGKYKRAGLQYKKIVSSAGHHAVLVFFQVSEAPGKQQGPFDWALSASNLGHVSSDNIAGLLCLTIGKLYTEALRTGQASNEKGLFRRGEDHLAENDFEPGTACIPRTGLQHLPPARTGAKTQLDDV

SEQ ID NO: 1017020 - protein, 136 aa, Homo sapiens
SRSQALPVVPTSLSFRLAGVHSSLSDCGVFAEGHIELQVESGVPLGFSTMAEDMETKIKNYKTAPFDSRFPNQNQTRNCWQNYLDFHRCQKAMTAKGGDISVCEWYQRVYQSLCPPSWVTDWDEQRAEGTVSPGKI

SEQ ID NO: 1017021 - protein, 147 aa, Homo sapiens
MALRACGLIIFRRCLIPKVDNNAIEFLLLQASDGIHHWTPPKGHVEPGEDDLETALRETQEEAGIEAGQLTIIEGFKRELNYVARNKPKTVIYWLAEVKDYDVEIRLSHEHQAYRWLGLEEACQLAQFKEMKAALQEGHQFLCSIEA

SEQ ID NO: 1017022 - protein, 147 aa, Homo sapiens; identical to SEQ ID NO: 1017021

SEQ ID NO: 1017023 - protein, 147 aa, Homo sapiens; identical to SEQ ID NO: 1017021

SEQ ID NO: 1017024 - protein, 147 aa, Homo sapiens; identical to SEQ ID NO: 1017021

SEQ ID NO: 1017025 - protein, 147 aa, Homo sapiens; identical to SEQ ID NO: 1017021

SEQ ID NO: 1017026 - protein, 147 aa, Homo sapiens; identical to SEQ ID NO: 1017021

SEQ ID NO: 1017027 - protein, 93 aa, Homo sapiens
RRRLSQCSIAVKRHLDHSNSYKGKHFIGAGLPFLRFGRENDNMQVNMVLEEVAKSSTSEYTGKPGVVAHAFNPSILEAEVGRFLSSRPAWSTE

SEQ ID NO: 1017028 - protein, 105 aa, Homo sapiens
EGQQFAEGVNAQMLQHAESRVVTYQTFKKRTTGVFNIDIAVSYRRDDLSGDGAFQCTTTGNSNSTGYRQRAMARMRHKITHINCPAFLRWRNKHRFRDNHITDIT

SEQ ID NO: 1017029 - protein, 224 aa, Homo sapiens
MDGGCRSPQVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQADSPEDMHSWIKEIGAAVQALKCHPREELPFLDASVNSMNSSQAGMFYLVM

SEQ ID NO: 1017030 - protein, 178 aa, Homo sapiens
MDGGCRSPQVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQVQCTI

SEQ ID NO: 1017031 - protein, 98 aa, Homo sapiens
HYGSSSFGSLTFFMAVCKEQFLMNCCKELSGDQNEISLKNIKCNEHFIIMRLETLKAMLKPIRGMRLILSYCVGELAASHRYVGIVTHWLIHLKQQCE

SEQ ID NO: 1017032 - protein, 220 aa, Homo sapiens
RADAERPDQVRGAGPASAPPAEAEPETRGGSTDAGAGMATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPALKAIRDRKARLACDLLPCNSDLRDLLSS

SEQ ID NO: 1017033 - protein, 175 aa, Homo sapiens
MATLRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPALKAIRDRKARLACDLLALQQ

SEQ ID NO: 1017034 - protein, 185 aa, Homo sapiens
SGRTPSGQIRYAGRALRPPLPPRLSLRPGADRLTPGPGWRRLGPARTGPAARIPARCSAYSRRWRRWTSRHYASRNGHYAVCQFLLESGAKCDAQTHGGATALHRASYCGHTEIARLLLSHGSNPRVVDDDGMTSLHKAAERGHGDICSLLLQHSPALKAIRDRKARLACDLLPCNSDLRDLLSS

SEQ ID NO: 1017035 - protein, 220 aa, Homo sapiens; identical to SEQ ID NO: 1017032

SEQ ID NO: 1017036 - protein, 211 aa, Homo sapiens
RADAERPDQVRGAGPASAPPAEAEPETRGGSTDAGAGMATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHICSLLLQHSPALKAIRDRKARLACDLLPCNSDLRDLLSS

SEQ ID NO: 1017037 - protein, 245 aa, Homo sapiens
RADAERPDQVRGAGPASAPPAEAEPETRGGSTDAGAGMATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPALKAIRDRKARLACDLHRPVLQAPALVSIHAAGQGTEARPPRKSPSLVTVEARE

SEQ ID NO: 1017038 - protein, 211 aa, Homo sapiens
RADAERPDQVRGAGPASAPPAEAEPETRGGSTDAGAGMATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDSRELRPDHPGRAPVWSLWKRGSRFGVAKSV

SEQ ID NO: 1017039 - protein, 297 aa, Homo sapiens
MATPRPCADGPCCSHPSAVLGVQQTLEEMDFERLLRGVTGTANSPALQGTIRGTAIGYGSAHVHCCLATVTCGTCYPAEPPPYLQLPLKGKWRRVEGKVLGFGHGVPDPGAWPSDWRRGPQEAVAREKLKLDLKDASRRKLDPIYPRYQDFKFWTYTWNDLEKKIESYNKKENSDLSNQVVHQTQATMQQHEKKGRQNHTGEKQEQERTGADVHEEEHKERTGSNRRTDKAKTEKGTKTTKTRSHSPATDGTDTEGQHKPEATNADRRQQKRGPLQGRLKEPHNEDTQKKKRKRTRR

SEQ ID NO: 1017040 - protein, 220 aa, Homo sapiens; identical to SEQ ID NO: 1017032

SEQ ID NO: 1017041 - protein, 221 aa, Homo sapiens
RADAERPDQVRGAGPASAPPAEAEPETRGGSTDAGAGMATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPALVSIHAAGQGTEARPPRKSPSLVTVEARE

SEQ ID NO: 1017042 - protein, 208 aa, Homo sapiens
RADAERPDQVRGAGPASAPPAEAEPETRGGSTDAGAGMATPRPCADGPCCSHPSAVLGVQQTLEEMDFERGIWSAALNGDLGRVKHLIQKAEDPSQPDSAGYTALHYASRNGHYAVCQFLLESGAKCDAQTHGGATALHRASYCGHTEIARLLLSHGSNPRVVDDDGMTSLHKAAERGHGDICSLLLQHSPVWSLWKRGSRFGVAKSV

SEQ ID NO: 1017043 - protein, 133 aa, Homo sapiens
TLAGDVHIVRGDFDEKSELPQNKRLWTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKS

SEQ ID NO: 1017044 - protein, 255 aa, Homo sapiens
SGVPPGSRQGAELRSRLVSRVHRSIPASFCPSERTLQEQPRGWHGSEHRHGMGWRRASASCQSMGDPKGPVGEEMNGKRNVGQAVQRTARVADGKSVTGTDVDIVLLPKSTGKSSSGHQAMRESEKALDRSWRPQKIQGERAADGGLLMPSASWWQAKEPDRMWASLKQNPGGAVERTDGPPGDTQGLPQGSASMRSGKGQRHWRDRQDILDDSGYVTPPTRMTAPTMPRGNKLRLGKDRLPSADDTDKRLKAGY

SEQ ID NO: 1017045 - protein, 75 aa, Homo sapiens
SCARLGGAVEPPEGDRGIQKPLPGLPWEEADPGPASDRGMGWSCRKALGRGRQRGHWLLLCCRRRTGSSAYTELY

SEQ ID NO: 1017046 - protein, 83 aa, Homo sapiens
SGGSCQSKAKRKEAGPLEVVVTTPAMWRSLWLALALCLLPSGGTESQDQSSLCKQPPAWSIRDQDPMLNFNGSVTVVALLQAS

SEQ ID NO: 1017047 - protein, 83 aa, Homo sapiens; identical to SEQ ID NO: 1017046

SEQ ID NO: 1017048 - protein, 103 aa, Homo sapiens
LDSFPHRRQSGPAPLRSFPPIGPLWPVGEFRREAFPLEVVVTTPAMWRSLWLALALCLLPSGGTESQDQSSLCKQPPAWSIRDQDPMLNFNGSVTVVALLQAS

SEQ ID NO: 1017049 - protein, 83 aa, Homo sapiens; identical to SEQ ID NO: 1017046

SEQ ID NO: 1017050 - protein, 379 aa, Homo sapiens [sequence omitted]

SEQ ID NO: 1017051 - protein, 281 aa, Homo sapiens; identical to SEQ ID NO: 766224

SEQ ID NO: 1017052 - protein, 81 aa, Homo sapiens
MKWVALLLLAAWAAARTAEVSSFRVKENFDKARFSGTWYAMAKKDPEGLFLQDNIVAEFSVDETGQMSATAKESSLLNNLG

SEQ ID NO: 1017053 - protein, 255 aa, Homo sapiens
FDRVLLNDGGYYDPETGVFTAPLAGRYLLSAVLTGHRHEKVEAVLSRSNQGVARVDSGGYEPEGLENKPVPDEQPSPGTPGAVFPSLNSCRAAGLGTRSAVTTWSIGRQRGSTREEPLTIFQAVALLYGGPRSLKQRVELGSQPKCLRSGEDDMVGVLAGSWGVFSLKTGGTYGPGQMRLTPWAPQAGHTAPQEDGLLPTPPGRARLQGRARGPAIGRLFAPECGSPTRKPPSQGPALPEGQPDSIGNTVQVPVT

SEQ ID NO: 1017054 - protein, 120 aa, Homo sapiens
MSSSDSSDSSFFASTFFSSAGAAAVDGAAPPAGAVQLLERPTSPYIADEAPNVDIGQSLGKQARPERFDADTSCFNEGIDLILRDRHLVVVQDEGGVDASELGDGSHAVDCRHGASRRMK

SEQ ID NO: 1017055 - protein, 110 aa, Homo sapiens
IYPTVQYPLEVLGLHLIESGNLTDEGQQYCCRLVEMDSKSGPGLIGLGIKALQDKKYEDAVRNLTEGLKESPVCTSGWYHLAEAQVKMHRPKEAVLSCSQGIFDTFWVDI

SEQ ID NO: 1017056 - protein, 77 aa, Homo sapiens
RGGGIQDEEREESPSPPPPPPPVGGGLREETVADLGMFWKKRIYPKIENWKQPLMCMMVVLIQSVGMTRENIFIGLR

SEQ ID NO: 1017057 - protein, 139 aa, Homo sapiens
LQDNSSYPDEPWRITEEQREYYVNQFRSLQPDPSSFISGSVAKNFFTKSKLSIPELSYIWELSDADCDGALTLPEFCAAFHLIVARKNGYPLPEGLPPNSGSQEYLEGKLFLKAQNGDFSIYFEFLIPEVTAGQINLVN

SEQ ID NO: 1017058 - protein, 147 aa, Homo sapiens
RWKAQCMRKGSHERECPTKLVSGGCPSWAPLAAIGFILILVFTHLALAKEGPGSAKQTAVPSEGSGVNDPKQPQLGGWPQLPLNSLRKDPVPKMHWGPRQSKSPSPCWSEDIITGMSPKPEHLLYGMTMGTLQMAALCPIKAQRARL

SEQ ID NO: 1017059 - protein, 99 aa, Homo sapiens
VLERRRSSMGKSKLGRSCRAGIMMRDFTPSGIAGAFRRGYDRYYNKYINVRKGSISGISMVLAAYVVFSYCISYKELKHERRRKYHLKRGRWRALHGRA

SEQ ID NO: 1017060 - protein, 120 aa, Homo sapiens
MTRMSVFPQGNSFLPDALFGHDADPESISSIHIPLGCRNEDIFHQPHGSVQRQGDVLYILHIFEANLVVEQRLQHGIAEPPALKESLWVRAHWVKAVHSSLSFFIKSSNDVVNIVREEAP

SEQ ID NO: 1017061 - protein, 198 aa, Homo sapiens
MAAPAPLTAKEAQGWGAPLPSNDRPCHILTLAQQENTAGPSERCRPLQPAMPLDHEGDPAVHVMRFPFTTIAYRAEVWVAFESSLGVLLVYKIAIMPSDELTDICFPTVLGGWRPEIEVPDTISVMPEPRRSRAKPQRGHKHLRRTTESLQVFSPVESGSRCRWSQLSNSSSPASTTEQTQLHFSVEPPVDTESHWGV

SEQ ID NO: 1017062 - protein, 142 aa, Homo sapiens
APTPSPPHARPLAFAEPKWINYTLSVSLRAVLSRCAPARLSLSSLPLCPLFRSRPFSVLHICLSTAYHLAPFYSLIQEVTSVSQSTRYAPTTIEGTNDLVQPQRHGEDKRVIPWKKGTRMDRLKDRKHERYTHKKENGRGVH

SEQ ID NO: 1017063 - protein, 110 aa, Homo sapiens
FENLMESSKKAFIFQTPKLSKFLPCPAVFVEKYHQSFQNLGRNQMKRKLFVETGKALLAEGHHFKEEVREARTVSVRLQASSEGHEPQEDDDLAQRGQVKQEPETAPSPP

SEQ ID NO: 1017064 - protein, 189 aa, Homo sapiens
MAASTSMVPVAVTAAVAPVLSINSDFSDLREIKKQLLLIAGLTRERGLLHSSKWSAELAFSLPALPLAELQPPPAITEEDAQDMDAYTLAKAYFDVKEYDRAAHFLHGCNSRKAYFLYMLFQISVWGKTGDETVDCLGPLGGQVKGALGGLWVGLSKHQARELDGFGLSLSGVVLRKLGLVNEIDVFVE

SEQ ID NO: 1017065 - protein, 125 aa, Homo sapiens
MAASTSMVPVAVTAAVAPVLSINSDFSDLREIKKQLLLIAGLTRERGLLHSSKWSAELAFSLPALPLAELQPPPAITEEDAQDMDAYTLAKAYFDVKEYDRAAHFLHGCNSRKAYFLYMLFQISG

SEQ ID NO: 1017066 - protein, 126 aa, Homo sapiens
RRNGPRLRPRDLRGKKKEELLKQLDDLKVELSQLRVAKVTGGAESKLSKIRVVRKSIARVLTVINQTQKENLRKFYKGKKYKPLDLRPKKTRAIARRLTKHEEKLKTKKQQRKERLYPLRKYAVKA

SEQ ID NO: 1017067 - protein, 153 aa, Homo sapiens
QAHRASGKVSARSRVSSPHCGRGDSERPLDEIAKAQVAQPAATRIFGKIIRKEIPAKIIFEDDRCLAFHDISPQAPTHFLVIPKKHISQISVADDDDESLLGHLMIVGKKCAADLGLKRGYRMVVNEGADGGQSVYHIHLHVLGGRQMNWPPG

SEQ ID NO: 1017068 - protein, 282 aa, Homo sapiens
LAPVPETRAMSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKTSEKSPSGRVAKYVSHGATGKGNDQVRFELHAATHLDLHQIQGHLLPGGCLNSTTVFKGRNDLDGVRKATLGIPNTRVHSQRNPWSMDENLNATSATRLESWKNPKKPSASRSLHEEARTQTKPQTPLTFSQIEFKERVPVRVTNVTDGTNAQTSLELLHVPERSRGQHGLG

SEQ ID NO: 1017069 - protein, 284 aa, Homo sapiens
GQHAFPVYNASYSRGSVTAETPWGGLDTSCILVWLKEQGYDVIAYLANIGQKEDFEEARKKALKLGAKKVFIEDVSREFVEEFIWPAIQSSALYEDRYLLGTSLARPCIARKTSEKSPSGRVAKYVSHGATGKGNDQVRFELHAATHLDLHQIQGHLLPGGCLNSTTVFKGRNDLMEYAKATLGIPNTRVHSQRNPWSMDENLNATSATRLESWKNPKKPSASRSLHEEARTQTKPQTPLTFSQIEFKERGPCEVTNVTDGTNAQTSLELLHVPERSRGQHGLG

SEQ ID NO: 1017070 - protein, 50 aa, Homo sapiens
DTSLHSFLRALRSLLSPDMANKGPSYGMSREVQSKIEKKYSRQLEERLGG

SEQ ID NO: 1017071 - protein, 123 aa, Homo sapiens
YSRRSKMNPLWNTMVIGGYADGESFLGYVDMLGVAYEAPSLATGYGAYLAQPLLREVLEKQPVLSQTEARELVERCMRVLYYRDARSYNRFQIATVTEKGVEIEGPLSAQTNWDIAHMISGFE

SEQ ID NO: 1017072 - protein, 140 aa, Homo sapiens
VFSRTRDLMRAGVLKEKPLWYDIYKAFPPLREPVFRSPAAIRQSKADIQDIFYQEDQIRAKFFATYGSGQKAFDLFNPNFKSTCQRFVEKVHRASESLEKQIEEKLFVETGEGSVGQEGIILKKSSEKPRTVSVRLQASS

SEQ ID NO: 1017073 - protein, 97 aa, Homo sapiens
PDVQTMSHLVEPPPPLHNNNNNCEEGEQPLPPPAGLNSSWVELPMNSSNGNENGNGKNGGLEHVPSSSSIHNGDMEKILLDAQHESGTEQLKRQFAL

SEQ ID NO: 1017074 - protein, 76 aa, Homo sapiens
VTTLPDMPTVGGDITPAQTSIKTTTPPTTPPPFTGGDFTHFFQNLLSSDAHGLGFLRHKFDDLRFCDELSLLSANP

SEQ ID NO: 1017075 - protein, 159 aa, Homo sapiens
RHEGGVSSVLVPKWISAGLRQMQAWGKSPFWTEKRRMEKPLFPLVPLHWFGFGYTALVVSGGIVGYVKTGSVPSLAAWLLFGSLAGLGAYQLLSSDPEETVYEAILLASYILLLLSRVLWRMRSYYYGKFMPVGLDVQVPGLLMAAKSGSSVCWTDNLT

SEQ ID NO: 1017076 - protein, 178 aa, Homo sapiens
PHTHLAYARARGADRMSSFGDFVALSDVCDVPTAKIISREVSDIIPPGYEEEALTILSKKKNGNYCVLQMDQSYKPDENEVRTLFGLHLSQKRNNGVVDKSLFSNVVTKNKDLPESALRDLIVATIAVKYTQSNSVCTPRTGRLSALEQDSSLVYTALALQEIRQTIGGLDTIHKCFR

SEQ ID NO: 1017077 - protein, 178 aa, Homo sapiens; identical to SEQ ID NO: 1017076

SEQ ID NO: 1017078 - protein, 125 aa, Homo sapiens
MRRHTPRDTRRVGNSHKPLHPAFTPHYVLLRAGRGPCPSGSLVSSEASLSRKCGEVPAPGARPRPPPFFPTLRTRGRQGRGGGGEAGASRPPGSPPPAGPEPRGGAGRGRRRGPGVESDFLLRGR

SEQ ID NO: 1017079 - protein, 138 aa, Homo sapiens
MEKHFKNGMAVARFLETNPRVEKVVYPGLPSHPQHELAKRQCSGCPGMVSFYIKGALQHAKAFLKNLKLFTLAESLGGYESLAELPAIMTHASVPEKDRATLGINDTLIRLSVGLEDEQDLLEDLGSSFERQRTLKKF

SEQ ID NO: 1017080 - protein, 365 aa, Homo sapiens
TSSNHLWAPPACTFISTFSQHLRQTPAMANHAPFETDISTLTRFVMEQGRKAQGTGELTQLLNSLCTAIKAISSAVRQAGIAQLYGIAGLNQCDWGSSKKLDILSNDLVINMLKSSYATCVLVSEENTNAIIIEPEKRGKYVVCFDPLDGSSNIDCLVSIGTIFGIYRKKSTDEPSEKDALQPGRDLVAAGYALYGSATMLVLAMDCGVNCFMLDPSIGEFIMVDRDVKMKKKGNIYSLNEGYAKDFDPAINEYLQRKKFPPDGSAPYGARYVGSMVADIHRTLVYGGIFLYPANKKSPSGKLRLLYECNPIAYVMEKAGGLATTGDKDILDIVPTEIHQKAPVVMGSSEDVQEFLEIYRKHKAK

SEQ ID NO: 1017081 - protein, 113 aa, Homo sapiens
DEVREAAAPEPRAHQTGSREETDRAGPMKADVEIPFEEVLEKAKAGDPKAQTEVGKHYLRLANDADEELNSCSAVAWLILPALSLLCVGFVFQICVYVDFMVVFLIYLVAAKP

SEQ ID NO: 1017082 - protein, 68 aa, Homo sapiens
ARALERWRQRRQRRKCSPRGPALMVAGIWEPARARRRRQKLPAKILGGVCWWYSQKKDNVGSEARFQG

SEQ ID NO: 1017083 - protein, 100 aa, Homo sapiens
VEIDHHRGLHPYLHLEQTDEEEEGLVLLSWVAQLEENPHISGLSSSSNSCCSRVDCIYFSEAKFQNFDQIPQSPLKKLESLFQNGIAGRPWGIWFLDFTT

SEQ ID NO: 1017084 - protein, 242 aa, Homo sapiens
ARADMLCEAGRFGQKTGKGWYQYDKPLGRIHKPDPWLSEFLSQYRETHHIKQRSISNEEILERCLYSLINEGIPHLGGGDGRYAMSTSDVIYFAWVWVAKARGWAHVLCCLSWAATVLEKLQKYYRQNPDIPQLEPSDYLRRLGCPGKPSSERMAKLGKDPIAANCDSAFCILPCMVASNFSVIIPKIQTDFSEVQMIDLLLLLLLLVVVVLNGQQKPLSVSSYLIILMARFQECVFYTSDG

SEQ ID NO: 1017085 - protein, 107 aa, Homo sapiens
RVNRIGDCGGRAEPWPPHNGPRVWESDADAHVISYSLSPFEQRAYPHVFTKGIPNVLRRIRESFFRVVAAVCSVLSYLHMGGLKSSRDPRGRIQLPMKMTNEQRTSG

SEQ ID NO: 1017086 - protein, 124 aa, Homo sapiens
FPGILSGLFFLMDSFCIKYSLVLKLGVGGSAFSPQLRRQRQRGQRERQRERPERQRQRQVDILEYSLVYRSSSRTARATQRNPVLKKKKKIPLVLKQNHGYHCVHTESKSGWAQGFQLHLYVWI

SEQ ID NO: 1017087 - protein, 203 aa, Homo sapiens
GLRMRHDVRGVSQELGEGKRAPGPVPEARIRIYSMRFCPFAERTRLVLKAKESGMKSSDIKPEHISPELGSFTDKIRYGSCVPRFLGKNKSRGSSVGILRKILGPSPTVDDVACDERITQWKKLLPDDPYEKACQKMILELFSKVPSLVGSFIRSQNKEDYDGLKEEFRKEFTKLEEVLTNKKTTFYGGNSISMIDNLIWPWY

SEQ ID NO: 1017088 - protein, 68 aa, Homo sapiens
ARIRPRVEDEDHFPEKSKVIISKEVYKCLVGMENEDKKKRRTMEKAQLGTEQQPAAKVTNSWDSRRVV

SEQ ID NO: 1017089 - protein, 184 aa, Homo sapiens
CYCCRKCCHWKCRGKCIQCTSASSLVLDHISKGATTPPASSQSVAKGSHQPFDVSAFNASYSDSGLFGIYTISQAAAAGEVINAAYNQVKAVAQGNLSSADVQAAKNKLKAGYLMSVETSEGFLSEIGSQALAAGSYMPPSTVLQQIDSVADADVVKAAKKFVSGKKSMAASGNLGHTPFLDEL

SEQ ID NO: 1017090 - protein, 152 aa, Homo sapiens
EEPRYKKDKASSNEENPSLSAATSPKLEVDAIVNAANSSLLGGGGVDGLQFSRRPPASDECRTLQSCKTGKAKITGGYRLPAKYVIHTVGPIAYGEPSASQAARLRSCYLSSLDLLLVMTLRSVAFPCISTGVFGYPCELAAEIVLATLREW

SEQ ID NO: 1017091 - protein, 121 aa, Homo sapiens
IATVEISIVENSWAPLEPVHLAENLKVVYPHSIAQVHWSGGDVHYQLESQPPGPFDVDTEGMLHVTMEPGPGAQAEYQLQVRAQNSHGEDYAEPLELQVVVMDENDNAPVCSPHDPTVNIP

SEQ ID NO: 1017092 - protein, 119 aa, Homo sapiens
MKLLAELVLLLTICSLEGALVRRQAKEPCVETLVSQYFQTVTDYGKDLMEKVKEPRSFQAEAKSLLFEKFKGAADTPGSKKDWKRNWLTSLAISVELGTQPCHPVKCARPFSSNPSWPL

SEQ ID NO: 1017093 - protein, 73 aa, Homo sapiens
QEGTALHLQTSLPALSEADTQELTQILRRMKGLALEAESELERQDEALDGVAAAVDRATLTIDKHNRRMKRLT

SEQ ID NO: 1017094 - protein, 105 aa, Homo sapiens
QEGTALHLQTSLPALSEADTQELTQILRRMKGLALEAESELERQDEALDGVAAAVDRATLTMFCGCCRSVDHGGTPRTLGTGLEEAALVLSRLPFMDRLAFLAVL

SEQ ID NO: 1017095 - protein, 73 aa, Homo sapiens; identical to SEQ ID NO: 1017093

SEQ ID NO: 1017096 - protein, 155 aa, Homo sapiens
MLLSPDPSHSATGNLLNLEVGGDCPCRPRHLVAPAPLLGFADDVPQEPVPTLWNEPAELPSGEGPVESTSPGREPVDTGPPAPTVAPGPEDSTAQERLDQGGGSLGPGAIAAIVIRRPAGHLAWVLALGGSFALKKVFLAFLKRIKVVARGATRL

SEQ ID NO: 1017097 - protein, 81 aa, Homo sapiens
MVERIDEGVFIVEEGDALVTKNLVPGESVYGERRVSISEEMTNEDRAWTLPSKLAAAILGGVDQIHINRGLRSLPGAPGTK

SEQ ID NO: 1017098 - protein, 76 aa, Homo sapiens
MPAPDPATPTVAAPAPMNLAAVSMSREMTLVWNSVGPPGRGELLQEGCLDGASGLLRREADTGLIRPLVQERIRAG

SEQ ID NO: 1017099 - protein, 123 aa, Homo sapiens
RRRTQPLPTSGVFFQATQDIFSFCYPRFPLFSTSLWLASPPRGAPIRGGVLRLPYGDNSTFEVSVLGNICGLQGQSQVWGSPSPYDQCWGIPWEPRFFEAPAPLLTTLEWVVPVFIEIKDPFP

SEQ ID NO: 1017100 - protein, 151 aa, Homo sapiens
ATSGAKKITIFTDAKESSTVFELKRIVGGASSKRPPEEQRAFTRMTSSLMMAKTLGECGFTSQTAPPQAPATVGLAFRADDTFEALRIEPFSSPPELSRCDESHRILEAVPMNKLCSEGPRPTPLETHFPNKKILAVYLIDFFWFPSWFTE

SEQ ID NO: 1017101 - protein, 72 aa, Homo sapiens
MELILLTDPAAAACVPLERQTSAPPIRFPFLPPQLAESSRAHRSAPYENEVVTGPRMTPRHHCEAYSSAGGG

SEQ ID NO: 1017102 - protein, 187 aa, Homo sapiens
MMKLWVPSRSLPNSPNHYRSFLSHTLHIRYNNSLFISNTHLSRRKLRVTNPIYTRKRSLNIFYLLIPSCRTRLILWIIYIYRNLKHWSTSTVRSHSHSIYRLRPSMRTNIILRCHSYYKPPISHPIYWNNPSRMNLRGLLSRQSHLDPILRFPLHLTIYYRGPSNRSPPLPPRNRIKQPNRIKLRCR

SEQ ID NO: 1017103 - protein, 284 aa, Homo sapiens
MMKLWVPSRSLPNSPNHYRSFLSHTLHIRYNNSLFISNTHLSRRKLRVTNPIYTRKRSLNIFYLLIPSCRTRLILWIIYIYRNLKHWSTSTVRSHSHSIYRLRPSMRTNIILRCHSYYKPPISHPIYWNNPSRMNLRGLLSRQSHLDPILRFPLHLTIYYRGPSNRSPPLPPRNRIKQPNRIKLHVSVSWEFAGTDYKVLLSRQMGMVFALDYDPVESKIYFAQTALKWIERANMDGSQRERLITEGVDTLEGLALDWIGRRIYWTDSGKSVVGGSDLSGKHHR

SEQ ID NO: 1017104 - protein, 153 aa, Homo sapiens
FKYRKQDLLHFMQFGVHAAMEMSTIFNVLKNKTVARAVHKVLVLLDLGEKGWGGNQLSVENEFMAHRQEMFPHLLDAEGSGEGAEKNAGGKGSDPFSFSEGRTGRVEILYTLGKEEHRLPCPLAVVVSAQARKHTRELFLQPHVSRKCHKYVI

SEQ ID NO: 1017105 - protein, 135 aa, Homo sapiens
FKYRKQDLLHFMQFGVHAAMEMSTIFNVLKNKTVARAVHKVLVLLDLGEKGWGGNQLSVENEFMAHRQEMFPHLLDAEGSSEGRTGRVEILYTLGKEEHRLPCPLAVVVSAQARKHTRELFLQPHVSRKCHKYVI

SEQ ID NO: 1017106 - protein, 169 aa, Homo sapiens
RSDSELKDEETKETLRWSGRDYREREREYERDQERILRERERLKRQEEERRRERYEKEKTFKRKEEEMKTEKDTLRDKGKKAESTESIGSSEKTEQKEEVVKRDRIRNKDRPAMQLYQPGARSRNRLCAPDDSTKSGDSRSRKEAGPVVLAIDKEGGEALIRPDALRVS

SEQ ID NO: 1017107 - protein, 239 aa, Homo sapiens
RSDSELKDEETKETLRWSGRDYREREREYERDQERILRERERLKRQEEERRRQKERYEKEKTFKRKEEERRRQKERYEKEKTFKRKEEEMKTEKDTLRDKGKKAESTESIGSSEKTEQKEEVVKRDRIRNKDRPAMQLYQPGARSRNRLCAPDDSTKSGDSRSRKEAGPVVLAIDKEGGEALIRPDALGCPDCLGSQKSTTLSNSTQLPFRGKAIERKGAAVLVGYTARGVSLVSTAGI

SEQ ID NO: 1017108 - protein, 225 aa, Homo sapiens
PSTATNSHPEMFHQVWAALLSLYGLLFNSMNQCPEHSQLTALGMDDTETPEPHLGLWYFIAGPSTTEELATFDPVDNIVFNMAAGSAQGGQLRATIRTKSGVCVPRKWTYRLTEGKGNMELRTEGRPDMKTDLFSSSCPGGIMLKETGQGYQRFLLYNRSPHPPEKCVEEFQSLTSCLDFKAFLVTPRNQEACPLSSKLTSDFTRVLDRQDRSPASSGEASDSCP

SEQ ID NO: 1017109 - protein, 77 aa, Homo sapiens
SETVRLTARILAKQKIHPERTPSEKLLAVKEFESHLDKLDNEKKDLIQSDIAALHHFYSKHLGFPDNDSLVVLFQGE

SEQ ID NO: 1017110 - protein, 211 aa, Homo sapiens
MPPKKGGDGIKPPPIIGKIWNLTEQLVLLDCQTVGKSTFLQCVNQIAQASASKTSRSAPIDPNEEQSTCARLNRFDFSLSSTTKPASKDSCPFYNVSGLSLAFVTGAHNGQGLGNAFLSHISACDGIFHLNTCYRQQLMTIPRPGLQGTDGSIPIPQPYQTINHMNDSFQFNDCRHMIGANTAQYTKVAVTRRAYKPQPDHDTTPQPTLGT

SEQ ID NO: 1017111 - protein, 271 aa, Homo sapiens
YGRLWLRVRACLQRADGDPAAPAGLRVPVQGTGWSSCAREAGSMQSPEKYQQRVVRVKLASDDRGELAVPDAAHPHPQLHTSSSKTLGGVLPGALGPSIALLSHATHRSASAATHRLWGRTKSSRLAVADCLGPWVACLTPLVPPWRAWPYLILVGTAALAQASSASLNRHLLPTSSLGRLHMLPADPSWGPLRICSWEQRDTSLAPSVCAPRVTQLQGGAGLPGVPFTTVPGPSGPPLDAEFLPQNCISWAQQHEVPEAIVSEAITRLSG

SEQ ID NO: 1017112 - protein, 279 aa, Homo sapiens
MDTGPLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFPAPEDWAEPQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 1017113 - protein, 326 aa, Homo sapiens
RWTTEDTFTASSEGDAKCRGHIVPSKVLCVLKDLLVAAIVHCKHHSLIAPGPLNAASLREEQLHLSLLVSSGWRTISFHVVPVVRRKLGAPALEGVQQMPGFPEGSLRRILSQGVDLVPASAQLWRTSTDYLLTRLLGELGSLQGHRLDSLSILDRVNHESWRDSGQTDGLTFGHLKMVLLWASVLFPAPEDWAEPQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQKTRTLGGEES

SEQ ID NO: 1017114 - protein, 150 aa, Homo sapiens [sequence omitted]

SEQ ID NO: 1017115 - protein, 187 aa, Homo sapiens
MAAMSCCSGFGLRADSVALAAALVLDSESEVFSRGSEDCRSCAAQWGHGKRLFVVKPSLYYDARFLRLMKFYLMLTGIPVIIGITLVNIFIGEAELAEIPEGYIPEHWEYYKHPISRWIARNFYDGPEKNYEKTLAILQIESEKAELRLKEQEVRRLMRARGDGPWYQFPTPEKEFIDHSPKATPDN

SEQ ID NO: 1017116 - protein, 363 aa, Homo sapiens
TPFQQTLVYSKRSGKPQLLSFIEEHEQMNPLKKTQMARKLMAEGPCERGEGRTVKGWRPRRLGGGLGGTRRGGADVNIRHSGRVDTSRYDERPGPSPLPHRDRDRDRERERRERSRERDKERERRSSRSREPAEALTKSQTRRSGRRSRERSKNKDRDRKQAKQPKSGARPGGSGSARRSCVAAVATWRSPPRRVTRPLMMGLQGRHSLTALTVQRKRAGIVTGSDGGSHRSERERRRDRDRDRDRDREHKRGERGSERGRDKARGGGGGQDNGLEGLGNDSRDMYMESEGGDGYLAPRDGYLMEVRRSEEFVLSICCVSDAFLHQPLAVIPSPNLGHLSLSSKGRCLICSGPLDLKIKLISC

SEQ ID NO: 1017117 - protein, 306 aa, Homo sapiens
KWKPPAGLGEGLRWLPRKRKECSRSASLPPLRIKPRPPPPSRGTGNREPQRGAPEQLVARAATKEAERAVPRSREPAEALTKSQTRRSGRRSRERSKNKDRDRKRRSSRSRERARRERERKEELRGGGGDMAEPSEADYAPPDDGPPGEALPNGPDGPEEKGRDRDRERRRSHRSERERRRDRDRDRDRDREHKRGERGSERGRDKARGGGGGQDNGLEGLGNDSRDMYMESEGGDGYLAPRDGYLMEVRRSEEFVLSICCVSDAFLHQPLAVIPSPNLGHLSLSSKGRCLICSGPLDLKIKLISC

SEQ ID NO: 1017118 - protein, 57 aa, Homo sapiens
MCCEASPDSSKTDKKLQIQEKAAQEVKLAIKPFYQNKDIYQEDYKALYGAVDKFVIV

SEQ ID NO: 1017119 - protein, 108 aa, Homo sapiens
RYPKAAELGVWARPAGEAYKLRYQEIAKRTQPPPKLPVGPSHKLSNNYYCTRDGRREVVPPSIIMSSQKALVSGKAAESSAMAATEKKAVTPAPPMKRWELSKDQPYL

SEQ ID NO: 1017120 - protein, 76 aa, Homo sapiens
ARAGTTMSKVSFKITLTSDPRLPYKVLSVPESTPFTAVLKFAAEEFKVPAATSAIITNDGIGINPAQTAGEYLKLF

SEQ ID NO: 1017121 - protein, 78 aa, Homo sapiens
ARAGTTMSKVSFKITLTSDPRLPYKVLSVPESTPFTAVLKFAAEEFKVPAATSAIITNDGIGINPAQTAGNVFLKHGS

SEQ ID NO: 1017122 - protein, 69 aa, Homo sapiens
RQGRKEAGWECGGRSFSSSATMAPIKVGDAIPQWRYLKGNGKEGELGRLFKGKKGVFVWSPWGIYTWLF

SEQ ID NO: 1017123 - protein, 267 aa, Homo sapiens
MTGSNEFKLNQPPEDGISSVKFSPKHLPVPCCVSLLGHVGGVSTNVPANSNGGSGYQTHAAPGLDWRLLRSKGNGPGVGGLRSSNCEQIALIVNTDPRKICVGGPIDAPNPDVVEYCPKKVTCDGHLKSGGIKNSYNLWGSKELLVNAGDLLYSLKKVYTPLSVWGDPGDCGDQAGRRSVGCRGLHGTMGYVQEGRESSLKYQIGDKEGPNKQVVLSHEARAVEIGPSLGGEKSSSCAQEENMGDSDSVLIKFAGVGEMDTRGPDSE

SEQ ID NO: 1017124 - protein, 179 aa, Homo sapiens
GLTQFTNKCHIAFAALEAVCFQTREILDAMNRDCGIPLSHLQVDGGMTSNKILMQLQADILYIPVVKPSMPETTALGAAWHSGAEGGWCVEVLNLRICQACHNGSGLNLRSNAERKPKIRYLHMERKAVIEGQFGLGLQTQFSRKVGNPIKLIPSSPEFPRCKLFNVDMKILTYSGLIV

SEQ ID NO: 1017125 - protein, 121 aa, Homo sapiens
WQLGHQCKYRDSAMVLQRIFRLSSVLRSAVSVHLKRNIGVTAVAFNKELDPVQKLFVDKIREYKSKRQASGGPVDIGPEYQQDLDRELYKLKQMYGKGEMDTFPTFKFDDPKFEVIDKPQS

SEQ ID NO: 1017126 - protein, 170 aa, Homo sapiens
PIYEGYALPHAIMRLDLAGRDLTDYLMKILTERGYSFVTTAEREIVRDIKEKLCYSGPWTFENEMCDWPAILLLPGTKSYELPERARSITIGNERLPLTRKTPLPAPPFIRNGVGGHYTRPPYNSISEDETSNIQEGPVMQQRHVGGHTMYPGIADRMQKETGNQTMSKI

SEQ ID NO: 1017127 - protein, 129 aa, Homo sapiens
LLAATSTAQDIKQIGWLTEQLPSGKPHGALLTEKELLLYLSLPETREALSRPARTAPLIATRLVHSGPSKGFSAYDAEFSFALRTGTRHGVDTHLFSVESPQRLACLGPASLLNAVNGAAKVLKKFLKA

SEQ ID NO: 1017128 - protein, 95 aa, Homo sapiens
GDHPVELLARDFEKNYNMYIFPVHWQFGQLDQHPIDGYLSHTELAPLRAPLIPMEHCTTRFFETCDLDNDKYIALEEWAGCFGIKEQDINKDLVI

SEQ ID NO: 1017129 - protein, 139 aa, Homo sapiens
FCASQSVAQHTSKSADFLGVVGQLCLFLAMRILIRLCNLLSLDVLICQMALMIDSTYLPYMRRHVKDPWLSIVMTQINANYYLLSYAKSRCCKRLKRDCWFPSWEVWESASRSAQWLEEVSKGNDGGAPRQRWELLATP

SEQ ID NO: 1017130 - protein, 131 aa, Homo sapiens
MQQEEIPRTSQVYLRWMFEVKKYRPKYCGSCVDGRCCTPQTRTVKMRFRCEDGETFSKNVMMIQSCKCNYNCPHANEAAVSRFTGLFKDIPKFRGLKGYLGFQGNTVRPTQEEELSRIRIHGENWPGAGVA

SEQ ID NO: 1017131 - protein, 131 aa, Homo sapiens; identical to SEQ ID NO: 1017130

SEQ ID NO: 1017132 - protein, 172 aa, Homo sapiens
IRNEVKPPGVMGGRNREAAAPFSLPSRVRVPIPRSSVPDPQWARPSDRSRLTGFRMSQYSVCQPYNQEERWGVQAMVTNRFSAHFNRGCSPPCRQVGNTSICYHQPLPEPICPAQPCPAQPNPALPQLGEPCPGMGWQGCTQPPWKAETQETSGVLFSGRVIPGEHMGPLGV

SEQ ID NO: 1017133 - protein, 106 aa, Homo sapiens
TANKIQITLNVRPCLLIALIIKRNNSREPATVDDNSVDTATQNRDQTDNFQCSHADHSRSGVNGKSNPIMVNSINRQTHMAKLAGNVAFTGNRFAVENQPAANTGA

SEQ ID NO: 1017134 - protein, 82 aa, Homo sapiens
ENYWERLPGIPRAGASGCGGEKNPEDWAPECLAERLPPFVHRGQDRVNILQQFPNSLQDVENVFAKLMPQTGAGRLEYIKNQ

SEQ ID NO: 1017135 - protein, 230 aa, Homo sapiens
MADPEGTDGEGTGCNGWFYVQAIVDKKTGDVISDDEDENATDTGSDMVDFIDTQGTFCEQAELETAQALFHAQEVHNDAQVLHVLKRKFAGGSKENSPLGERLEVDTELSPRLQEISLNSGQKKAKRRLFTISDSGYGCSEVEATQNQVTTNGEHGGNVCSGGSTEAIDNGGTEGNNSSVDGTSDNSNIENVNPQCTIAQLKDLLKVNNKQGAMLAVFKDTYGAIIYRFS

SEQ ID NO: 1017136 - protein, 230 aa, Homo sapiens; identical to SEQ ID NO: 1017135

SEQ ID NO: 1017137 - protein, 105 aa, Homo sapiens
MHGPKATLQDIVLHLEPQNEIPVDLLCHEQLSDSEEENDEIDGVNHQHLPARRAEPQRHTMLCMCCKCEARIKLVVESSADDLRAFQQLFLNTLSFVCPWCASQQ

SEQ ID NO: 1017138 - protein, 130 aa, Homo sapiens
RILKSPEIQRALRAPRKKIHRRVLKKIPLKNLRIMLKLNPYAKTMRRNTILRQARNHKLRVKKLEAAATALATKSEKVVPEKGTADKKPAVGKKGKKVDAKKQKPAGKKVVAKKPSREEAYYQKKRSQLA

SEQ ID NO: 1017139 - protein, 51 aa, Homo sapiens
PAYALPLTKAPVDLLGVAPNNLMAMAQETEDNLYWGSVTGSQSNAVSPTPA

SEQ ID NO: 1017140 - protein, 202 aa, Homo sapiens
GSSRTPALMNFMMTGSWVTIGATFAAMIGAGMLVHSISYEQSPGPKHLAWMLHSGVMGAVVAPLTILGGPLLLRAAWYTAGIVGGLSTVAMCAPSEKFLNMGAPLGVGLGLVFASSLGSMFLPPTSVAGATLYSVAMYGGLVLFSMFLLYDTQKVIKRAEITPMYGAQKYDPINSMLTIYMDTLNIFMRVATMLATGSNRKK

SEQ ID NO: 1017141 - protein, 100 aa, Homo sapiens
HFHKLPSLLSCDDVNMRIAAGESLALLFELARGMESDFFYEDMDSLTQMLRALATDGNKHRAKVDKRKQRSVFRDVLRAVEERDFPTETVKFGPERMYID

SEQ ID NO: 1017142 - protein, 234 aa, Homo sapiens
MAKPCGVRLSGEARKQVEVFRQNLFQEAEEFLYRFLPQKIIYLNQLLQEDSLNVADLTSSGPSWTSHRRLYLFQAKGWSEMAQQIKQEKKEVPKCGFVPGNEKVAVPACLWLSTGSLDSPKEETAILAELHGYRKHRDFPQIEDVESDSFGVANPGERLLDEVNSTSKHPNSGSFPHEHHCTEVTISEGGGCCRPKASQRRTHVNGFTEALGDMSEHEAAIIGEVTGRGRWHLG

SEQ ID NO: 1017143 - protein, 637 aa, Homo sapiens
MMSYSERLGGPAVSPLPVRGRHMVHGATFAYVPSPQVLHRIPGTSTYAISSLSPVTLTEHSCPCGEVLECHDPLPTKLAQEEEQKPEPRLSQKLAQVGTKLLKVPLMLAFLYLFVCSLDVLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHVTGLVVASFNIRGGRDAPDLLKVITEPFTRLIIQLDKSVITSIAVGDESLRNHSLIRIWCHPDTTEASTSMSRVEAIGSLANTTMEKCNHIFVDTGLPDLAVGLILLAGSLVVLCTCLILLVKMLNSLLKGQVANVIQKVINTDFPAPFTWVTGYFAMVVGASMTFVVQSSSVFTSAITPLIGLGVISIERAYPLTLGSNIGTTTTAILAALASPREKLSSSFQIALCHFFFNISGILLWYPLPCTRLPIRMAKALGKRTAKYRWFAVLYLLVCFLLLPSLVFGISMAGWQAMVGVGTPFGALLAFVVLVNVLQSRSPGHLPKWLQTWDFLPRWMHSLQPLDGLITRATLCYARPEPRSPQLPPRVFLEELPPATPSPRLALPAHHNATRL

SEQ ID NO: 1017144 - protein, 637 aa, Homo sapiens; identical to SEQ ID NO: 1017143

SEQ ID NO: 1017145 - protein, 61 aa, Homo sapiens
CLLGRCGRRSPLTSELDIFVGTTLIDEDVYRLWSDGYSVTDAVALRVRSGNPGADWRHGSG

SEQ ID NO: 1017146 - protein, 111 aa, Homo sapiens
HSAGLGARLELAYRAAPLTRAAPAAAACTGPGAAMPKCPKCNKEVYFAERVTSLGKDWHRPCLKCEKCGKTLTSGGHAEHEGKPYCNHPCYAAMFGPKGFGRGGAESHTFK

SEQ ID NO: 1017147 - protein, 77 aa, Homo sapiens [sequence omitted]

SEQ ID NO: 1017148 - protein, 77 aa, Homo sapiens [sequence omitted]

SEQ ID NO: 1017149 - protein, 125 aa, Homo sapiens
GIGDVPLMEGAEDLRVGCQAGRMRAEVHRALGRAGCKRRVRQWWVGAASCSVSPGPVCASAAERVTSLGKDWHRPCLKCEKCGKTLTSGGHAEHEGKPYCNHPCYAAMFGPKGFGRGGAESHTFK

SEQ ID NO: 1017150 - protein, 132 aa, Homo sapiens
GAVSPRGGVPGSLKGADQAGSTQSRACSPCRPSRCRLHRTRSRHAQVSQVQQGGVLRREGDLSGQGLAEPRATLSSKPGGGDPILGCLQGHCPGKCQALSPDAQGSLVAPNALSKPEHLENQKFKLFINTQN

SEQ ID NO: 1017151 - protein, 125 aa, Homo sapiens; identical to SEQ ID NO: 1017149

SEQ ID NO: 1017152 - protein, 111 aa, Homo sapiens; identical to SEQ ID NO: 1017146

SEQ ID NO: 1017153 - protein, 72 aa, Homo sapiens
MPKCPKCNKEVYFAERVTSLGKDWHRPGQWPCKQPRRGVSTTWLLESVATRLPPRPKPLGPNMQRRGSLSEQ

SEQ ID NO: 1017154 - protein, 104 aa, Homo sapiens
MQSLFTGKEVLYLALCNSVETCILVFAGKLFSVGGDLQSHPSPGGAWGPFPSCSQVDQELTARCWWLWDESLLLLTGNMTLPLDIKWTQYLGSSFFSIHLTVPL

SEQ ID NO: 1017155 - protein, 68 aa, Homo sapiens
DPGSYPGPSTRAARWERKFPFNQWGLQPRSLLLQAARDYVVRKPAQSRLDDDPPPSTLLKDYQNVPEE

SEQ ID NO: 1017156 - protein, 2038 aa, Homo sapiens
KYCCNETEFQAVMQANLTASSEGYMHNNYTALLGVWIYGFFVLMLLVLDLLYYSAMNYDICKVYLARWGIQRTMDETGPPAVGEPRSGPSAGSAGPTAAASPRPAATSPTGRAHIAGRCSQPTADDLPEFVCLKTLLLCLRMGEMRSEAPGAASEKNNFYRDARDSRGSGGGQEEMLPVPKAPFRGLLRLGANSGVGAGGAGEGILSHLSASNSPILGWWLLRGDSLWTQDDQDKATLADSSQEDEACELYLWLKTEASLAPAPSSSGPLGLFVSEYGMCVCVCVCVIWGVLFVCLVGWFLLGLPPSSSLMGMSHPPAGGSHPCQCPSRKLIAKHRVRPLCVSGSTGDLKMPVRVVSYRIRSCNNSNTKGCISELTTGQVPSKVFSCTPSLTTWEAGMINPLQKNSQWGSGAGTQSPGSNSLDVTCSPAGVHPAQCWEHLLDASTITAWSADPLSTFWLSICCVPGPVLGSDGKKDELDLISAPGEPPIWWETQTRGSLLERVTRPWKPRQERSRNPSTFKKDFHARNIQPTELITPTPAPLPWDTYEMASPEIITNISKGHAASVDTLIPWVLVIPNLPQLLAREALLDQCVCPLTQFPHFIRPSVLTLTTHPFTRHDSEQGRSLLTVLAFSWGRKTVKKEGGEGSECSAGNSVPGTQFEGHVSETLVDLGWSGKAAYEQMIEAQDLNDTQEPVMGVKDRKRAFQAEGTASAKILRQPQAWWFQGSTRKPGGTRKPGGWGPRGKAEGDEGDSAQLWALLWVKLCKHNVLPLEKQNKLAEGIKHPPFCLAVHPLNSPMKKGLSPFYGQEDRLSWVKWLAQDHTGQLWKTQAPGFSLWVQLSPPGSAASVQAYGLAKWENLCLGSRLEKGMASSPLMWAVPGPCCRKGVHSLSTSPAAEATAVSHVQCLRRQRKPEVGAQDPDSDISSATENSVTSGKVCYLSFPIGKRKESDGYLRSLQPSCPAVLDNALEVLPLPKRNWWPCLPLLDTWGQRSLPNRQLELGFTYASLEMYNLLGGHSSCLPPSPQEVFSGITEKPMGFVVLLLCQVPLGQLGWGLEHSVASRRPQQRSPRPSTPGTDSLRQRQVQSADSHGILLPAGHPHEPLNLSEPLLLTCQVCEVGYQLVTVLAVSQRSRQVRTVCMWVSTLSVESRCVCIQSPNGVKGSSKCHGSQVIVINTVPILLWLWLEGPSRSRLSLRTRWMQGSDEFKHSQSYCFLATQPDFLSCLLLLFTVSFCPSPCNFVIIIIQKEKREREEDKMSTEESAFEAVCRTTAFVRTVSHWELCVINEQFYAFPLVCVRCDCCVFQNLYSEPIAGNACWLAALKLASERALHLEKQLFSPASPGCSSGQASHLTMTIADVQQALIEKTHKYNMHMRAHTQVISQVDLVPLAVSNALESSKKAADSVPRVSGISPHHQKDSVKFWPRAEEEDLENVRENMTGLGVNRLLWPGDGFQFTVNPKALFQVMANRPGLWVWLCLALTPPQAAVQVGSGFQLPSPGRPLRWLGCFHNHHVCLLETVPFKETGSPGVQTCKIFEFFNLAELVPINRKSLLEVNLQISPMFEININMNPEGRACSELEIAPVHSSLGNRVRLCLGRKVRRKEGRTDLDGVIGNMSYQCCRAPYHCRETSTWVVFVCCENLGLESWKQTAGILNHPAHVVGIRGCLLGPHSTGTVREAMVDDALITALCSPGIPHWAGAIPCALWKTSLRTYYVPDAMHSALVPCCSTNTSHAGAEMHANNFGGCGPKSSNVKVKQSGKLEEVRSLLENSFDDTRFPHLFRYLPSACHLPGPVPRAYLGAIPAIAGTTVKRLVVPNRHAQIHKMNSEHLPVPPVKVTLEVSLPPTTPVSSPSQQLVLDRCLMNEQIGLLVTLYLKLLSLHQSPDRFALDRLKSGAAAGFTSRRHHSRHCPINGNGLPGILFTETALRTVTLRFVQGGTLLNDPKPASKMCRIPHWSAPTLSTGSKTIDDMATLATAGTKLVAQERASSWNCMSVSHTQFLPIFPISRFKASGIPHSQITKWSVSRQCAVTRWGLQG

SEQ ID NO: 1017157 - protein, 95 aa, Homo sapiens
DEEEEITINAWFGPQGTISPLHQDPQQNFLVQVMGRKYIRLYSPQESGALYPHDTHLLHNTSQVGTGGLEVTLQVLPTALEMMTSFAFFRLRGES

SEQ ID NO: 1017158 - protein, 126 aa, Homo sapiens
DEEEEITINAWFGPQGTISPLHQDPQQNFLVQVMGRKYIRLYSPQESGALYPHDTHLLHNTSQVDVENPDLEKFPKFAKAPFLSCILSPGEILFIPVKYWHYVRALDLSFSVKLLVVVARIGAERG

SEQ ID NO: 1017159 - protein, 135 aa, Homo sapiens
CVQVVFVLVRGLSSVLAVSCCLLFSCGLFVCCVLCFVVVLVCIFVFLRVVVLVYGFAVGPVMSVSLSFVVVAIGSSVFMMVVLAVDNRICSGLARQTGVPVCLSGPSQLDSLQLDMGPDTMMLSPETPHPVDLGL

SEQ ID NO: 1017160 - protein, 212 aa, Homo sapiens
MRSPVCALRMTEWEAATPAQETPDIKLFGKWSTDDVQINDISLQDYIAVKEKYAKYLPHSAGRYAAKRFRKAQCPIVERLTNSMMMHGRNNGKKLMTVRIVKHAFEIIHLLTGENPLQVLVNAIINSGPREDSTRIGRAGTVRRQAVDVSPLRRVNQAIWLLCTGAREAAFRNIKTIAECLADELINAAKGSSNSYAIKKKDELERVAKSNR

SEQ ID NO: 1017161 - protein, 286 aa, Homo sapiens
MAELCNSRNNSHNISEQERQAETCGSSLPHPDPHSHRPVPGGGRRGRRQDGSGGGWTKQVTCRYFYAWGCKEGDNCRYSHDLSDSPYSVVCKYFSEGLYIVETVQIEHSKPLKQEEASATRANYKVIPCLLPQVSHRKLAHLLNLNTGEAESRNSNFATEEQVQRTWVNAIEVRPGQAYCGRTALPAMKHPAGSVTREESEKSKPPWDKGSRCAPILAVRSADTGALCFLPGSCTVCVRSGSMVCQRTRYNRGWALEGWAMGGARTRRALRAEARAVEPHAPLARG

SEQ ID NO: 1017162 - protein, 239 aa, Homo sapiens
FRVVRALPMSRPAITAAATSVFCGSSHRQLHHAVIPHGKGGRSSVSGVVATVFGATGFLGRYVVNHLGRMGSQVIIPYRCDVYDIMHLRLMGDLGQLTFLEWDARDKDSIRKAVQHSNVVINLIGREWETRNFDFEDVFVNIPQQQLFEKGDVNGEKEQKFYTFLKNSCPPTAELLGSPGRLFWEPMKIHDIRWNFEKFLVGPDGIPVMRWYHRTTVSNVKMDILSYMRRQAALSARGK

SEQ ID NO: 1017163 - protein, 82 aa, Homo sapiens
WPPQDAPQPAMARILRASCLLSLLLAGFVPPGRGQEKSKTDCHGGMSGTIYEYGALTIDGEEYIPFKQYAGKYILFVNVASY

SEQ ID NO: 1017164 - protein, 187 aa, Homo sapiens
MPPPYPYPLPIMQGPRRGSSGRKPHSQSFYPHPRFSFLLHKRQAWHNCVSEPLWTRDNCPSVCMATQPRICLLETQGWSICVYGLAQHPHIFFSFLFQMSPKETQVLGPMVLLKPEHHSWGQHLPHAHTTHHQPPSSFLKDPPEPPSPSHSAPETSQDNCERDGRVPQVRGGVSMKEGPKALWAGLP

SEQ ID NO: 1017165 - protein, 149 aa, Homo sapiens
MPPPYPYPLPIMQGPRRGSSGRKPHSQSFYPHPRFSFLLHKRQAWHNCVSEPLWTRDNCPSVCMATQPRICLLETQGWSICVYGLAQHPHIFFSFLFQMSPKETQVLGPMVLLKPEHHSWGQHLPHAHPTHTILKSKLFKKSNSIFCCC

SEQ ID NO: 1017166 - protein, 155 aa, Homo sapiens
MFVRKSQRLPFKATTPVIMVPGVPFIGFIQERQQKEVGETLLYLRCRDESLREAVAQHRDGALTQLNVAFSREKSKKVYVQNLLKQDREHLLEVESRGRCQHLRLWGCTDTWPGDVKNDLLASIVAELGAMENVQAVDYIKKLMTKGRYSLDVWS

SEQ ID NO: 1017167 - protein, 104 aa, Homo sapiens
ASENQPLSRHARPRPPFFPLFSLPSPPFLPLPARQGPTVAACLREGWEREGGWVRPPPPPRECDSPRPQNSSWTQAQGPAWDKAPRVGWPELFLPPASPAGPPT

SEQ ID NO: 1017168 - protein, 98 aa, Homo sapiens
WLQGYFAECERWPAQALRARGPSGAAALRSMASGGGVPTDEEQATGLEREIMLAAKKGLDPYNVLAPKEASGTREDPNLVPSISNKRLVGCICKRQYS

SEQ ID NO: 1017169 - protein, 111 aa, Homo sapiens
GGSIWPPKVFLGKGIQSREQKAEDKAVEHKEILDQLESLKLENRHLSEMVMKLELGLHECSLPVSPLGSIATRFLEEEELRSHHILERLDAHIEELKRESEKTVRQFTALK

SEQ ID NO: 1017170 - protein, 183 aa, Homo sapiens
MNTKSQLEISTQMCKKQNDRIFKPTHSRTTEFKNTEFKPTHGQHRHDGIKTEHYKTDLHSPRGQASDSINPMSRVLSPLSPQISPCSSTRSLTSYSLCKTHSLPSALDTNEANFSDTMSESMNDQEEFISSCSLPVSPLGSIATRFLEEEELRSHHILERLDAHIEELKRESEKTVRQFTALK

SEQ ID NO: 1017171 - protein, 183 aa, Homo sapiens; identical to SEQ ID NO: 1017170

SEQ ID NO: 1017172 - protein, 111 aa, Homo sapiens; identical to SEQ ID NO: 1017169

SEQ ID NO: 1017173 - protein, 208 aa, Homo sapiens
ATISPVSLSSGGAGIRPGEKREQVCEANLSPRLTHLAGDESGSDEGRLPMDRPRKTNKMEQPMTEWRGTPPFGERGEGIAVVYGKSRVDKALSDLPLIFDGHIPNRQINDGMGGDGDDMEIFMEEMREMQKKTYGASVEELSAYAYGGAHVVHHDHHDGISPYALTSVPFSHEITYCDYPVFANSSLHFPNMPLAESVWCEPYVMSTV

SEQ ID NO: 1017174 - protein, 81 aa, Homo sapiens
TRELAQKKQPHAKRRAVWLRGSRGCVCLPVKEGLPAVPSGSKVLVSPCGADGLQESQTVTADRTGSAGAAWGRDHDDDSPM

SEQ ID NO: 1017175 - protein, 133 aa, Homo sapiens
DHYMYLNHGQQTIPNGLGIGGGSTITLGFGMDVDFGKGHSRAKPTCTTYNSPQLSAQENFQFDKMEDDGQVGDPSEEQLAKGNKSILDADPEAQALAGDQWAFAPQQKGSGKSRTMNEEPPEPSWSQDLDSSG

SEQ ID NO: 1017176 - protein, 133 aa, Homo sapiens; identical to SEQ ID NO: 1017175

SEQ ID NO: 1017177 - protein, 154 aa, Homo sapiens
MLPHVLSRDIAELGIYPAVDPLDSTSRIMDPNIVGSEHYDVARGVQKILQDYKSLQDIIAILGMDELSEEDKLTVSRARENIQRFLSQPLPGAEVFTGHMGKLVPLEGDHQRIPARFWQSEYDQSSQNEAFYMVGPIVRSCGTKLITLAEEHSS

SEQ ID NO: 1017178 - protein, 126 aa, Homo sapiens
MLPHVLSRDIAELGIYPAVDPLDSTSRIMDPNIVGSEHYDVARGVQKILQDYKSLQDIIAILGMDELSEEDKLTVSRARENIQRFLSQPLPGAEVFTKSYGEAGTLRDLKISSLQGYTFPQALIVA

SEQ ID NO: 1017179 - protein, 155 aa, Homo sapiens
MHWLRKVQGLCTLWGTQMSSRTLYINSRQLVSLQWGHQEVPAKFNFASDVLDHWADMEKRKKKNNLNGRIRKINEKKGNEITREKEKRTTRRKRTQATRNRRRDEHDDGTNRGRRHNTPSYPPNTTSKRNDKEHSNWKTRDETRKTKRSNDGNTY

SEQ ID NO: 1017180 - protein, 256 aa, Homo sapiens
MFLQYYLNEQGDRVYTLKKFDPMDNRPAQPILLGSPQMTDTLDTESPSRKRFKVLMTQNRALSSEGAAVNLYVYFLVMRGYSRRDDVPLDRRRRVGDVVYAPWSCRVVGRAQYFGVGSPGRLRGRIELLRCGRGNHGLASPIKGTHFDFFSHILNYYKIIKDRLIPRKKSEKHKGGGGLRAHEKMFNRPIAWGQQPQGLKEAGHRWVKGPRAGPRAGSRNEKRGGERLFAQSTWVWRHSRITKSQRAYRARVVLGC

SEQ ID NO: 1017181 - protein, 241 aa, Homo sapiens
MFLQYYLNEQGDRVYTLKKFDPMDNRPAQPILLGSPQMTDTLDTESPSRKRFKVLMTQNRALSSEGPLNLSVFSAAVLPLGGFRKPELFADCEPLMPFLASRYSCGIQSLVGLDYAVCEAIMGGITHKGNTFDFFSHILNYYKIIKDRLIPRKKSEKHKGGGGLRAHEKMFNRPIAWGQQPQGLKEAGHRWVKGPRAGPRAGSRNEKRGGERLFAQSTWVWRHSRITKSQRAYRARVVLGC

SEQ ID NO: 1017182 - protein, 271 aa, Homo sapiens
SHQFACEDGYCLHGSTRPVRSFHDSVDCSDDLLCHNVLQRCGPCEQYSAAASRPPPEVSLSRPRWYCYTRRSREALEGSPGEGWIDDCTEDMKMLQYHILEVSADDEYMRSRSIASTTRDTRTSYLVPSTDMMTCRHGKALRIVTFLCDCWASWGIHSNARTELFATAKPGPEDILKARYWEEMGSTCTDLPWSPPTCPVRGIAVLNNFGYLIGGDNNVQGFRAESRCWRYEPRYNPWFQIQSLQQEHADLFLCVVGRYIYAVAGVTTSND

SEQ ID NO: 1017183 - protein, 78 aa, Homo sapiens
MRPKDPLDATYRSTFLEKKPDYRKGCPGLMTTPDGCTLYILSSSSHPGPYLTGTSKGDLTLLEARILNNRDYPLHHTN

SEQ ID NO: 1017184 - protein, 162 aa, Homo sapiens
MSNLGGRRNGPVEVRLTGEGGAAWPGWAAARWASWQGCLWPWDGPGSRSVVSWGSGGVGRPSSERAIGKPLVPVWTSFNKAEDDSAAGEGGVYVAVGGYTSFAYAERISGRKVKVKEPDADLPGTRQNSPLGYRPGEIVQQDEELPCRGILELRLSHDMRCS

SEQ ID NO: 1017185 - protein, 115 aa, Homo sapiens
DRREQPADRGGRPGATTYEIRVKTNLPIFKLKESTVRRRYSDFEWLRSELERESKVVVPPLPGKAFLRFPFRGDDGIFDDNFIEERKQGLEQFINKVAGHPLAQNEPLSSHVFTG

SEQ ID NO: 1017186 - protein, 340 aa, Homo sapiens
MFTFATYNNITKIICIEFWKKHRKHEQNETIPWAVVWTQLNPECSVADAVYPWERHTQEWPFAEKKVMAPGWPPPCRDTEATPFAPSTPCSRRPGRLLPGGDSRIWSRTRPHSDRLPGPRPISWIEGVWAWNQWVTVAASSEPKVWDPLVAVRLTSMGRSVLPIFLVFSAAVSVSDLRKSCRGRQAAVKTGAGETSPLHLRMCPRCCCWGHGCRAEACVAPEQQLTARLMLDGTPGRVDMRPLLARDAVRRPTWLPEQQLTARLTVGQGFVAWVFSSLPGAARSSCADWWRWEGLLGLMGTPASLSGVQQPCRTWPPVLSLGALAGAALSNDAGPEQLPT

SEQ ID NO: 1017187 - protein, 226 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGK

SEQ ID NO: 1017188 - protein, 83 aa, Homo sapiens
GARPRTKMATAMYLEHYLDSIENLPCELQRNFQLMRELDQRTEDKKAEIDILAAEYISTVKTLSPDQRVERLQKIQSRGSALS

SEQ ID NO: 1017189 - protein, 207 aa, Homo sapiens
RRLLLALSDLLRFPRDTLTGQLPGPVQGSLLGFSWPEGLPCSHTRALVPAAPPDCSLEGTSDPAIGRGRRTHPVKDGRLGVKSVLLIDVYLSTSEPASCIEPHGASAHFPCGRPRPHCVCLSWCPPAGVQQPWETWGGGPWAPCALAEMAPRGLTAPFLVTGSVHGVSRKRGRRSRRSCVPGSEEQVNLSLHSCRNISLPFKTTLFG

SEQ ID NO: 1017190 - protein, 219 aa, Homo sapiens
MVSCAGLSFSPISPSDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGKWFCPRCVQEKRKKK

SEQ ID NO: 1017191 - protein, 254 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDVLSTVCPGKEEEEVGGAVCPDPRSKLICPFIRVAIFPFLLKLPCSVDT

SEQ ID NO: 1017192 - protein, 240 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKKGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGKWFCPRCVQEKRKKK

SEQ ID NO: 1017193 - protein, 273 aa, Homo sapiens
MATAMYLEHYLDSIENLPCELQRNFQLMRELDQRTEDKKAEIDILAAEYISTVKTLSPDQRVERLQKIQNAYSKCKEYSDDKVQLAMQTYEMVDKHIRRLDADLARFEADLKDKMEGSDFESSGGRGLKSKSVNFFSLFSLLLTMEFSQEFVTVNHYQYDHYEGRGQKEKRGSRGRGRRTSEEDTPKKKKHKGGSEFTDTILSVHPSDVLDMPVDPNEPTYCLCHQVSYGEMIGCDNPDCPIEWFHFACVDLTTKPKGKWFCPRCVQEKRKKK

SEQ ID NO: 1017194 - protein, 340 aa, Homo sapiens; identical to SEQ ID NO: 1017186

SEQ ID NO: 1017195 - protein, 83 aa, Homo sapiens; identical to SEQ ID NO: 1017188

SEQ ID NO: 1017196 - protein, 127 aa, Homo sapiens
GTRKKLVAKGGKKKKQVLKFTLDCTHPVEDGIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 1017197 - protein, 97 aa, Homo sapiens
HGAFFNLTIAFSLSLLGTLIFRSHLISTLLCLEGIVLSLFIITSVTSLNSNSISSIPIPITILVFAACEAAVGLALLVKVSNTYGTDYVQNLNLLQC

SEQ ID NO: 1017198 - protein, 324 aa, Homo sapiens
VGDVGKDGAAAQSRVVRVLSMSRSAITAIATSVCHGPPCRQLHHALMPHGKGGRSSVSGMVATVLGATGFLGRYVVNHLGRMGSQVIIPYRCDKYDIMHLRPMGDLGQLLFLEWDARDKDSIRRVVQHSIVVINLMGRDWETKNFDFEDVSVKIPQAIVQCPRKLELKQFIHVSHLNANIKALLDIGEIRLVAEKVVRDAFPEAIIVKPSDIFGREDRFLNSFASMHRFGPIPLGSLGWKTVEQAVYVVDVSKGIVNAVKDPDANGKSFAFVGPSRYLLFHLVKYIFAVAHRLFPPIPLAAFWLSMGSTESLKIAHLSPGKQGI

SEQ ID NO: 1017199 - protein, 143 aa, Homo sapiens
MDKWMIYGPGGLPAHSGEPGQHPPEQEICDAWLLEYMCSQGLLLKTPNSHSCPQLKARKQQDGKMFCCVPTVTSLASPLSGSSQTMGNSSPHWWDVTNTILVILASLFLVGCVFSRCLCVCVCVFFCDLLSPYVPPPPQIPYP

SEQ ID NO: 1017200 - protein, 83 aa, Homo sapiens
AQGKIQVPELIGGIQGAETKVPQANIMKGEHASSLRAKEQTGPGMEKDLGLRLCAVLLSPRRSKNQKERVRDPSARARPCAQT

SEQ ID NO: 1017201 - protein, 333 aa, Homo sapiens
MENTSGKGSTNQQDFSSGKSEDLGTVQEKSTKSLVIGPLDFRLDSSAVHRILKMIVCALEHEYEPYSRLKSDIKDENETILNPEEVALLEEYIPTRHTSVTLLKCTCTISMAEFNLLDHLLPVIMGEKNSSNFMNTTNFQSLRPLPSIRILVDKINLEHSVPMYAEQLVHVVSSLTQPSDNLLHYCYVHCYLKIFGFQAGLTSLDCSGSYCLPVPVIPSFSTALYGKLLKLPTSWTKRSQIAITEGIFELPNLTIQATRAQTLLLQAIYQSWSHLGNVSSSAVIEALIKEIFQSIGMTNPTAEVSLYVFDGTLGLLDYSCVFMCSAHLQGPDK

SEQ ID NO: 1017202 - protein, 94 aa, Homo sapiens
AHAEAPNQPGRSEVIMDEVVADAMDEVVAAHAENPYNNGTRAEFILDSTHHKETYTEIAGMQRFGAFYMDYLYTMENTSGKGSTNLPRHFLLRK

SEQ ID NO: 1017203 - protein, 234 aa, Homo sapiens
PARGDHSVKRLYGFNGLMKHPLHQMLEATAGLTPLILLGIPTEVALLLALAIAVQLLLQNSNVDMRLGPLRWVFAWAPVHRFHHMKYGRAGDVNFRLVFQSVVDWLLGNGVLQPMTIEMGAGRLGDWQGRIFRREYVGAVASRFKERLQLSKEAARFPVPSKFEGFVRARFAQTTPPAVTPNKLFQWSGKNAPKSNPGAMGAFRSGCCRPKANSKRQANANKNQGEVIRQNPVG

SEQ ID NO: 1017204 - protein, 541 aa, Homo sapiens
MQLFVLRPGSYTPSEGDLASETVSAQIKGSCSLTWMWHCPVKIKVCAPVQGAAPVMDEATSVAMCGGWMALTNPWKVCHVPAMHWMCTSPIGFHCGPRCLEKVEAVVSTPKGVGTKAVSKEQTERRPGGLVLHVWAVNCHCTNSVTGYLAQNTDIVGPNTCYGGTRTLDPVVAPLKLAQTHSFKWTPLILLEVSLGPFVYITRKDINGLDFYDCTCSKSKNRASYNESENKSTGRSADIMYAWTHSGRSTQRHANRKRSVIHLEHECGGHHAGVGHKSTRCGNDPLMTHPTRQYYDSVSKPNKQLEMDPTQSQYERRRHTHAPESNVGQITRTASQPHILPRTKIKATQSGITTQPRGAQLNMNTRLPGTNHTRTAQTHDNYRQSDRHRDEQKTTQPTQHARRRMRASHEEQRYIKLTIQTARVSGTDERGTPDGRGTETEGRRKTRRARTTRHHAQSEQNASAGRARETHARETREQTRRERPSVRARTGGESREDDHNTPEDRETEDDERRREGRRDRGRQRRKEGGERGRRRRRENDK

SEQ ID NO: 1017205 - protein, 68 aa, Homo sapiens
AVQGGSKGLHRSPQAGWEECKGVLQTGSSYKALKDYKSSLSDISSLLQIEPRNGPAQKLRQEVNQNMN

SEQ ID NO: 1017206 - protein, 255 aa, Homo sapiens
LALSLNGVLLHLNNVSTGCILLGRLLMDEACWECATNVMVTVAKSFEAPIKLVFPQDLLEKGLEANNFAMLGLGDVVIPGIFIAWTLRFDISLKKNTHTYFYTSFAAYIFGLGLTIFIMHIFKHAQPALLYLVPACIGFPVLVALAKGEVTEMFSYESSAEILPHTPRLTHFPTVSGSPASLADSMQQKLSWPSPPAPAESQRHVMPSGCPPARFPPLPRGPSYEESNPKDPAAVTESKEGTEASASKGLEKKEK

SEQ ID NO: 1017207 - protein, 187 aa, Homo sapiens
LALSLNGVLLHLNNVSTGCILLGRLLMDEACWECATNVMVTVAKSFEAPIKLVFPQDLLEKGLEANNFAMLGLGDVVIPGIFIAWTLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 1017208 - protein, 104 aa, Homo sapiens
RLPGRVSCDLTVAPQAPKPAPFFCDLVCCSGELTRPGVTVAENLCPLCGMPLPCSINSYKFSLSHTHTHTHTHTHYIYLYIYVANVLSLSSTGNQSPCCACGIL

SEQ ID NO: 1017209 - protein, 227 aa, Homo sapiens
MAAAVPRAAFLSPLLPLLLGFLLLSAPHGGSGLHTKGALSPGIRSLSTRFIPKSKFVYGEVRNPVTTYGEKKDEFKRLAEKSASSDDLVAEVGISYGDKLNMELSEKKLDKSYTVFYLFRDGDFENKVQNTGAVKVGAIQSWLKGKGVYQGMPGFLPVYDALAGELIREYGVEDRKEILKKGQDLSSVKEQKKWAEQLKIMGKILQGEDFPASEMTRIARLIEKKMS

SEQ ID NO: 1017210 - protein, 107 aa, Homo sapiens
MHWFTGSFIAMIPHASVAVLQTSQKAEWQPGTLQKLRGQSGSQAHMSLKYLSPRSGDYFLQNHHTRPSRQSWFCFSFPSPFQSLPWSEEILQWRAVSHLPKIPFNQH

SEQ ID NO: 1017211 - protein, 107 aa, Homo sapiens; identical to SEQ ID NO: 1017210

SEQ ID NO: 1017212 - protein, 112 aa, Homo sapiens
GGTPRETPRQVFLQIRPGPQRAPPPVGAPRNHVLASGERPGCIGQRTSRDPCVGNAKAPTPTLGPRPTLPRVAPGKNKVGQEEPIGETHPSFWQPSCLMVKKRLTRVNILIC

SEQ ID NO: 1017213 - protein, 147 aa, Homo sapiens
MKRLHLWGSGAHGLAGTMCASRDDWRMVHPMHEFSAKDIDGHMVNLDKYRGFVCIVPTWPPSEARPDSKGHSGSSTVHAQIRLTMWLCEILASARVTRIRKQEPGSNEEIKEIAPGYNVKFRDDQQDLRERGRRPPPVVVDEDATAR

SEQ ID NO: 1017214 - protein, 102 aa, Homo sapiens
FSEGVNGARRLAPRVMAKVLTTPFQGKLGDISRGDCEHEGAGYAGAARRLLGDQCEFRRTVVRGWRTAPKTGVLQPLMLQVGKQSELHSPNCPRDGPKWLML

SEQ ID NO: 1017215 - protein, 193 aa, Homo sapiens
TATCGNVLHGGRSQALLRKLVQDGPNDDGEMFMRPGQLSDYFPKPYPNPEAARAANNGALPPDLSYIVRARHGGEDYVFFPAPWATVSPPTGVSLQEGLYFNPYFPGQAIGMAPPIYTEVLEYDDGTPATMSQVAKDVATFLRWASEPEHDHRKRMGLKMLLMMGLLLPLTYAMKRHKWSVLKSRKLAYRPPK

SEQ ID NO: 1017216 - protein, 290 aa, Homo sapiens
RASPCSPSPLGRPSSETRAFLSPPTLLEGPLRLSPVLPGGGGRGPSSPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPGDFPGPPPAPFAMRNVYPPRGFPPYLPPRPGFFPPPPHSEGRSEFPSGLIPPSNEPATEHPEPQQET

SEQ ID NO: 1017217 - protein, 266 aa, Homo sapiens
RASPCSPSPLGRPSSETRAFLSPPTLLEGPLRLSPVLPGGGGRGPSSPGNPLDHQITNERGESSCDRLTDPHRAPSDTGSLSPPWDQDRRMMFPPPGQSYPDSALPPQRQDRFCSNSGRLSGPAELRSFNMPSLDKMDGSMPSEMESSRNDTKDDLGNLNVPDSSLPAENEATGPGFVPPPLAPIRGPLFPVDARGPFLRRGPPFPPPPPGAMFGASRDYFPPYLPPRPGFFPPPPHSEGRSEFPSGLIPPSNEPATEHPEPQQET

SEQ ID NO: 1017218 - protein, 117 aa, Homo sapiens
MATKKTTIFPPRPKEVAETLSFRIPGDTDVFQCSDMCVCDACMHACMHACINMPCDMWPCCVPVNGMLCCHEPWPGSMPLTLPHALCPEQSCCCANGLYFHINQTLSGWPTSTAYST

SEQ ID NO: 1017219 - protein, 167 aa, Homo sapiens
AFNRVAFGNPAHCRLLLSIAMFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVD

SEQ ID NO: 1017220 - protein, 110 aa, Homo sapiens
GLFPGGAWGLRPRTALAATNMETLYRVPFLVLECPNLKLKKPPWLHMPSAMTVYALVVVSYFLITGGIIYDVIVEPPSVGSMTDEHGHQRPVAFLAYRVNGQYLMGLECL

SEQ ID NO: 1017221 - protein, 165 aa, Homo sapiens
GLFPGGAWGLRPRTALAATNMETLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPG

SEQ ID NO: 1017222 - protein, 83 aa, Homo sapiens
GLFPGGAWGLRPRTALAATNMETLYRVPFLVLECPNLKLKKPPWLHMPSAMTVYALVVVSYFLITGGIIYDVIGGTLKGCGVS

SEQ ID NO: 1017223 - protein, 118 aa, Homo sapiens
MYIKMATLANGQADNASLSTNGLGSSPGSAGHMNGLSHSPGNPSTIPMKDHDAIKLFIGQIPRNLDEKDLKPLFEEFGKIYELTVLKDRFTGMHKGCAFLTYCERESALKAQSALHEQ

SEQ ID NO: 1017224 - protein, 178 aa, Homo sapiens
PLLILYLCGKSFMWTPLDDDDKIVGGYSCEERSVPYQVSLNSGYQFCGWLPHQLNQWCGISMASCYNVREIHGDDWDDALTSKSLEGELTQFTQLQPTINPPPPIPTGRLWNNDIMLIKLSSRAVIKRPRVHHLSAPPPSSHWHEVPHLWPGATLRALRPISQRAECLDAPVLSQAKC

SEQ ID NO: 1017225 - protein, 187 aa, Homo sapiens
QEEGGSPQSKASESSSSFSFLLLLLLQPPRLPRHPSDSCFDRSRRGAFQADKDRVPYGRSHAAAASGALGAADWLAVQILLNPLVLRHIMEGSGGVGKSALTLQFMYDEFVEDYEPTKADSYRKKVVLDGEDVQIDVLDTAGQEDTLHLETTTYGVGKGSSGVAAIQRWNPLELQLTGEHILRVEER

SEQ ID NO: 1017226 - protein, 278 aa, Homo sapiens
HFYSYNLNIILSYPNHIFLFTQSFYSIPLYTTYTYTSYHSISPNSQSFYNNFITSYYLLIYLPPYHSYFISLISPYHFPYSFPFSLYNSFTSFYFYIYLPLTQTPPTSSIIFLFIPTFPFLHSLSQTLPPFFFFFAGAGAGSLLSLFVGGQEVPPTRLGRVGASASGLVNMYDVLCFFNQGGASGFPQHNRSLPCPGMPHHTQVSSFALRSLQGLPNPGQSPMCLVQELPGPCEGQQRAPPPPDGWGPTQPLSPLCSRLTCHCQEMAPTSTPLLQQRS

SEQ ID NO: 1017227 - protein, 156 aa, Homo sapiens
MYDVLCFFNQGGASGFPQHNRSLPCPGMPHHTQVSSFALRSLQGLPNPGQSPMCLVQELPGPCEGQQRAPHHLTAGDPPSPSPLSAPDSLAIARRWPQQAPRFCSRGAELADRAPLNLTPSHQPRPASSDIEFLQPGGSTSTRAAANEVELQVLFP

SEQ ID NO: 1017228 - protein, 142 aa, Homo sapiens
SVVNEPISTRIPADVQINRNATIFPEANIVGHQSVIRCIDEQLIADIAFLCIEGAGFNRTYPIATEQHRISWRELPGFFAIENHTDTFRIRRGQRWRVQQIVFIHFAAFRAWLQFDINSRQQRSQAANPFATNLRFHHPKDG

SEQ ID NO: 1017229 - protein, 168 aa, Homo sapiens
MSRRYDSRTTIFSPEGRLYQVEYAMEAMGHAGTCLGILANDGVLLAGRETQQSTSFLMKSFFLEKIYKLNEDMACSVAGITSDANVLTNELRLIAQRYLLQYQEPIPCEQLVTALCDINTSLYTIWRKTSLWCSLLYIGWDKHYGLQLYQSDPSGITGDGRQLLVKYR

SEQ ID NO: 1017230 - protein, 182 aa, Homo sapiens
MSRRYDSRTTIFSPEGRLYQVEYAMEAMGHAGTCLGILANDGVLLAGRETQQSTSFLMKSFFLEKIYKLNEDMACSVAGITSDANVLTNELRLIAQRYLLQYQEPIPCEQLVTALCDINTSLYTIWRKTSLWCSLLYIGWDKHYGLQLYQSDPSGITGDGRQLLVKYRVSWCHVEQTIKRGK

SEQ ID NO: 1017231 - protein, 83 aa, Homo sapiens
GQTFTGHESDINAICFFPNGNAFATGSDEATFRLFDLRADQEPMTYFHDNINLRDTSVSSSKSGRLLLAWDDDFTATSGIALK

SEQ ID NO: 1017232 - protein, 81 aa, Homo sapiens
RVELVQLVIDGVNYLIDCERRLERGQDIRIPPPLVHSKHSTPHPQRMSQDPQDFCIFNSGLVYLPWTCLSPCPSKDSTLCC

SEQ ID NO: 1017233 - protein, 125 aa, Homo sapiens
MPTGPQSASFGITGDDGSPVMAKPPSIPPFLITHLLWKICHLGFNWIRRETVGTQEQNGARRYVLLPMQHVKKCPTCPHLKIRPLTSQKIRYSGPGAVAHACNRNTSGGRGGRIIRSRVRDQPGK

SEQ ID NO: 1017234 - protein, 110 aa, Homo sapiens
MGNRALNFSLEGNLRGSRHSGGTDRPPGADRRGRQGDRTEDTWGGWKVSALGHWYLSSLPQLDQASQPVGCQGQSVLRRRHGSPHEIHQVSPGSIQVTGLEGPQQPSWTC

SEQ ID NO: 1017235 - protein, 117 aa, Homo sapiens
NRYRRGNQRFNSWRLTKRRRCSSFIKVQAIKRLCFCPWAISFLTTFTAPTSVRARYNGGKFSPRDTSDVNHITCFAKLLLFSIIFFDKGDFTAFTPQLLLLAAKVCIVFVQPQVYGV

SEQ ID NO: 1017236 - protein, 1212 aa, Homo sapiens
MYKSLLDKAGLGSITSVRFLGDQQSVFVSKDLLKPIQDVNSLRLSLTDNQTVSKEFQALIVKHLDESHLLQGDKNLVGSEVRIYSLDPSTQWFSATVVHGNPSSKTLQVNCEEIPALKIVDPALIHVEVVHDNFVTCGNSTRIGAVKRKSSENNGSSVSKQAKSCSEVSPSMCPVQSVPTTVCKEILLGCTAATPSSNRQQNTPQAANSPPNIGAKLPQGCHKQSLPEEISSCLNTKSEVLRTKPDVCKAGLLSSKSSQVGAGDLKILSEPKGSCIQPKTNTDQESRLESTPQPVTGLTKECLVTKTSSKAELDNATAPELQKRLEHTASTPDGLSDKPEVEAGVTRLNSCSEKKVGPSDLGSQSQNLKETSVKVDHDSCCTRSSNKTQTPPARKSVLTDPDKLKKLQQSGEAFVQDDSCVNIVAQLPKCRECRLDSLRKDKDQQKDSPVFCRFFHFRRLQFNKHGVLRVEGFLTPNKYDSEAIGLWLPLTKNVVGTDLDTAKYILANIGDHFCQMVISEKEAMSTIEPHRQVAWKRAVKGVREMCDVCDTTIFNLHWVCPRCGFGVCVDCYRLKRKNCQQGAAYKTFSWIRCVKSQIHEPENLMPTQIIPGKALYDVGDIVHSVRAKWGIKANCPCSNRQFKLFSKPALKEDLKQASLSGEKPSLGTMVQQSSPVLEPAAVCGEAPSKPASNVKPICPANTSPLNWLADLTSGNVNKENKEKQLTMPILKNEIKCLPPLPPLNKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKAVNPVLANLNLPAHWK

SEQ ID NO: 1017237 - protein, 91 aa, Homo sapiens
AQPLPVSNSWQQGARRHNKTMSRLNAPLKQMPCCPTKIGYCCLTPNDLWNWKILLPKKCMYQAIMHPDSPCAAFISILSLPLIFFANGFYV

SEQ ID NO: 1017238 - protein, 52 aa, Homo sapiens
MSASDPNSSIFLTDTAKQIKTKVNKHAFSGGRDTIEEHRQFGNCDVDVSFMA

SEQ ID NO: 1017239 - protein, 413 aa, Homo sapiens
TGYPRCGAEAPAPGGMQGWLDPWPGVSLGVLLPDPPPTLPGSDLSLTDAPPVSRPRLSLSMAEQEPTAEQLAQIAAENEEDEHSVNYKPPAQKSIQEIQELDKDDESLRKYNGGPAWACVACFLQTPNGPQTVVVTWPDPGVQLVPRAPLELDLTGDLESFKKHVCIVLKDGCWSTGIKISFRVNREIVSGMKYIQHTYRKGVKIDKTDYMVGSYGPRAEEYEFLTPVEEAPKGMLARGSYSIKSRFHRRRQDRPPVLGVKSHHQEGLEGPDPKQRAGTGTPDRTDDRTGGTHAHNKSTKTQQKQTKTNRDTTKRNDNTKQTTHKSNTPHPHTHRATTDRPHRTTADVEQNTATHRRPAAADTHVRAETKPEGDQDGTREHTATTNDDRQTTGEEQEERVQKEVKLQSVPDST

SEQ ID NO: 1017240 - protein, 352 aa, Homo sapiens
MAEQEPTAEQLAQIAAENEEDEHSVNYKPPAQKSIQEIQELDKDDESLRKYKEALLGLRGLFPADPKRSPNSRGDWPDPGVQLVPRAPLELDLTGDLESFKKHVCIVLKDGCWSTGIKISFRVNREIVSGMKYIQHTYRKGVKIDKTDYMVGSYGPRAEEYEFLTPVEEAPKGMLARGSYSIKSRFHRRRQDRPPVLGVKSHHQEGLEGPDPKQRAGTGTPDRTDDRTGGTHAHNKSTKTQQKQTKTNRDTTKRNDNTKQTTHKSNTPHPHTHRATTDRPHRTTADVEQNTATHRRPAAADTHVRAETKPEGDQDGTREHTATTNDDRQTTGEEQEERVQKEVKLQSVPDST

SEQ ID NO: 1017241 - protein, 89 aa, Homo sapiens
VARVFVGGCLGWWDSRPKKHHDFGRELLDELMGRGPKPSPGREAHEPCGGTTRAFVNIISVVFVLRNCSQIHVLILMYLEEEITLESSA

SEQ ID NO: 1017242 - protein, 148 aa, Homo sapiens
MKNHTVHRYVQDQTMQDLSCSRKPVAASAMFQRSSLLPRLLVSAGMIHRPGAHSRRRRRRARAPPEPPAAGDAGSAGNRAGRGRAGFSFSSLIANSLKVPTSGFRGAITWPLPPRVLGPFIFIMLIFRKRRPSGAPKETPQAVTTRIS

SEQ ID NO: 1017243 - protein, 148 aa, Homo sapiens; identical to SEQ ID NO: 1017242

SEQ ID NO: 1017244 - protein, 148 aa, Homo sapiens; identical to SEQ ID NO: 1017242

SEQ ID NO: 1017245 - protein, 148 aa, Homo sapiens; identical to SEQ ID NO: 1017242

SEQ ID NO: 1017246 - protein, 148 aa, Homo sapiens; identical to SEQ ID NO: 1017242

SEQ ID NO: 1017247 - protein, 254 aa, Homo sapiens
MGPRVLQPPLLLLLLALLLCGAAVRCRRGLARAPRAVHVVAAAGGDEREPAGRATQQHAHASAGGFGSALTRSFYVILGFCGLTRVYFLIRAFRLKKLQWRRYGLLANTEDPTEMASLDSDEETVFESRNLRLMLSQGGGPSSSHEGRTGDGAHPVPSNPLLHHSFPCWARGWCHPVPTRELLLEPAQPADLLPPAPTAGPCSLASWMLSPGRGQVKTGGTPTATQEALPDCDLCSSLSAPVGTWQPRAKGGWE

SEQ ID NO: 1017248 - protein, 209 aa, Homo sapiens
GCYPHPGSLPPQALFMGEGTCKRRDAEYGASPQVADNGDDSEGGLVNHVSTMMLGGGGRAGRKPLKSGMKELAVFREKVTEQHRQMGKGGKHHLGLEEPKKLRPPPARTPCQQELDQVLERISTMRLPDERGPLEHLYSLHIPNCDKHGLYNLTQCKMSLNGQRGECWCVNPNTGKLIQGAPTIRGDPECHLFYNEQQEARGVHTQRMQ

SEQ ID NO: 1017249 - protein, 105 aa, Homo sapiens
INAEWPLRRGLQTYLEKGCILDIQARRRTQKAVTYIILCIYLLGEIVRLPILSLGRNGLVQPYTESSRARQYREYLTKGTWEKCSRGTLGNSRPPPPSCFPLIRQ

SEQ ID NO: 1017250 - protein, 121 aa, Homo sapiens
MSLKILHAAAYRNALANPLYCPDYRIGRMALIELAVSHTVLKQSAEQFLNMRGGLGLSGAKANYLRRRNPRTECIQTCSCCFSSTKSCRARSQANAFSVVQHVLGAVPHVERGKNTTSLLD

SEQ ID NO: 1017251 - protein, 105 aa, Homo sapiens; identical to SEQ ID NO: 1017249

SEQ ID NO: 1017252 - protein, 75 aa, Homo sapiens
ADSRGSRTLQPYSENSGVNTGPGRDSYKPGAGTSFEFALAIVEALNGKEVAGSSEGTCSSRLEQQTADHLEKQAS

SEQ ID NO: 1017253 - protein, 120 aa, Homo sapiens
MAHRFPALTPEQKKELSEIAQRIVANGKGILAADESVGTMGNRLQRIKVENTEENRTQFRELLFSVDNSISQSIGGVILFHETLYQKDSQGNLFRNVLKEKGIVVGIKLNPGSFHEAGYG

SEQ ID NO: 1017254 - protein, 364 aa, Homo sapiens
MAHRFPALTPEQKKELSEIAQRIVANGKGILAADESVGTMGNRLQRIKVENTEENRTQFRELLFSVDNSISQSIGGVILFHETLYQKDSQGNLFRNVLKEKGIVVGIKLDQGGAPLAGTNKETTIQGLDGLSERCAQYKKDGVDFGKWRAVLRIADQCPSSLAIQENANALARYASICQQNGLVPIVEPEVLPDGDHDLEHCQYVSEKVLAAVYKALNDHHVYLEGTLLKPNMVTAGHACTKKYTPEQVAMALVTALHRTVPAAVPGICFLSGGMSEEDATLNLNAINRCPLPRPWKLSFSYGRALQASALAAWGGKAANKKATQEAFMKRAMANCQAAQGQYVHTGSSGAAATQSLFTASYTY

SEQ ID NO: 1017255 - protein, 88 aa, Homo sapiens
GTPIRSQALGNQNSENEILLEGDDDTLSSVDEKDLENLAGPVSLSTPAQLVAPSVVVKGTLSVTSSELYFEVDEEDPNFKKIDPKVRR

SEQ ID NO: 1017256 - protein, 645 aa, Homo sapiens
MAGPAPPAADELPGPAARRLYSRMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHQYTGAPGLVEHPSTGHSRSALHTGATGRPGERLAQGEHGAHRDPTLGGKGQGGPTQGANGAQGTNVPTDLAPGGRTIPGLHVPRTSIPRAPSSDEECFFDLLTKFQSSRMDDQRCPLDDGQAGAAEARRPTPGGQDRPASMTARPDRGILRASSPAPRAGGLDDQGASCGHACGAANHPQAMHGHSEATVKPLSRGTNSSDADSTSLQTMTR

SEQ ID NO: 1017257 - protein, 269 aa, Homo sapiens
AVSGGRASAWQKQLCRAQDPEDAVGKPTEAPMALGAAEGEPGPHVHVHTWETERGSRWVWGQTQEDAEAERGDLGPAETPPGAGAEWRQPPFRGLAGAQQGLATPPREEQEVPGRPWTLRGGPGRAATPRWTAPTSGCTCHARASRGPRLRTRSASLNLLTKFQSSRMDDQRCPLDDGQAGAAEARLPHTWRTGSPSLDDGSPRPRNSSTLIASSQSRGLDDQGASCGQPAGLRITHSNAGHSEATVKPLSRGTNSSDADSTSLQTMTR

SEQ ID NO: 1017258 - protein, 613 aa, Homo sapiens
MAGPAPPAADELPGPAARRLYSRMEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGARPKRTQRLSAETWDLLRLPLEREQNGDSHHSGDWLGAQQGLATPPREEQEVPGRPWTLRGGPGRAATPRWTAPTSGCTCHARASRGPRLRTRSASLNLLTKFQSSRMDDQRCPLDDGQAGAAEARLPHTWRTGSPSLDDGSPRPRNSSTLIASSQSRRIGRPGGQLWASLRGCESPTSNAGHSEATVKPLSRGTNSSDADSTSLQTMTR

SEQ ID NO: 1017259 - protein, 434 aa, Homo sapiens
MEASCLELALEGERLCKAGDFKTGVAFFEAAVQVGTEDLKTLSAIYSQLGNAYFYLKEHGRALEYHKHDLLLARTIGDRMGEAKASGNLGNTLKVLGRFDEAAVCCQRHLSIAQEQGDKVGEARALYNIGNVYHAKGKQLSWNAANATQDPGHLPPDVRETLCKASEFYERNLSLVKELGDRAAQGRAYGNLGNTHYLLGNFTEATTFHKERLAIAKEFGDKAAERRAYSNLGNAHVFLGRFDVAAEYYKKTLQLSRQLRDQAVEAQACYSLGNTYTLLQDYERAAEYHLRHLLIAQELADRVGEGRACWSLGNAYVSMGRPAQALTFAKKHLQISQEIGDRHGELTARMNVAQLQLVLGRLTSPAASEKPDLAGYEAQGEFQGCGGVLLPTGTDRIRSCGGVGSRPGQHGGGGSRQKMAPTSQFFLASGTAQA

SEQ ID NO: 1017260 - protein, 138 aa, Homo sapiens
APRAPGVRPVQPMITQYHLMEKAVVKTDIQIALPSGCYGRVAPRSGLAAKHFIDVGAGVIDEDYRGNVGVVLFNFGKEKFEVKKGDRIAQLICERIFYPEIEEVQALDDTERGSGGLVPLERIKIYAKNRKQEVIPFS

SEQ ID NO: 1017261 - protein, 138 aa, Homo sapiens; identical to SEQ ID NO: 1017260

SEQ ID NO: 1017262 - protein, 133 aa, Homo sapiens
SVSSLPVFFCCSLPLCSPSCTLGLLFSFLVSVVLLRGCARLVFSRVVFLFGPLMSFSSYLRLAPVVECVSAACRLVGLVGFGVALGPRVGVCFVFACVWWVGAPILCVSGVVCPFSSRGAVLSGGAFCRRSVL

SEQ ID NO: 1017263 - protein, 110 aa, Homo sapiens
ILTVPLHPTLVTAYLSPNPFTVVPTELKTPPPKPRGHPKRDPKLYIKSHNIGPQVWWLMPCNPQHFGRLKAGGLLEPQEFKQYQPGQHGETLSPQKIQKLAGCSGTHLYS

SEQ ID NO: 1017264 - protein, 269 aa, Homo sapiens
EDLVDLMDETMALNKNHSEGGGVIVNNTESILMSYDHVELTFNDMKNVPEAFKGTKKGTVYLTPYRVIFLSKGKDASAVLHDAILSHEKTVRSSSPYLDANYIKGTVKAEAGGGWEGSASYKLTFTAGGAIEFGQRMLQVASQASRGEVPSGAYGYSYMPSGAYVYPPPVANGMYALASWLPLSSAPHLSSIQEPRMMDGAMGYVQARTTTYPGPMETPVSGPDVPSTPLRGRMPRCRTKLGRQRAITTQANPHNVYMPTEPAAAPPYT

SEQ ID NO: 1017265 - protein, 100 aa, Homo sapiens
QTGLTLLISNDPPPSASQSAGIRGVSQGALPLLPVCTFPGSWVLTPDLTISALQVVVNGNPFYEYGHRLPLQMVTHLQVDGDLQLQSINFIGGQPLRPQV

SEQ ID NO: 1017266 - protein, 120 aa, Homo sapiens
KKWGSEERKRSMPFKKGAAFELVFIVLAEHYKVVVNGNPFYEYGHRLPLQMVTHLQVDGDLQLQSINFIGGQPLRPQGPPMMPPYPGPGHCHQQLNSLPTMEGPPTFNPPVPYFGRLQGG

SEQ ID NO: 1017267 - protein, 100 aa, Homo sapiens
PGHIVERDEEYGGCELGNPFYNCWLCVLVLLETHLQVDGDLQLQSINFIGGQPLRPQGPPMMPPYPGPGHCHQQLNSLPTMEGPPTFNPPVPYFGRLQGG

SEQ ID NO: 1017268 - protein, 179 aa, Homo sapiens
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVEASMGVTVPDSDPRRWQPPSLRGGRVCRDLAAAPERPVPAGAHRSHYTGASGHHHCFDVL

SEQ ID NO: 1017269 - protein, 179 aa, Homo sapiens
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVEASLGVTVPDSAPRRWRRRRYAVAACAGTWLLLLNALSPLARTDLTNRCKWASPLLRRPQ

SEQ ID NO: 1017270 - protein, 143 aa, Homo sapiens
MSRLFSLAIQTPQDLALPFLPTLVSSHIPSSAVQQPCRLSLVLQIHQAWFHLMVLHLLFPMCAMLDLSPGSLAQGTEADTTLITPDGMEEMEVGGRMCSLAQGTEADTTLITPDGMEEMEVGGRMCNPDSSKSKGEGKQERDT

SEQ ID NO: 1017271 - protein, 143 aa, Homo sapiens; identical to SEQ ID NO: 1017270

SEQ ID NO: 1017272 - protein, 252 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLDPEPAAQLTQTAPFFRGDIHPNLQVQGTPVRTISASLVQHKHWVDVLGDHTPGWRGRKTSIKVPGGPQYLGRSLRLRGEGAPGERGSIGSENLLVPNENYCKFEDWADAHSGPDGDGSRTQRGVKWTPSKMIARLGKEINNPESVYYWARRTTSCVESALDGSLG

SEQ ID NO: 1017273 - protein, 247 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLAPPPPPPPPPPSLRAPPPLPTPAPAPHHSLPFVQHKHWVDVLGDHTPGWRGRKTSIKVPGGPQYLGRSLRLRGEGAPGERGSIGSENLLVPNENYCKFEDWADAHSGPDGDGSRTQRGVKWTPSKMIARLGKEINNPESVYYWARRTTSCVESALDGSLG

SEQ ID NO: 1017274 - protein, 123 aa, Homo sapiens
WDPLNRVLANLFLLSSILGSRTAGPHTQFVQWFMEECVDCLEQGGHGSVLQFMPFTTVSELVKVSAMSSPKVVLGHHGPQPAPVACQVAAKAIASTLSVACAWPQLVGWVTGCSPSAPPMGSM

SEQ ID NO: 1017275 - protein, 34 aa, Homo sapiens
MLAWYPSEILDPHVDAVNHSETYSEFTHYFSPKT

SEQ ID NO: 1017276 - protein, 965 aa, Homo sapiens
ISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPHSLPATESPDSLQSSQKPPVYHPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPATLIGES

SEQ ID NO: 1017277 - protein, 967 aa, Homo sapiens
ISPSGTELSSLEQTRSYLLSDGTCKCGLECPLNVPKVFNFDPLAPVTPGGAGVGPASEEDMTKLCNHRRKAVAMATLYRSMETTCSHSSPGEGASPQMFHTVSPGPPSARPPCRVPPTTPLNGGPGSLPPEPPSVSQAFPTLAGPGGLFPPRLADPVPSGGSSSPRFLPRGNAPSPAPPPPPAISLNAPSYNWGAALRSSLVPSDLGSPPAPHASSSPPSDPPLFHCSDALTPPPLPPSNNLPAHPGPASQPPVSSATMHLPLVLGPLGGAPTVEGPGAPPFLASSLLSAAAKAQHPPLPPPSTLQGRRPRAQAPSASHSSSLRPSQRRPRRPPTVFRLLEGRGPQTPRRSRPRAPAPVPQPFSLPEPSQPILPSVLSLLGLPTPGPSHSDGSFNLLGSDAHLPPPPTLSSGSPPQPRHPIQPSLPGTTSGSLSSVPGAPAPPAASKAPVVPSPVLQSPSEGLGMGAGPACPLPPLAGGEAFPFPSPEQGLALSGAGFPGMLGALPLPLSLGQPPPSPLLNHSLFGVLTGGGGQPPPEPLLPPPGGPGPPLAPGEPEGPSLLVASLLPPPPSDLLPPPSAPPSNLLASFLPLLALGPTAGDGEGSAEGAGGPSGEPFSGLGDLSPLLFPPLSAPPTLIALNSALLAATLDPPSGTPPQPCVLSAPQPGPPTSSVTTATTDPGASSLGKAPSNSGRPPQLLSPLLGASLLGDLSSLTSSPGALPSLLQPPGPLLSGQLGLQLLPGGGAPPPLSEASSPLACLLQSLQIPPEQPEAPCLPPESPASALEPEPARPPLSALAPPHGSPDPPVPELLTGRGSGKRGRRGGGGLRGINGEARPARGRKPGSRREPGRLALKWGTRGGFNGQMERSPRRTHHWQHNGELAEGGAEPKDPPPPGPHSEDLKVPPGVVRKSRRGRRRKYNPTRNSNSSRQDITLEPSPTARAAVPLPPRARPGRPAKNKRRKLAP

SEQ ID NO: 1017278 - protein, 530 aa, Homo sapiens
MERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 1017279 - protein, 408 aa, Homo sapiens
PGRFVFSSELHGKSAYSKVTCMPHLMERMVGSGLLWLALVSCILTQASAVQRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 1017280 - protein, 261 aa, Homo sapiens
DLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 1017281 - protein, 261 aa, Homo sapiens; identical to SEQ ID NO: 1017280

SEQ ID NO: 1017282 - protein, 283 aa, Homo sapiens
DLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKGLQYDSYAEGKLTSCPLEPCPSPALMAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQKSRVCSPRQA

SEQ ID NO: 1017283 - protein, 261 aa, Homo sapiens; identical to SEQ ID NO: 1017280

SEQ ID NO: 1017284 - protein, 115 aa, Homo sapiens
KGKVEKAQRPGSWCFPLSLSRGSLRVCIFFLSTHAVYFPAPRRNVGLQPLFLKKRKRLQMTAQTSPELSVGWRGKWRLLATGWQECLYSLLAGSPRGASGRFFLLDRISWRPAGP

SEQ ID NO: 1017285 - protein, 317 aa, Homo sapiens
GAGRAGPGKASAGGAAAPELLERSGSPGGGGAQRRRQAAARCAPPRTVRRPGPSRELAGGRAAPAAAPTPGPLRRAMARPLVPSSQKALLLELKGLQEEPVEGFRVTLVDEGDLYNWEVAIFGPPNTYYEGGVLQGALKFPIDYPYSPAAFRFLTKMWHPNIYETGDVCISILHPPVDEPQSGGAASERWNPTQNVRTILLSVISLLNEPKTFSPGKRWTPPVMYSQVEREAGGRIREYTDIIRSLGPGWTRSVEGLKGPNKAWAELLRLRAMGRAPDRGSDVSRESNYEDGKLKEQAESCSGTMKITFGGGVLKEH

SEQ ID NO: 1017286 - protein, 70 aa, Homo sapiens
NCFSPDGNRFPTASPDGQIYIYDGKTGEVCPLGGSKAHDGGIYAISWSPDSTHFLLLLGTKLPRFGDVSV

SEQ ID NO: 1017287 - protein, 513 aa, Homo sapiens
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAGNMLNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGARGKNGEGSWFVMAREHAPSIIFMDDIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 1017288 - protein, 393 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVWSCDTQLPGGSKGMTDYTLHKILPNKVDPLVSLMMVEKVPDSTYEMIWWTGDKIMIIRARSKREVIELPVKHPELFEALGIAQPKGVLLYGPPGTGKTLLARAVAHHTDCTFIRVSGSELVQKFIGARGKNGEGSWFVMAREHAPSIIFMDDIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 1017289 - protein, 295 aa, Homo sapiens
MTGYTLHKILPNKVDPLVSLMMVEKVPDSTYEMIWWTGDKIMIIRARSKREVIELPVKHPELFEALGIAQPKGVLLYGPPGTGKTLLARAVAHHTDCTFIRVSGSELVQKFIGARGKNGEGSWFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 1017290 - protein, 521 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAGNMLNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGARGKNGEGSWFVMAREHAPSIIFMDDIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 1017291 - protein, 32 aa, Homo sapiens
TLEQSDQLRFLHADFPLILSIALSFRINGCKK

SEQ ID NO: 1017292 - protein, 199 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQPPPTFPRADAERLCLAFLIFPLSLLFFSFFSSPLHSSSPQQALPVPPRLKTSPRG

SEQ ID NO: 1017293 - protein, 184 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQVSLAFARNQSGTGKVASNRVLIQMEKGNQAYLNWSGKLDR

SEQ ID NO: 1017294 - protein, 164 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRM

SEQ ID NO: 1017295 - protein, 141 aa, Homo sapiens
MRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRM

SEQ ID NO: 1017296 - protein, 108 aa, Homo sapiens
MKDFVWLHDTLIETTDYAGLIIPPAPTKPDFDGPREKMQKLGEGEGSITKEEVCQDETRTGKLSISLCERKTVSSHEVFFSGFRSHPVLSKRSQAFMFFLEYESGSKC

SEQ ID NO: 1017297 - protein, 35 aa, Homo sapiens
RGEALRTHGGAPGDREGPAPLFLAPQVCGPVPKLR

SEQ ID NO: 1017298 - protein, 197 aa, Homo sapiens
KLKKKDKESVALLCRAFCAERGPGRSPQRAAGPPCPVPAAVLHPSSSFCVPFRPCAQPSQAGTARVRRPWGAAGLMHASAMESSVCFGACPCLPPTSCIDFNASVNIRPLPQAGISIHKNKSKHLGQQTPGGTGGKGLSTEIEDTKQTASCLPSPFVLRTHADSSRRHGNGQAPAVYPCHNCEQLQLRNNKSLPQRQ

SEQ ID NO: 1017299 - protein, 86 aa, Homo sapiens
SVISGEIGFWRRLEDLIQGLTGEKPRADDMKWAQKIKYFSEPATWLPTFPSPQTEAICQIPASLSWPLQMERTSPGLGPGPPAHPS

SEQ ID NO: 1017300 - protein, 201 aa, Homo sapiens
MKVLLLKDAKEDDSGLDPYIQELRLCGLEATHEFLCCHLSLCLSPVCQKSCLILKALEDSFSPSPRAVEAVKLCLEKDNKTEAWEKSLEKTDGIAKSCVTWLEVANGFLLVNKIGLDAEGAGSGNAEKLAEYICSKPSSELPLLFPCGTIKGDTLPKMLKDKGIPMESMHVYQTVPHPGIQGSLKSYYEDQGIPASITFFS

SEQ ID NO: 1017301 - protein, 105 aa, Homo sapiens
SKPCGGIWRGKRPFREIGAGGGALPELSPLFLSGPLSSLDGDINYIRLGAVAHACDPSHFGRPRVYHLKPGVREQPGQHGVCLYKKNLNYPGVLALSCGPSYSGG

SEQ ID NO: 1017302 - protein, 255 aa, Homo sapiens
GEPGEKGVPGKEGVPGKPGEPGFKGERGDPGIKGDKGPPGGKGQPGDPGIPGHKGHTGLMGPQGLPGENGPVGPPGPPGQPGFPGLRGESPSMETLRRLIQEELGKQLETRLAYLLAQMPPAYMKSSQGRPGPPGPPGKDGLPGRAGPMGEPGRPGQGGLEGPSGPIGPKGERGAKGDPGAPGVGLRGEMGPPGIPGQPGEPGYAKDGLPGDPWASRGDTDQLDILGSQDLPVPQANVTLPSVPTSPALLPGRVM

SEQ ID NO: 1017303 - protein, 75 aa, Homo sapiens
ELGLPGLKGDRGEKGEAGPAGPPGLPGTTSLFTPHPRMPGEQGPKGEKGDPGQCDPSQCAYFASLAARPGNVKGP

SEQ ID NO: 1017304 - protein, 250 aa, Homo sapiens
SGGHLCAGPRFRQRRSGESAVGLPAMEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNFSAYFRGSRTSPKTRIFSSFC

SEQ ID NO: 1017305 - protein, 115 aa, Homo sapiens
QLTQGASRCLSRLLAPQNRCRMASQSQGIQQLLQAEKRAAEKVSEARKRKNRRLKQAKEEAQAEIEQYRPAEGRKNSRPRKLRHWDPVAVCSTEVEKETQEKMTILQTYFRQNQG

SEQ ID NO: 1017306 - protein, 84 aa, Homo sapiens
MKREPKNLSSEQVLKPTYSQSKPNRIRLYYWGLGLNLRAAASEANRMESKKVGKRLGAGKQQMGAELTEQHMARISLPAKILGY

SEQ ID NO: 1017307 - protein, 110 aa, Homo sapiens
SRSGDADATKEMNQNKITLLGGGNRKEHVAITPLHPCKEARRCLEQGRPSLLQIARSELSKGSTGRTGRKVLQGTDRTVPGLGKRNTVQTQSPYEWQAQLKISKRAFLGF

SEQ ID NO: 1017308 - protein, 155 aa, Homo sapiens
RCGDRVHNCGIVQHHALNQLSLADCPGTLFITPEEKPTPTQELPPSSGNQSHGISVERPIPNTSITAITHDPLHLAFLPGHNVFKLHPWCSLPQSLLLVFLEPGVSLCHQAGVKCHNHGSLLPPTPGFEGSSAPASRGAGTTGVCHHAQIIFKIL

SEQ ID NO: 1017309 - protein, 151 aa, Homo sapiens
MPEETQTQDQPMEEEEVETFAFQAEIAQLMSLIINTFYSNKEIFLSRAHFKIHSDALDKIRYEELDRIPGKVRLWAKSCILNLIPNKQDRTLTIVDTGIGMTKADLINNLGTIAKSGTKAFMEALQAGADISMIGQFGVGFIILLIWLLRK

SEQ ID NO: 1017310 - protein, 122 aa, Homo sapiens
MENQIMDFRMQLVRLCYNSNHENLKPQYLEQLPAQLKQFSLFLGKFTWFAGEKLTFVDFLTYDVLDQNRIFEPKCLDEFPNLKAFMCRFEALEKIAAFLQSDRFFKMPINNKMAKWGNKCLC

SEQ ID NO: 1017311 - protein, 86 aa, Homo sapiens
VEPSRKPKRRRAADVEPSSPEPKRRRVGDVEPSRKPKRRRAADVEPSSPEPKRRRVGDVEPSRKPKRRRAADVEPSLPEPKRRRLC

SEQ ID NO: 1017312 - protein, 143 aa, Homo sapiens
WAPISPSLGPRYRESNTAGNDVFHKFSAFIKNPVPAQDEALYQQARALARDSYLRAPLEHEVGGGCRCASSRRFLDGDVTLADCSLLPKLHIVDTVCAHFRQAPIPAELVRRYLDSAMQEKEFKYTCRTAPRIRWYRPAVHPP

SEQ ID NO: 1017313 - protein, 124 aa, Homo sapiens [sequence omitted]

SEQ ID NO: 1017314 - protein, 124 aa, Homo sapiens [sequence omitted]

SEQ ID NO: 1017315 - protein, 124 aa, Homo sapiens [sequence omitted]

SEQ ID NO: 1017316 - protein, 151 aa, Homo sapiens [sequence omitted]

SEQ ID NO: 1017317 - protein, 87 aa, Homo sapiens
MSQAVEILFCGKILENHQNKLLPNNILPETESERSRIVHSLPPRSLCAESREDMGPVIRALLPLPVGSTARRPLSAPQAWHQPQGPV

SEQ ID NO: 1017318 - protein, 110 aa, Homo sapiens
MVLVLALPRGVGVAVWGGERRPSLMEPTVPGPGLSLCEGLPCVTHSYMSSGREDISADQSFLRIFFESSRYLETSPPHLWGAGAVLGVGADGWTAAAALLGVGSPWSTQW

SEQ ID NO: 1017319 - protein, 128 aa, Homo sapiens
MEGTGAVWELPSFPPCSAWGKRWGAWSLLFAPWWDLGGLASPVCPVVGLGCLPSMALRALVQTQAKGLGGGQAQATPPLSGAEAAYHHDRAPRRPLLPSHRPLPLDTLSSIREVSDPSEIQAMSNLRS

SEQ ID NO: 1017320 - protein, 178 aa, Homo sapiens
VILEEHGYRRTTTPTTDTHHKAEAKVTYPPNVGQEALSQTTISWAPFQDTSEYIISCHPVGTDEEPLQFRVPGTSTNATLTGLTRGATYNIIVKALEDQQRHKVREEVVTVGNSVNEGLNQPTDDSCFDPYTVSQLCQWEIEWERNVWNEALNCGASADALEVVISDVIHLDGAMTMV

SEQ ID NO: 1017321 - protein, 122 aa, Homo sapiens
NECTLVHADLSEYNMLWHAGKVWLIDVSQSVEPTHPHGLEFLFRDCRNVSQFFQKGGVTEALNERELFNAVSGLNISADNEADFLAEIEALEKMNEDHIQKNGRKAASFLKDDGSPPVLSAD

SEQ ID NO: 1017322 - protein, 176 aa, Homo sapiens
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLWGLYESIQDYKHLCQDLSFCQDLSSSLHSDSSYPPDAGLSDDEEPPDASLPPDPPPLTVPQTHNARDQWLQDAFHISL

SEQ ID NO: 1017323 - protein, 166 aa, Homo sapiens
MPVTSGCRMPSTSASEGLGGRGHAPMQKAQKLPLRQALRLRSLRLPPYRLTSQEGQACIPQRRNCQTLSPVLGWLALGRASRVQPLLMALGLQFFHMCAPPAWPTLSLAVGPEASSLPLGVSGIGMSAWLPSPPHLLLLSAAAGSGASHLRALGSSALEGLQDPSQ

SEQ ID NO: 1017324 - protein, 316 aa, Homo sapiens
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLSAGGAAAVGHVLVVPAVGPVRVNPGLQTPVPRPELLPACLLTRHPLLCPRRTMPVTSGCRMPSTSASEGLGGRGHAPMQKAQKLPLRQALRLRSLRLPPYRLTSQEGQACIPQRRNCQTLSPVLGWLALGRASRVQPLLMALGLQFFHMCAPPAWPTLSLAVGPEASSLPLGVSGIGMSAWLPSPPHLLLLSAAAGSGASHLRALGSSALEGLQDPSQ

SEQ ID NO: 1017325 - protein, 154 aa, Homo sapiens
MNGLPSAEAPGGAGCALAGLPPLPRGLSGLLNASGGSWRELERVYSQRSRIHDELSRAARAPDGPRHAAGAANAGPAAGPRRPVNLDSALAALRKEMLSAGGAAAVGHVLVVPAVGPVRVNPGLQTPVPRPELLPGPVILPPFGQLLPTGCGPV

SEQ ID NO: 1017326 - protein, 154 aa, Homo sapiens; identical to SEQ ID NO: 1017325

SEQ ID NO: 1017327 - protein, 190 aa, Homo sapiens
MPVTSGCRMPSTSASEGLGGRGHAPMQKAQKLPLRQALRLRSLRLPPYRLTSQEGQACIPQRRNCQTLSPVLGWLALGRASRVQPLLMALGLQFFHMCAPPAWPTLSLAVGPPGKKKGISFRSIFPSAWRLWDWDECLAPISSSPFVAIGSCWLRGIPPPGSGFLCPGRAPGPVPITTHGQEGQGPVLDI

SEQ ID NO: 1017328 - protein, 281 aa, Homo sapiens
MSQQRPARKLPSLLLDPTEETVRRRCRDPINVEGLLPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 1017329 - protein, 326 aa, Homo sapiens
MSQQRPARKLPSLLLDPTEETVRRRCRDPINVEGLLPSKIRINLEDNVQYVSMRMEEWAPERRHLYYEICTFVPEVTASGLETKCDIVEVLSNRTFLTEEALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 1017330 - protein, 249 aa, Homo sapiens
MNPSPSKIRINLEDNVQYVSMRKALKVKRPRFDVSLVYLTRKFMDLVRSAPGGILDLNKVATKLGVRKRRVYDITNVLDGIDLVEKKSKNHIRWIGSDLSNFGAVPQQKKLQEELSDLSAMEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 1017331 - protein, 129 aa, Homo sapiens
MEDALDELIKDCAQQLFELTDDKENERLAYVTYQDIHSIQAFHEQIVIAVKAPAETRLDVPAPREDSITVHIRSTNGPIDVYLCEVEQGQTSNKRSEGVGTSSSESTHPEGPEEEENPQQSEELLEVSN

SEQ ID NO: 1017332 - protein, 281 aa, Homo sapiens; identical to SEQ ID NO: 1017328

SEQ ID NO: 1017333 - protein, 65 aa, Homo sapiens
SLHVVPTLRTGGRRGLSAWHLDKTRSTVPAVCWYCSHFQEPATGEVRAGCFGTGSLVALGLSSLK

SEQ ID NO: 1017334 - protein, 110 aa, Homo sapiens
MGRRALLLLLLAFLAPWATIALRPALGPSQPTLANQPHIPPGCSKNYSVLYFQQKPPLVIPGKQGLEGTSSKLQQTCSSGSRLLEGKLTNRKDIHTKTPSVRHHSFKDQR

SEQ ID NO: 1017335 - protein, 71 aa, Homo sapiens
SLRLVRGRVNRQRLNKSSVIGRYIHSSQQYKSNKLLIATFDFYFLAFVLFFFRIKKTLWLWTNYMKDLEPV

SEQ ID NO: 1017336 - protein, 402 aa, Homo sapiens
GYRDRGQARHERRAPRLPRVLSNVPAPQHERHFRHPRAAVGGGAHGGGGQVGFEARPCPSPRPSRDYISRGASAVFCGDCGAETSPGSGARDFHSCVRLRGAWRRDQRPNSGSDKMAGLPRRIIKETQRLLAEPVPGIKAEPDESNARYFHVVIAGPQDSPFEGGTILKLELIPFQEGITQWEALEVRFMTKIYHPNVDKWGRICLDILKDKWSPGLRIRHGGLLIGSRPCQVLPKSEMIQFSTNDVAERTWKSNRSPSQEKNSLEHGTRLYAMSNMEHDTITQDVIILLFCKSYSSLLPLMDTVLETLQSTPEPEIFERRHMMYNIEEQSIGGLMMPGGDQGHLRGAWGKDGVRAHCFTRASWGHRMRGRKQDPVTHNIGRDPAPRETRRTRALSPKARQY

SEQ ID NO: 1017337 - protein, 230 aa, Homo sapiens
GTAKMAASVRQARSLLGVAATLAPGSRGYRARPPPRRRPGPRWPDPEDLLTPRWQLGPRYAAKQFARYGAASGVVPGSLWPSAGAAAGAWRPEEREWYPSLATMQESLRVKQLAEEQKRREREQHIAECMAKMPQMIVNWQQQQRENWEKAQADKERRARLQAEAQELLGYQVDPRSARFQELLQDLEKEGAQAPQGGKNRNGRRRRGACCIGLQLCASRPSSLWGTQAP

SEQ ID NO: 1017338 - protein, 230 aa, Homo sapiens; identical to SEQ ID NO: 1017337

SEQ ID NO: 1017339 - protein, 216 aa, Homo sapiens
GTAKMAASVRQARSLLGVAATLAPGSRGYRARPPPRRRPGPRWPDPEDLLTPRWQLGPRYAAKQFARYGAASGVVPGSLWPSAGAAGEGAAHRRVHGQDATDDCELAAAAAGELGEGPVLTRRGGPDCRLRPRSSWATRWTQGVPCFQELLQDLEKEGAQAPQGGKNRNGRRRRGACCIGLQLCASRPSSLWGTQAPEALSFPIKLLPGSYPLKEI

SEQ ID NO: 1017340 - protein, 275 aa, Homo sapiens
ERVNDHDSLDPHYSNKFVSHFQIRCKSRDGFVPTSAQGKYASHCYDVNNQGVDGEDKKNRDNIWPELRVAQAARAAAAPASSAWRQARPPGVVVGVAGRRGRGRAAGLGGAAGWKWVELPLEAAPDLGPRPDEPVGPEPSGPTEPARSRLQGESRRGAGTGQAAAGAVSVSLSFTLRPARWRARSGGGGGRLDMGKREPPKGVMINDLIDHSGCYFLMPQDILLGTTTPAPGHSDLPLLSDPLWPDYYSQSYLATNGYQGNLGEQIQFFHYWLYT

SEQ ID NO: 1017341 - protein, 247 aa, Homo sapiens
TFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGGSVWTSPSLAHSFFDAANL

SEQ ID NO: 1017342 - protein, 257 aa, Homo sapiens
TFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 1017343 - protein, 257 aa, Homo sapiens; identical to SEQ ID NO: 1017342

SEQ ID NO: 1017344 - protein, 257 aa, Homo sapiens; identical to SEQ ID NO: 1017342

SEQ ID NO: 1017345 - protein, 121 aa, Homo sapiens
VPRAVGIRHAMGCSCCVMPRFCLPVETSTPRASLRVWDFPAGAQPPLCHGDTGQGRHWPSLLPAPRGLALGSSAWAEDVACRILLCLGVALCGPVPHWPILFLTQPICDHDSSHRCLLLGF

SEQ ID NO: 1017346 - protein, 257 aa, Homo sapiens; identical to SEQ ID NO: 1017342

SEQ ID NO: 1017347 - protein, 257 aa, Homo sapiens; identical to SEQ ID NO: 1017342

SEQ ID NO: 1017348 - protein, 257 aa, Homo sapiens; identical to SEQ ID NO: 1017342

SEQ ID NO: 1017349 - protein, 257 aa, Homo sapiens; identical to SEQ ID NO: 1017342

SEQ ID NO: 1017350 - protein, 39 aa, Homo sapiens
ASADRPKNTPTGIRAINEDSTGTKKGPQKKPNHLSTYRI

SEQ ID NO: 1017351 - protein, 302 aa, Homo sapiens
QHQKKLNSAGDGSPVSMREEGSRLVSTDPHEDFRLAVRPPGPALPLSFSYSFKTLLLLFKNELDGREVASPTLQVTHSGEGGGGGGRKSWGWGWEHGNSFLKASGSCFPWPLLEGPWTGRSACLFGNQVCEPNACQAMHSAEEPLYLAALRGARGHLPCGSRHHVGSLAPASVPAPGACLWVCEWETLLPGLILERPLVPSAEASGAGKPQQKGGTTEQLCIVIVGFGAFGGSLVTGNCLCACVGCMLPGLSCPRPAQATPSHPKPLVELLWNHLPKAQGRIQGSKTISMELMFFFSVGTFF

SEQ ID NO: 1017352 - protein, 165 aa, Homo sapiens [sequence omitted]

SEQ ID NO: 1017353 - protein, 305 aa, Homo sapiens
AHSGSAALGLRRALRVGARDVVVGAQPAAPCPSPPGPEYRPPTKEEPEVSVPAAMLPRRPLAWPAWLLRGAPGAAGSWGRPVGPLARRGCCSAPGTPEVPLTRERYPVRRLPFSTVSKQDLAAFERIVPGGVVTDPEALQAPNVDWLRTLRGCSKVLLRPRTSEEVSHILRHCHERNLAVNPQGGNTGMVGGSVPVFDEIILSTARMNRVLSFHSVSGILVCQAGCVLEELSRYVEERDFIMPLDLGAKGSCHIGGKRGNQRWRPAVSSIWLTAWDCPGPGSGAGRRHLSWDCLTSLRKGQQVMN

SEQ ID NO: 1017354 - protein, 256 aa, Homo sapiens
AQFTEACEPVKRQPRSQCLSTLVRPVFGELKEKHKQSGGSVGALEELENAFSLAEESCPGISDKLMVHLVELSAEVFTQQKPPDIHPLKRTAVQIGDGRSFVFGSELHKNCADLEGALCYVVPAGTRRIPWASHARSPGHRLLPPLQCAVVHVRDAVLYAHCPPPSPGPAVLLTGAPAAGVALMSYAWVFCRLMQPYGPLRPRRRATIRAALPPPPMRWGEATGQPPEECPGRCPPGAHDGHRFALWCWIRYCVCS

SEQ ID NO: 1017355 - protein, 87 aa, Homo sapiens
STSIGTYVLLCDGTREFGHYGRDVKTLELNLRRHHFSAYVCSLECSTGKKHVCFSCRKIIFETYQSVLYQRNREYLQGCTGRLFISP

SEQ ID NO: 1017356 - protein, 154 aa, Homo sapiens
MRCLTTPMLLRALAQAARAGPPGGRSLHSSAVAATYKYVNMQDPEMDMKSVTDRAGRTLLVGLALFLMCLVHDTMSYLFRVNRTPSSYPVLRQGPADVPSASLWVSMLLAPVPILGKGAVALALQSSAEAILPRTHGPFIPSDGLEAKRCLTWQ

SEQ ID NO: 1017357 - protein, 147 aa, Homo sapiens
MRCLTTPMLLRALAQAARAGPPGGRSLHSSAVAATYKYVNMQDPEMDMKYVCREPTCVADFQAGYWSCRTAIRQAVAVRMLADIEEVMLSGACRSYSVSAYTVNNRIMGLARIQPLVHGHRCEQGVSEVSNAQSGDLIGTPRPSLCH

SEQ ID NO: 1017358 - protein, 130 aa, Homo sapiens
KKKGKANPSDLLELGHSSACGHQSLGFLALGLQGIHQWPPEGSKDFGLELRITPSASLGLRFLGWIKSCFQHFRVSAVQMACCGTSQPPLSDALIPPISPISYIVIYPTTFQSREQHIRWWPSSKLRLIY

SEQ ID NO: 1017359 - protein, 130 aa, Homo sapiens; identical to SEQ ID NO: 1017358

SEQ ID NO: 1017360 - protein, 257 aa, Homo sapiens
GPFQAVNALLKHLVSAADPSRYFSSSGSTRWMTSARYLEQMDVTHASIHPVLVILIESCEIFMMEAATGSVEKCKRMASVDRRRPAWSMSSRVGPSEQEQVKYTARHYARWAEPSSLGSDTTLVPGASGLPLTVAFGYEVPFLTWFRMVSCDVGPQARDCFCSSRAEGGSGCHLCLIGGSLTGRPGGWLVGLLFVGLFPHGLFELLTGSRAFELDVGLELLKEFLHGGGWPGGGGPRGRGGTGPSRGRGRRRPATGR

SEQ ID NO: 1017361 - protein, 33 aa, Homo sapiens
MVAAGPAAGGRGGGGARGPVGDGAAGDQPPEEN

SEQ ID NO: 1017362 - protein, 142 aa, Homo sapiens
EDSVSEGMTLRRPGCAPSALGESYSVGAGSCPNCVGAAPSHTPLGILGLKAGALPGLLGGGLQHTGLSLRSSGRVHYAGSLGPGTSHVPSCQKREVSLLVEILNFGFALVLSFVNRVTGAVKKEMLEMILALTLPSEADAGG

SEQ ID NO: 1017363 - protein, 380 aa, Homo sapiens
MMGSCGGAGSPYMSPAGASMSVETVDGTVLTPWTRNTTYIAVVRMSSHTQSHTHERELYKDNTDCWRGPHESMGRGRDWNVDRDSRNSSWRNGQLVKMLLYTEVTRYLDFKVVEGSFVYKGGKIYKVPSTETEALASNLMGMFEKRRFRKFLVFVANFDENDPKTFEGDRTPDYQHAMTSTEKEDLGQDVIDFNMAMTTERSTDTDDYLDQTCLETDNGIHSWYSESLDPGMGRAHIYTRLYGLELSCTRVFEGLSGNILGGHIMPSTKQERRDTQYMGQQREGLVERSNNRRGHKLTGQENRRNSVNPRTQHRNQCARQRAAQGNTRSPVNHKNPHNKNKNRHIMGNKRSPRARSEKRQHSRNIESNESTERQQCNTEN

SEQ ID NO: 1017364 - protein, 97 aa, Homo sapiens
DVGVGPGGRCSGRGSRSLMNGLGHPLGDEGTLTLSVHKIWWFKRVLAPLPTPTLSCSCFCHGTRMIPLPSARTKSSLEPPQKLSDVGAMLLVQPAEP

SEQ ID NO: 1017365 - protein, 229 aa, Homo sapiens
MDNLSSEEIQQRAHQITDESLESTRRILGLAIKSQDAGIKTITILDEQKEQLNRIEEGFDQINKDIERDKEDFNRTQQMLEAMMYTTHIKKTKNKKQTKQEDNKGDGGENSPCNVVSKQPGPVTNGQLQQPTTGGKPVVDTLNSITNDAREDEMEENLTQVGSILGNLKDMALNIGNEIDAQNPQIKRITDKADTNRDRIDIAKARAKKLHLTAKATVSSLSFITSVAL

SEQ ID NO: 1017366 - protein, 256 aa, Homo sapiens
MTGIPEKMKKDFRAMKDLAQQINLSPKQHHSALECLLQRIAKNEAATNELMRWGLRLQKDVHKIEGRVLPMERINLKNTSFITSQELNWVKEVTRDPSILTIPMHFWALFYPKRAMDQARELVNMLEKIAGPIGMRMSPPAWVELKDDRIETYVRTIQSTLGAEGKIQMVVCIIMGPRDDLYGAINKLCCVQSPVPSQVVNVRTIGQPTRLRSVAQKILLQINCKLGGELWGVIPLKQLMVIGMDAYHDPSGMRSA

SEQ ID NO: 1017367 - protein, 146 aa, Homo sapiens
MLTVLIGSKQVSEGTDNGDLPSYVSAFIEKDTLEMTYKVFYTEDLDKLIEQRTVSKMQLEELGTYNFHQKMLERIRECLKKDAWKESNAFLNQCLEQETHLFSAINSHCADCADLGLDDLGTMISQIEEIERQYLLTLNGFHKLMN

SEQ ID NO: 1017368 - protein, 100 aa, Homo sapiens
VLRRRCRRSLSAPASFDRLPPPAGGAASSTATPASSLPYVPYNSSPYISFYPYPSSPHRQDRGGGRDSEQQPEFIKPLNLYRTEQRQHCSWNALFLKKKA

SEQ ID NO: 1017369 - protein, 195 aa, Homo sapiens
QGSFSRPHRFFYLYHFAFYAYHYRFNGQYSSLALVTSWLFIQHSMIYFFHHYELPAILQQIRIQEMLLQAPPLGPGSPTALPDMNNNSGAPAKAPSAGHPALGPVGASGSGPVAAAPSLVAAAASAAAGGYLGMAETAAIITDASFCISFLERPAILGGHQDIFPIYLSSYTTLAVGGKEMVPTEAPSEVGFEHS

SEQ ID NO: 1017370 - protein, 148 aa, Homo sapiens
MLSGPRKAYRRGGTCAKPWKGAKGRARGDLRRRTHWAFSCDVAKEHDVQNTFEEMEKHLGRVNFWVNAAGIPGMVFSKNKTLKIWYLIFILTSVGSMLTCKAAMRTMIQQQGGSMVNVGSIVGLKGNSGQSVIQVPVKEDSGISTCSG

SEQ ID NO: 1017371 - protein, 67 aa, Homo sapiens
HSRGRPAPALTVVDRGRRWDPSPLLGAHLARPSSLRFAPSPRTRTRVYIAPHFIPVPGEQRWVYVFI

SEQ ID NO: 1017372 - protein, 122 aa, Homo sapiens
LFFLYMCLSFSSYHFSRSFPPLRGVGSYCLVRDPLVCLRTRASPRVLPARGDTFSPGPLSLPFLGTVGTVHPKPVFPSGFPVFLNHRPQRSFQAPVFLSSPTTLPLPSPPSHIRAALSWLAR

SEQ ID NO: 1017373 - protein, 156 aa, Homo sapiens
RVTVFTGFACIQNAHHFEVHLADFHGTLKKRVHIGRPGPQPRHDFMVLGINIVVVLTENMRVFHIGRRTFQAIQAQQTQAENVFANRRFIFVRGKFCCLTLQLAEIVAHQLQVSHRVIDARVGIYSQALRFQRAQGNRFTSVATNTRRIEVNVGQG

SEQ ID NO: 1017374 - protein, 196 aa, Homo sapiens
ALSTPAQETNQPNSHHHHQMRRTPSNTPATPPNGPDTLAMHAKHRASEGLHLSNSPMTAAACAPPANSSSLLGLAPAQPPGALEPALRPHHRPPPPPPTAHVAPRSTAGGRPAESHGAIDRPEIRLNPPGWLELGATPGLWEHRRARKGEPGEGRGFPEDRTERFYKRIFVGRGDSKLPGPRGSFRSFSGKFFLCF

SEQ ID NO: 1017375 - protein, 122 aa, Homo sapiens
CRARVGPPEKIQSPKEIVPFVCWSGPRSQTTSSSHSLTAFSPGPGHPKSTLTTGAGKEGFTFYRYPGGPGPPKPAPPSTHPLPPHAPPAQVEPCPRKDWKGSAHKPLGHSTLSTRKSGKRGR

SEQ ID NO: 1017376 - protein, 116 aa, Homo sapiens
DTCRQGRGESQVETMRSRLALAYTRADGVNVCHRSTVGRGRNKWCPGMRPVERGSSGLSLSAKGTKRRPGNLDGACASAKPHVEMPARGPQRFLQQSPHPQPSTTQLALTQPPLRR

SEQ ID NO: 1017377 - protein, 53 aa, Homo sapiens
MRRFLRPGHDPVRERLKRDLFQFNKTVEHGFPHQPSALGYSPSLRILAIGTRS

SEQ ID NO: 1017378 - protein, 53 aa, Homo sapiens; identical to SEQ ID NO: 1017377

SEQ ID NO: 1017379 - protein, 81 aa, Homo sapiens
AFPTPIIRPQVVTAFSPEVSSGGCRLSKMRRFLRPGHDPVRERLKRDLFQFNKTVEHGFPHQPSALGYSPSLRILAIGTRS

SEQ ID NO: 1017380 - protein, 233 aa, Homo sapiens
MNNRINRNTWNDNARSSPVVIDASTAIDAPSNLRFLATTPNSLLVSWQPPPAKSTGYIIKYEKPGSPAREVVPGPGADVTEATITGLEPGTEYTIYVIALKNNQKSEPLIGRKKTDELPQLVTLPHPNLHGPEILDVSFHSSKDPFPHPTPGYDTGKWYSSFWHFWSATQCWGNKMILLREHGFLGDHTGPQTGHPHKGIPKTIPRPNVGEEIQIGHIPREDVDYHLVPTRSG

SEQ ID NO: 1017381 - protein, 245 aa, Homo sapiens
MNNRINRNTWNDNARSSPVVIDASTAIDAPSNLRFLATTPNSLLVSWQPPPAKSTGYIIKYEKPGSPAREVVPGPGADVTEATITGLEPGTEYTIYVIALKNNQKSEPLIGRKKTDELPQLVTLPHPNLHGPEILDVSFHSSSWHFWSVTQCWATVIFEEHGFRRTTPPTPLTPEGIGQAIPPNVGQEGLFQNEHMMAPFQDTCEYTNLCSAVATDEEPFQLGVLDFYKGTVTGLTEVPPQQHNG

SEQ ID NO: 1017382 - protein, 117 aa, Homo sapiens
MLGIQTTGQSRYFNSILQIRVRFREMIELVRTEPGLKLELTTSTSSLHSVTHERDFPARPGAFYFKGQRDLFFLSCLSMAHSFILGFRVASLGWQSSGHWGRVTPGGVHISHHFKGE

SEQ ID NO: 1017383 - protein, 61 aa, Homo sapiens
MRNQLELAARGPLRQTFTHNPLLQPGKDNPPNISPSLQENGGVQWEPALCLLCAVHLLCAV

SEQ ID NO: 1017384 - protein, 239 aa, Homo sapiens
HEGGSVRWGPAHPNTRVQLDSGVPHLLPILRVLLPHGEPQPWQVHLESRKQATGLTHETVWRPSSRCRCGPQEPTGVSAAEPPPCCVGGEQAGSLSVFFYTACACTSPNNLSWFSAKKSSDSPGVLGHHVELDPRLSWARTDHSGGGSGRRCLSAHGLCVSAVGGLAMPGPSLSVHWGRSMEAEAAVRRPSIGASLLPSSLWQENRDGLVMNYHSQTRVHLEHQDGTMFENRVFPNVIK

SEQ ID NO: 1017385 - protein, 110 aa, Homo sapiens
PQLQSNETKAVPELSKTDSKPGGHESSGIPPTGRSFSGLNSRLKATPSTYSGVFRTQRVDLDQQAYLPDALGWRHKPWKRTVPPPREGPSRREEEPGSRGDKEAEKPPPR

SEQ ID NO: 1017386 - protein, 253 aa, Homo sapiens
CHISCYTEVPIISTSSRSVMLHYRSDLLQMLDTLLAPCIWVLQSRSSWEWKSHTLNCTGIDIHILYGYLRIHAQLHWAQIPAIQLPQMTSRFYKCCPAISPSHRLLLLFHYLQWVWGGIWPRHRFSLQVNIRKRDNSRKEVQRRIFAHQPGPEGQEESTPQSDVTEDGESPEDPSGTEGQLSEEEKPDQQPLSGEEELEPEASDGSGSWEDAALLTEANLPAPAPASASAPVLETLGSSEPAWGCSPTAPHLL

SEQ ID NO: 1017387 - protein, 129 aa, Homo sapiens
CHISCYTEVPIISTSSRSVMLHYRSDLLQMLDTLLAPCIWVLQSRSSWEWKSHTLNCTGIDIHILYGYLRIHAQLHWAQIPAIQLPQMTSRFYKCCPAISPSHRLLLLFQLPAVGVGGHLAQTPLLFAG

SEQ ID NO: 1017388 - protein, 163 aa, Homo sapiens
ERSRLGLGVSVHQRSGPKCIAVFTRVSEPRIQISTLPGSYPHPIPAKTLNAVSGQSNYGGSQGSGQTLNRPPVASNPVTPSLHSGPAPRMPLPASQNPATTPMPSSSFLPEANLPPPLNWQYNYPSTASQTNHCPRASSQPTVSGNTSLTTNHQYVSSGYPSL

SEQ ID NO: 1017389 - protein, 103 aa, Homo sapiens
RVPWNLGSRWLSGLCSGFHAEVRRVPWNLGSRWLSGSSGCVARGQKTPGAFQSLFQEWDMDRKRVITTSLNFLDCSRKRGIQKPGTARRWPVRQIGLAWMSKL

SEQ ID NO: 1017390 - protein, 124 aa, Homo sapiens
LRANPLAQQARAALRKLVIDVVPPKFLGDLLLLLQLPVRSFSKEEQAPLRLVKPPRARRLACSKRVCSNPGAAVPPARSPEGKGVPRARGQRSPAPTGAGPRPQPAAGRTAECFSPLIKIIRLL

SEQ ID NO: 1017391 - protein, 112 aa, Homo sapiens
MAVLWRLSAVCGALGGRALLLRTPVVRPAHISAFLQDRPIPEWCGVQHIHLSPSHHSGSKAASLHWTSERVVSVLLLGLLPAAYLNPCSAMDYSLAAALTLHGHWGPWTSCY

SEQ ID NO: 1017392 - protein, 116 aa, Homo sapiens
CTLSDGRYDLTASTELALHVLPQGCSLKTECCHVSHKTKCAIHLVDDWCPTGFQVGFNFQPSNSSSPGKVLSNTTTITGAWAFITSLPSKHLQNQNESEGMEKGMFYEGFNGLAAL

SEQ ID NO: 1017393 - protein, 317 aa, Homo sapiens
MSTDEAGGRTEPKSELEPEERVFKKEVYLHTSPHLKADVLCQSDPTAEMAAESLAFLLWDTVQLVKLEAWYEDLQEVLSSDENGGNYVSPPGNGTMEESKNLQAILTLHSHGLADMRRRQKQQRSQDDRPRSPHSPDSSQSSLAQEDSRRTDKGEPGNGNSSGRYPSRAGKAAHERRKNKENDRASGTNKLQQTDRIHAGKSQRREHGTERRTRRTLHRPDMVTTGANASTNREAKSPPNQRPHIPHTLPQNEGYWNTALHKWTMLVTLKSTIRREKRMQKTQKGQRHKCVSRKAPSLHTEHQQTQQERDHKKIDNH

SEQ ID NO: 1017394 - protein, 80 aa, Homo sapiens
MTLHSPAGFLDECIAKRILIAIAPIKEASRAVGYVMCSLLYPLVTFFLCLCIYWGSTAVLPHFPTKRSIRSFDDSPCFNC

SEQ ID NO: 1017395 - protein, 72 aa, Homo sapiens
ELPPAHAMESIRLDLDILGGKCLEPGRWLGEEPQEESPGFSAVENVTRCCTPNSKGGTWHVVSNSLCICCMI

SEQ ID NO: 1017396 - protein, 81 aa, Homo sapiens
TLSRELEPELRRRRYEYDHWDAAIHGSLYILRGSARYSHEILRDEESFFGERRIPRGRRISVICRSLPEGMGPGESGQPAC

SEQ ID NO: 1017397 - protein, 40 aa, Homo sapiens
MARAPEHREAIRTSLLATMRPPSSLPAAKTKGGLGSPGRR

SEQ ID NO: 1017398 - protein, 146 aa, Homo sapiens; identical to SEQ ID NO: 830300

SEQ ID NO: 1017399 - protein, 146 aa, Homo sapiens; identical to SEQ ID NO: 830300

SEQ ID NO: 1017400 - protein, 146 aa, Homo sapiens; identical to SEQ ID NO: 830300

SEQ ID NO: 1017401 - protein, 146 aa, Homo sapiens; identical to SEQ ID NO: 830300

SEQ ID NO: 1017402 - protein, 183 aa, Homo sapiens
TFPQGRTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQHPPKPAVSPGKTVNDVNSNNNMSYRN

SEQ ID NO: 1017403 - protein, 256 aa, Homo sapiens
TFPQGRTLVTNQPSGNVEFISVQSPPTVSGLTKNPVSLPSLPNPTKPNNVPSVPSPSIQRNPTASAAPLGTTLAVQAVPTAHSIVQATRTSLPTVGPSGLYSPSTNRGPIQMKIPISAFSTSSAAEQNSNTTPRIENQTNKTIDASVSKKAADSTSQCGKATGSDSSGVIDLTMDDEESGASQDPKKLNHTPVSTMSSSQPVSRRIATHTTSTALQPSGCHKGTILDTYIYYLQLHYREFKNRPVLRDPRFLYQGS

SEQ ID NO: 1017404 - protein, 70 aa, Homo sapiens
MGVGPPRKRKMVFGIPEFPVGRRVEVSTFLEKGWVPDKLPQPHVNGTVMPAVPPYKWVKMFQFYIHPYPQ

SEQ ID NO: 1017405 - protein, 120 aa, Homo sapiens
DPRAPDTGASPWLNQLTEEQIAEFKEAFSLFDKDGDGTITTKELGTVMRSLGQNPTEAELQDMINEVDADGNGTIDFPEFLPMMARKMKDTDSEEEIREAFRVFDKDGNGYIQRSQSCVT

SEQ ID NO: 1017406 - protein, 120 aa, Homo sapiens; identical to SEQ ID NO: 1017405

SEQ ID NO: 1017407 - protein, 109 aa, Homo sapiens
LDGDFDLAEEAVHEAFFIAIERWQAMVPANPRAWLVSTGRFKAIDVLRRRGFCRIPGAVDRPGRSVGADRWNDEDVEDDRLRLIFTCCHPALSADAQVPLTLREVCELV

SEQ ID NO: 1017408 - protein, 69 aa, Homo sapiens
MCQLMHRTEEEKNGGNERRLEVGRNVSGSLTSGRPPSVFTPIGLDLTGHLFLTERLLKRLQQTRPSEIP

SEQ ID NO: 1017409 - protein, 148 aa, Homo sapiens
EEHYHLVNKCCQGKECSNTSDALDPPLKNVSSNAECPACYESNGTSCCGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 1017410 - protein, 166 aa, Homo sapiens
EEHYHLVNKCCQGKECSYTSDALDPPLKNVSSNAECPACYESNGTSCCGKPWKCYEEEQCVFLVAELKNDIESKSLVLKGCSNVSNATCQFLSGENKTLGGVIFRKFECANVNSLTPTSAPTTSHNVGSKASLYLLALASLLLRGLAAPRTSRARKSPEERRPGKR

SEQ ID NO: 1017411 - protein, 139 aa, Homo sapiens
EEHYHLVNKCCQGKECSYTSDALDPPLKNVSSNAECPACYESNGTSCCGKPWKCYEEEQCVFLVAELKNGNQVMVQIELETHLDKYPLGVHFLPKKLDEAVAEVHLHRLNVKLTKLTEKQAQYLGMSCDGPFKLDDYHY

SEQ ID NO: 1017412 - protein, 155 aa, Homo sapiens
EEVAALELLPGTSDPGSKHVVLHRLFLQPLSRPFSPCPRAGTVPEAPPLEPEDSGTFSLGKMITAKPGKTPIQVLHEYGMKTKNIPVYECEQHLTVQIHVPTFTVQQVTVGDITCTGDTVQRYRSLADNIELHEAAINILAKPMHSYMLRSFLTP

SEQ ID NO: 1017413 - protein, 120 aa, Homo sapiens
YYYYIRGRVDSAHTVGLGVQKNSGNSDFPYLDSGLNSGAELQGPGSGADSPALTNMQLNKFQHAGERSWLAQYKYDFAQLGVNGLVFATTYVHGDQIRTPADPNAKEWERDISLASTRPR

SEQ ID NO: 1017414 - protein, 111 aa, Homo sapiens
EHPRDLKFSIDYILSSPDPFPGLKPPCLHKRADTRGWRTWDSTFGQCDVEPPWRPLQFSLGSSPDPPWKDDSSPTLSQEARVRQILQFLLQTEGQVPHQAWTGGTGGGGAP

SEQ ID NO: 1017415 - protein, 619 aa, Homo sapiens
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVKGDVHNWKLTEEDYELAMAELNDTYSLGPLGSGGFVPFGFEGILRGAATCFYAFVGFDCIATTGEEAQNPQRSIPMGIVISLSVCFLAYFAVSSALTLMMPYYQLQPESPLPEAFLYIGWAPARYVVAVGSLCALSTSLLGSMFPMPRVIYAMAEDGLLFRVLARIHTGTRTPIIATVVSGIIAAFMAFLFKLTDLVDLMSIGTLLAYSLVSICVLILRYQPDQETKTGEEVELQEEAITTESEKLTLWGLFFPLNSIPTPLSGQIVYVCSSLLAVLLTALCLVLAQWSVPLLSGDLLWTAVVVLLLLLIIGIIVVIWRQPQSSTPLHFKVPALPLLPLMSIFVNIYLMMQMTAGTWARFGVWMLIGFAIYFGYGIQHSLEEIKSNQPSRKSRAKTVDLDPGTLYVHSV

SEQ ID NO: 1017416 - protein, 619 aa, Homo sapiens; identical to SEQ ID NO: 1017415

SEQ ID NO: 1017417 - protein, 238 aa, Homo sapiens
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVGDVPWSSGGSIARDSSRFVALTGALLGK

SEQ ID NO: 1017418 - protein, 132 aa, Homo sapiens
MTVRISSQSGGINSPELTIGLIGKQPKPNNVNALLITIFTGSLFYTSYKPQEYFESPFTISDGIYGSTFPVAHRLPRTSRPSLAQTFLTHLAFIRQLIFHFSIQSITLASKPSPDTGIPSMWLDYFCMSPSS

SEQ ID NO: 1017419 - protein, 102 aa, Homo sapiens
MYGQHPVSLALAFLACIVFLVVYKAFTYDHSCPEGFVYKHKRCIPASLDAYYSSQDPNSRSRFYTVISHYSVAKQSTARAIGPWLSAAAVIHEPKPPKTQGH

SEQ ID NO: 1017420 - protein, 102 aa, Homo sapiens; identical to SEQ ID NO: 1017419

SEQ ID NO: 1017421 - protein, 113 aa, Homo sapiens
LHAAFALEPGKEYLIMGLDGATYDLEGHPQYLLDSNSWIEEMPSESLCPEHRQRAACAQLNDFLQEYGTSGVQGVRACPPTSAGRNLEPGEPWKLEELAVSAFHGQPGDQGMI

SEQ ID NO: 1017422 - protein, 107 aa, Homo sapiens
FEMWTVVNPMGLLVEELKKRNISAPESRLTRQSGSTTAHAIYILLAYTCDRKHDCRGTWGKLYSLPEEEAAPVALRKLYGFTENRRPWDYSKPKESPKRAEQTSVAS

SEQ ID NO: 1017423 - protein, 81 aa, Homo sapiens
GENKKNRAVIRESRKGVTDPKELKFCVQDLSDQLLEVVGLEGVIEYDVDLYLPDDCRQKVSSSYVFFHSSGTIHAVSSHAY

SEQ ID NO: 1017424 - protein, 100 aa, Homo sapiens
GENKKNRAVIRESRKGVTDPKELKSCVQDLSDQLLEVVGLEQPLCMDFKMVIFSSVTRTPLCMDFKMATFSSVTKMPLCMDFKMVIFSSVTKMPLCSDTP

SEQ ID NO: 1017425 - protein, 72 aa, Homo sapiens
QAFGSRTYPSGHPASQALRLRLHYCTSDPAAPAHRQQIPGPPSLHTCMSQFPHKSHLTQLDGAYWFCFSGKP

SEQ ID NO: 1017426 - protein, 176 aa, Homo sapiens
MSEHSLKAGADITPREGDELARLPYLRTWFRTRSAIILHLSNGSVQIHFFPDPPQLILGPLMATLTYIDENREFRTFRLVLLEEYGCCKELASRLRYARTMVDHSCLSSRSASNRLKASIIAALPIRSWCPPHSHPAFWGPHNWLAPAVPLSARVPTTPRWLGTEAASSLQVGVAV

SEQ ID NO: 1017427 - protein, 119 aa, Homo sapiens
MSEHSLKAGADITPREGDELARLPYLRTWFRTRSAIILHLSNGSVQIHFFPDPPQLILGPLMATLTYIDENREFRTFRLSSPGGVRLLQGAGQPGPLRPHYGGPQLLSSRSASNRLKAS

SEQ ID NO: 1017428 - protein, 98 aa, Homo sapiens
PTRPRNHRHIGGAFLKRFPASSIGMEAKLRIDDCFVEVKSCTESQEQGQGRDAPRMILCQFLLESSDVISAVLSILDTVIVAPTGLAVFYKEPRKGRA

SEQ ID NO: 1017429 - protein, 70 aa, Homo sapiens
PPRTRNNKARKTESEPRGLLATGRGGSSMETGERARLILILVLQLLLRIRRNRQQRCRRVLSHRSLFPRM

SEQ ID NO: 1017430 - protein, 124 aa, Homo sapiens
FLNEVAKKEKQLRKMLEGPFSTPVPFLQSVPLYPCGAFSEVEKRKLNSQTRGNFIETSSGPVGGQYGEAGTASGEGQSGQPLLQLHAALGGPAGAPSALKPRVPPNLQYPNGSAPKQAHAPPSM

SEQ ID NO: 1017431 - protein, 276 aa, Homo sapiens
MCGIWALFGSDDCLFCSVSECYEDAHRGPDAFRFENVNGYTNCCLWISPVGGSGPAVGNAANSSEEISGICGSDTMVKSTTISKMQQHFEFEYQSKVDGEIILHLYDKGGMSKQFVMLDGVFALFYWILPIKETCSLGRRYIMESDPFVKAMTRKMDLWCMCQKAKGLVNVGKDSGIPFYNGGAYFFPWTLCSLDFKARWARLHPSEMVNIITGGMKPLSLYEMWETPSGFELNWGNTQDLFIRCTNVARTTLGLTGGTQGGPCTLQPTTPKMGNP

SEQ ID NO: 1017432 - protein, 385 aa, Homo sapiens
MGRWCQTVARGQRPRTSAPSRAGALLLLLLLLRSAGCWGAGEAPGALSTADPADQSVQCVPKATCPSSRPRLLWQTPTTQTLPSTTMETQFPVSEGKVDPYRSCGFSYEQDPTLRDPEAVARRWPWMVSVRANGTHICAGTIIASQWVLTVAHCLIWRDVIYSVRVGSPWIDQMTQTASDVPVLQVIMHSRYRAQRFWSWVGQANDIGLLKLKQELKYSNYVRPICLPGTDYVLKDHSRCTVTGWGLSKADGMWPQFRTIQEKEVIILNNKECDNFYHNFTKIPTLVQIIKSQMMCAEDTHREKFCYELTGEPLVCSMEGTWYLVGLVSWGAGCQKSEAPPIYLQVSSYQHWIWDCLNGQALALPAPSRTLLLALPLPLSLLAAL

SEQ ID NO: 1017433 - protein, 102 aa, Homo sapiens
WTSHSLSHRYHEGFRGLAVILIATALCAPASASPYSWDTTPLLTLSYIARPLPRAHIKEYFYTSGKCSNPAVRLCHPKEPPSVAANPEKKWVWEYINSLEMR

SEQ ID NO: 1017434 - protein, 92 aa, Homo sapiens
RSASVSRYFVLVLMYRIILQFHVFILDTTPLLDFVLHMPAHLPRAHIKEYFYTSGKCSNPAVRLCHPKEPPSVAANPEKKWVWEYINSLEMR

SEQ ID NO: 1017435 - protein, 180 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTYRLFLPLTLPQSAPCEGTKKGHKLHLDYIGPCKYIPPCLDSELTEFPLRMRDWLKERPGHPV

SEQ ID NO: 1017436 - protein, 242 aa, Homo sapiens
AGIFRHHLLFGFLCTIIKFSYFHLDRISSTRYLITSATSSNCLIRQGLLLGSLPAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTYRLFLPLTLPQSAPCEGTKKGHKLHLDYIGPCKYIPPCLDSELTEFPLRMRGLAQGTSWSPCMRGMRTTTSD

SEQ ID NO: 1017437 - protein, 132 aa, Homo sapiens
MVQRKPKRRWWRKIPARTTTANTARCASWMRTTPPCACARTPPAAQPPLASYEKVCSNDNKTYRLFLPLTLPQSAPCEGTKKGHKLHLDYIGPCKYIPPCLDSELTEFPLRMRDWLKERPGHLYERDEDNNF

SEQ ID NO: 1017438 - protein, 98 aa, Homo sapiens
MRAWIFFLLCLAGRALAAPQQEALPDETEVVEETVAEVTEVSVGANPVQVEVGEFDDGAEETEEEVVAENPCQNHHCLPLIPMEHCTTRFFETCDLGN

SEQ ID NO: 1017439 - protein, 131 aa, Homo sapiens
GGGGAGCCSGSPAAARRPLEEDEEGDDEFDDEAPESLSYSPAPRQSREEERRVRETVRRDKTLHEGEEEATHGVVTIEQKRRKLLPDTILEKLTYELHKTNIKKSPGKVKEVNLQKKNEDCEKGNDSKKVK

SEQ ID NO: 1017440 - protein, 638 aa, Homo sapiens
GFKRRRLLRSVGKAPWAAGTSSSGPQAQQHRGGGPRRSLHGGGPACRIPRGEPLPRDVGEERRGGGGTELGPPAPPRPRNGYQSPPGTWWVWRGAKRRNSCSCSGEAGEASNIRTFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVLPFHLLCRVPQAPYQPLQLPQLSLHPHLPPPDIANVAGLPASRRQGLGVEARVPRKRAEGVGEAATTTTTHCLQQASKSNSSKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 1017441 - protein, 142 aa, Homo sapiens
KGWVWGHRPQGSAFLPCSLGCCCLGEHSFGETAWQAEAEKPGRIEEKRAWAPGPEDAGAQVGDPNEVECKYSQIGLEHNGGGGTTAGLAPHIPGDWRSDFGAMGSRHYAFIFSVSLAFERRRPGALFMDPVDPRSDVQALSS

SEQ ID NO: 1017442 - protein, 74 aa, Homo sapiens
SRGPLYAQPSDANPTPTTLVPPVAFQMLTLRMAFQVEKEKEAVVVEAATGKKGKSRRPRLIPGIVGLSCPVLER

SEQ ID NO: 1017443 - protein, 103 aa, Homo sapiens
MAEGGFDPCECVCSHEHAMRRLINLLRQSQSYCTDTECLQELPGPSGDNGISVTMILGSLDGLLAWICVLNEDSYILKRIQPNLKANQSSKVGHDPTSSSLLD

SEQ ID NO: 1017444 - protein, 103 aa, Homo sapiens; identical to SEQ ID NO: 1017443

SEQ ID NO: 1017445 - protein, 93 aa, Homo sapiens
DDSEREKRGQREHYVWEVPEAASAEEQKALEDKVTSPEKAEEAKLKARYPHLGQKPGGSDFLRKRLQKGQKYFDSGDYRMAKQMKNSNSTAVG

SEQ ID NO: 1017446 - protein, 291 aa, Homo sapiens
LLDVDMDGSSGTYWPVNSDQAVLSLIWAGSDLRLQGTEDDTLVQPPPPDSPSIKDEARRMIRSAQQVVAVVMDMFTDVDLLSEVLEARPRVPVYILLDEMNAQHFLDMADKCRVNLHHVDFLRVRTVAGPTYYCRTGKSFKGHVKEKFLLVDCAVVMSGSYSFMWSFEKIHRSLAHVFQGELVSSFDEEFRILFAQSEPLVPSAAALARMDAYALAPYAGAGPLVGVPGVGAPTPFSFPKRAHLLFPPPREEGLGFPSFLDPDRHFLSAFRREEPPRMPGGALEPHAGLRP

SEQ ID NO: 1017447 - protein, 124 aa, Homo sapiens
PVVCPEQGTQWCCSSPLATFRATPAPGQWEAQVSGKCGCGNGQVRGWGNYGAAHADPLRLGPVSNTPAEVAHGGPRPGSALEGSGIGEGSWAESPTSSQKTEEASQGPREASTVREGFQRGGMA

SEQ ID NO: 1017448 - protein, 120 aa, Homo sapiens
MKIFLPVLLAALLGVEREEQSVLPEADHLRTEQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 1017449 - protein, 131 aa, Homo sapiens
MKIFLPVLLAALLGVERASSLMCFSCLNQKSNLYCLKPTICSEQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 1017450 - protein, 131 aa, Homo sapiens; identical to SEQ ID NO: 1017449

SEQ ID NO: 1017451 - protein, 131 aa, Homo sapiens; identical to SEQ ID NO: 1017449

SEQ ID NO: 1017452 - protein, 203 aa, Homo sapiens
IRPRREDDRRGQSMAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPN

SEQ ID NO: 1017453 - protein, 185 aa, Homo sapiens
IRPRREDDRRGQSMAAGELEGGKPLSGLLNALAQDTFHGYPGITEELLRSQLYPEVPPEEFRPFLAKMRGILKSIASADMDFNQLEAFLTAQTKKQGGITSDQAAVISKFWKSHKTLSWRVDGKSQSRHSAQIHTPVAIIELELGKYGQESEFLCLEFDEVKVNQILKTLSEVEESISTLISQPN

SEQ ID NO: 1017454 - protein, 203 aa, Homo sapiens; identical to SEQ ID NO: 1017452

SEQ ID NO: 1017455 - protein, 250 aa, Homo sapiens
IRPRREDDRRGQSMAAGELEGGKPLSGLLNALAQDTFHGYPGITEELLRSQLYPEVPPEEFRPFLAKMRGILKRQNLPIIVQGGLKFLGLSNPLSLASQLLGLQQLFWAWKLDLGERSGWSIASADMDFNQLEAFLTAQTKKQGGITSDQAAVISKFWKSHKTKIRESLMNQSRWNSGLRGLSWRVDGKSQSRHSAQIHTPVAIIELELGKYGQESEFLCLEFDEVKVNQILKTLSEVEESISTLISQPN

SEQ ID NO: 1017456 - protein, 106 aa, Homo sapiens
GHSRFARVDPELPEAAVLLSRVGFSNSIAFFRFSRAQPSLEPDIRAGRFRGLGLGLNSSHRNGGAGNNTTTSSHLFPYPSHHQAARRPGTGALEKMADDIDIEAMP

SEQ ID NO: 1017457 - protein, 106 aa, Homo sapiens; identical to SEQ ID NO: 1017456

SEQ ID NO: 1017458 - protein, 162 aa, Homo sapiens
MTVDIGPRRGCIGGAVPGGILDAGLFDRWRQPSPPARHWLHSRPLWHTAAHSCLLGVLFFNACISLPPQAGGFEPPFCPANLQLPDSMCTALFAAEFARPRLTWRGIRVPFHTEAPSTWLSNNPVFPCICLTGCLSASFLKNHTITAICRSKRRPNNADGSD

SEQ ID NO: 1017459 - protein, 280 aa, Homo sapiens
NLNLKRFEKPKLKPRPPPPPPAPPKEDVKEKIFQLKAIPKKKVPEKTQVPEKRVELTPLKVPGGERGKFANYFRNVKPEPKEEVVLKSVLGKRPEEEEPKVEPKKLEKVKKSLQDQNQQAPKPVEEVEVPTVTPTGTWKIPEPTKVPEIKPAIPLPAPEPKPKPEAEVKTIKPPPVEPEPTPIAAQYTVPVVGKKQKPKAPKEEGCKPKVLIKVYPKSQKLHLLKYQRSQEGVPEKKGPRVLLKAESPEGRGPKKWRKKGAAPKAESPGGRRQRPKGRPQ

SEQ ID NO: 1017460 - protein, 86 aa, Homo sapiens
AKCEELLEKTVKNCLALADDKKLKSIAFPSIGSGRNGFPKQTAAQLILKASSSATMSSSIKTVYFVLFDSERIGIYVQEMAKLDAN

SEQ ID NO: 1017461 - protein, 229 aa, Homo sapiens
LKLGFRLAGCSHPHHNPPSFYRAVWAPNWGWWNSPAFCRLLALPVPNGAFVGTPAEVALIRITADGRLPANQRRGYKNVFNALIQITREEGGLKLWRGCIPTMARAVVVNAAQLASNSQTKQIKLNSGYFSNNFLCNFCASMISGLVTTAASMPVDIAKTQIQNMRMIDGKPEHKNVLYVLFKVVRYECFFSLWKGFTPYYARLGPHTVLTFIFLEQMNKANKRLFLSG

SEQ ID NO: 1017462 - protein, 115 aa, Homo sapiens
RHSGAAIFVVRFYIVQNIMDDVTAFLLQQLTLSKEVHIRSVWMATHGLLSSDAPRRCEESAIDEVVVTNTIPHEVQKLQCPKIKTVDISMILSEAIRRIHNGESMSYLFLESIGR

SEQ ID NO: 1017463 - protein, 279 aa, Homo sapiens
RNLLKTRHKRSPTKDMDSEEKEIVVWVCQEEKFVCGLTKRTTSADVIQALLEEHEATFGEKRFLLGKPSDYCIIEKWRGSERVLPPLTRILKLWKAWGDEQPNMQFVLVKADAFLPVPLWRTAEAKLVQNTEKLWELSPANYMKTLPPDKQKRIVRKTFRKLAKIKQDTVSHDRDNMETLVHLIISQDHTIHQQVKRMKELDLEIEKCEAKFHLDRVENDGENYVQDAYLMPSFNEVEQNLDLQYEENQTLEDLSESDGIEQLEERLKYYRILIDKLSA

SEQ ID NO: 1017464 - protein, 127 aa, Homo sapiens
TEPPPLPEAQPLVATFIPLHPPRTRSVVVAPARRGQRHERGPRDGTESIMGSTVPRSALRAASAAAPAPGRAALRGRSSPSSCRTTPSRCFHEEVEQGVKFSLELPGSFTGRATTDVELLILEGPPG

SEQ ID NO: 1017465 - protein, 113 aa, Homo sapiens
MLFVLKWHVLLLKPEKGGKVFKAAALLVNEILNSRLLLGKEASPGSPVLPRAVGLSSGETAPIPEAEGGNRFGAALSQGVEAQGRSRAFLLSKSEIMATPGARSPSTKTAIAV

SEQ ID NO: 1017466 - protein, 107 aa, Homo sapiens
QGAGREQPPESSVALPVTSPASPPSTSSLHQLLPRSLPADLQTLPVQSRPKDTALAVPSWERLCPDVPGIPFPRWTPFPPSLSHWARDIYSSLRIPRCPPPTRTSAP

SEQ ID NO: 1017467 - protein, 191 aa, Homo sapiens
AVGVVACICKSKLLKRSSHVSLPRLQVHTIIHGTGSRYVAQTGKFRFLNQVWGLQILFSHRVTIYPDNAPFHAVFPHLQYCSPIPPPLGVKVTRRDLSSLALTPRWPQWKVSKGNRFGFTGRAAAGVWVLEAQECRSLQLTDSTRLSSQTLSEISSQLPPLFHLHALPAVFCPFQHWPFLWVGGQRIQFPA

SEQ ID NO: 1017468 - protein, 95 aa, Homo sapiens
HFYYYPTLITRISIDEQILVSNLCYLRSLPEPVLTFHTINNIISGRHIYLFRVYSITATPRRDCINRYSSYSFSYVYAVFYLHSTAGRLKYQEPL

SEQ ID NO: 1017469 - protein, 74 aa, Homo sapiens
LCGGVPCIAGHPAAITLAFLLRAKLAPAPPPVVTAQVFPGVQQCPLVMLRGTGVLPPGFERCLTPTSGVSLPCV

SEQ ID NO: 1017470 - protein, 118 aa, Homo sapiens
MEVNAGGVIAYISSSSSASSPASCHSEGSENSFQSSSSSVPSSPNSSNSDTNGNPKNGDLANIEGILKNDRIDCSMKTSKSSAPGMTKSHSGVTVSDFGFLKIAAINCKWGLFYQLFI

SEQ ID NO: 1017471 - protein, 725 aa, Homo sapiens
MEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNFKSMIMRLMGLAAIFPVGESQQHLNGQFKGRNIMHYPNGPGHLVLHNGHCTEPSPMLILNAAHAAYSFPISTALSLQYLQTPTIAPPVPTTCAGTAMPSGSRPTAAKSPLLWILITSRHMQHLGQQLLACTPSLQASGHEPGRDTPAHPATPWALTTTLILPATEPQGSTPAHRASRTSHAAPQPAPPSEPALHSNPDSPSDNDTKTRLPNSWQQEHTTARPDITPHVHTGRNHSGEPTPPKPPTATQPQAQKAQTPPHPPQETPSNKQPATPTSPPTALRRTRLAPTHATQRANTTHASTLHPTHTATTPRQPRPERAPTPRPRHPPGATRDSTTSTPRQQDTAPATADQQHPPRTQPRTSTTTRSTAHTTRTDNTSEHTPQQPTQTHRHRVPQHRHAHPTPPPPVSTPAADPPAQRPRHARPATQPPP

SEQ ID NO: 1017472 - protein, 152 aa, Homo sapiens
MEASALTSSAVTSVAKVVRVASLRSFAPRIATVVKGGVVAMAGNANGCSVPWHCGGNRFVLHSKPRMMSGGGQLPNGGGVASGALWLTLQSLGSNWTLRIDQVHPGLHWVCHCGCHCEVLLAPPSCREENHARGEGTSILTQRGANYPKILG

SEQ ID NO: 1017473 - protein, 255 aa, Homo sapiens
MPSWLMENFIRGRRIIFLGSEPIISRNSSHSPLRTEYAIPWPNEPSFVFADVIRKSPDSPDGEDDRVYFFFTEVSVEYEFVFRVLIPRIARVCKGDQGGLRTLQKKWTSFLKARLICSRPDSGLVFNVLRDVFVLRSPGLKVPVFYALFTPQLNNVGLSAVCAYNLSTAEEVFSHGKYMQSTTVEQSHTKWVRYNGPVPKPRPWSVHRQRGTGRQLHQLFEFASPDPAAVFKEGPADIRVCEKNGRALETCVPVQ

SEQ ID NO: 1017474 - protein, 124 aa, Homo sapiens
EDKILLENYVRSIENERDTLEFEMRHLQREYLSLSDKICNQHNDPSKTTYISRREKFHFDNYTHEDTSSPQSRPLASDLKGGNNTHACPGSRGNTISSFQGCKHTCSVLQRHSVFQDCYSNIPC

SEQ ID NO: 1017475 - protein, 60 aa, Homo sapiens
MDSASVHLRSEEVHWLHVDMGVSSVREKYELAHPPEEWKYLRIRYLPKGFLNQFTEDKPT

SEQ ID NO: 1017476 - protein, 130 aa, Homo sapiens
GIQTRNRKMSSKSKKCKKVHDSLEDFPKNSSFNPAALSRHMSSLSHISPFSHMSSLSHISPFSHSSHIADHAHADAPAIQPVLWTTPPLQHGHRHGLEPCSMLTGPPARVPAVLSCIFAGAVFMEGLNAM

SEQ ID NO: 1017477 - protein, 79 aa, Homo sapiens
QWQRGHPASPDEHPAMCLHPPALTQPDPPAERTCRVDLGSEVYRMLRDQPSPWRGPKQSGSFRYLQGMLEAGEGDWPGL

SEQ ID NO: 1017478 - protein, 71 aa, Homo sapiens
NVMPLDVEIPTYRNLLEGESGNLPITYSANFRETSEQKGSEVHTKKTMIKTIETRDGEVVSEPTQQQHEVL

SEQ ID NO: 1017479 - protein, 147 aa, Homo sapiens
QRVGPDVLDPNLTPEVVKERLLSPRFRNRQFAGLLLDQAFLAGLGNYLRVEILWQVGLTGNHKAKDLNAAQLDALAHALLEIPRFSYATRRQVDENKHHGALFRFKVFHRDGEPCERCGSIIEKTTLSSRPFYWCPGCQHEADRFGA

SEQ ID NO: 1017480 - protein, 146 aa, Homo sapiens
MQHFNRCFKHLNEFHDPLIGAAQRTGIAVGVRVILRVVFEFTNIGVSQPAREMSWLFSSPGSVLAIAIVAELTADLQYPELSDIGTKYMQAVGRQGDMRVREYREDGLVLQNLALPGMEGDGKREGKHDGKITAAKEEAKEVTQAI

SEQ ID NO: 1017481 - protein, 146 aa, Homo sapiens
MQHFNRCFKHLNEFHDPLIGAAQRTGIAVGVRVILRVVFEFTNIGVSQPAREMSWLFSSPGSVLAIAIVAELTADLQYPELSDIGTKSCRRFAAKDDMMVREYRENGLVLQNLALPGMEGDGSREGKHDGKITAAKEEAKEVTQAI

SEQ ID NO: 1017482 - protein, 77 aa, Homo sapiens
MPSVPTGEWALMAGPRRPQTRRRGIGKIFTPFRKERRNLRSLPCPTSVEQLPLTERRAPLENVLIVGSEAGLSYVYM

SEQ ID NO: 1017483 - protein, 173 aa, Homo sapiens
VPYLVGPVVAGAPALQLFESPAGHLGPQLFNQFALPYIRDVAQPVKARLREAGLAPVPLIIFAKDGHFCPGGTGPSWLMSVVMGVELDTLAHRKRGVCWGKTVTIARAHLEPLCLVCTLRRRSGSLVKQMLDDFGPHRYIANLGHGLYPDMDPEHVGAFVDAVHKHSRLLRQN

SEQ ID NO: 1017484 - protein, 104 aa, Homo sapiens
MPTYALSLVNRETKACGPPDLPVGPPEEIGQLGEQMLDDFGPHRYIANLGHGLYPDMDPEHVGAFVDAVINTHVCFDRTECIPLPSSTTTQMIDRFQDNKSFGV

SEQ ID NO: 1017485 - protein, 151 aa, Homo sapiens
YICEFCARSFRTSSNLVIHRRIHTGEKPLQCEICGFTCRQKASLNWHRRKHAETAAALRFPCEFCGKRFEKPDSVVAHCSKSHPALLPAQEPPGSLVSSPSISAPESLQSPEGASISTTSDSNPCLLNIHFFTWGARPQEQREKLGECSGG

SEQ ID NO: 1017486 - protein, 154 aa, Homo sapiens
SGFARHLATKWRARGRRAEPQGREAPGPAGGGGGGSRWAESGSGTSPESGDEEVSGAGSSPVSGGVNLFANDGSFLELFKRKDGGGAAAAGRRSLPPGSAADPDQSACRRWAPGDPKEGMGGPGSTLSFVGKTQRREQTSPQDGNSSQEAEDGG

SEQ ID NO: 1017487 - protein, 72 aa, Homo sapiens
RGADEVRRRWQLTFADGASLKGNSKYSWVLQRLECELVGCGYEGASSAMPLAPGEAVASHSLPSQCGEASSM

SEQ ID NO: 1017488 - protein, 72 aa, Homo sapiens; identical to SEQ ID NO: 1017487

SEQ ID NO: 1017489 - protein, 92 aa, Homo sapiens
FLSGPELLALAEMGKFMKPGKVVLVLAGRYSGRKAVIVKNIDDGTSDRPYSHALVAGIDRYPRKVTADHGQEEDRQEIKDKIFCEQCITTIT

SEQ ID NO: 1017490 - protein, 92 aa, Homo sapiens; identical to SEQ ID NO: 1017489

SEQ ID NO: 1017491 - protein, 176 aa, Homo sapiens
PRIPISFPWLQDRPNKKTNNSNSYMNIFASLFLENVELEFPEEFRSHFLWLQDRPNKKTNNSNSYMNIFASLFLENVELEFPEEFRSHFLWLQDRPNKKTNNSNSYMNIFASLFLENVELEFPEEFRSHFLWLQDRPNKKTNNSNSYMNIFASLFLENVELDSLRIQCSLRIQWTS

SEQ ID NO: 1017492 - protein, 130 aa, Homo sapiens
IAALLSILLTTSANSECWIVTNLHGYGAMNGDRYEFTKDSTEDSVFNVTINGDKSSVYESVSGVYPEMKYTALSSNTMVGEYQSGGGITVETWSITTDKKALYSKVMNIPGMQQLTSKSFVGDVVGTSNQ

SEQ ID NO: 1017493 - protein, 376 aa, Homo sapiens
AGGQGARMRGVAEGVLLRLRERRGVGAGWGHRDPGQGGESPSSSPTCPKRENSRDVFIDSGGVRRVAELLLAKAAGPELRVEGWKALHELNPRAADEAAVNWVFVTDTLNFSFWSEQDEHKCVVRYRGKTYSGYWSLCAAVNRALDEGIPITSASYYATVTLDQVRNILRSDTDVSMPLVEERHRILNETGKILLEKFGGSFLNCVRESENSAQKLMHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDHREDMKGIPFHRIRCIYY

SEQ ID NO: 1017494 - protein, 160 aa, Homo sapiens
MHLVVESFPSYRDVTLFEGKRVSFYKRAQILVADTWSVLEGKGDGCFKDISSITMFADYRLPQVLAHLGALKYSDDLLKKLLKGEMLSYGDRQEVEIRGCSLWCVELIRDCLLELIEQKGEKPNGEINSILLDYYLWDYAHDHREDMKGIPFHRIRCIYY

SEQ ID NO: 1017495 - protein, 140 aa, Homo sapiens
PRTQLLNDSRLPAPQTLMLEMTFFVAESVGSHVWGPRSLCFCGERAHSPLCSPGWQGVSDRLLTGMKQSCGTGVQGWPQGPCVSSNHAALFTAGFIPFVPLYVDCRPLCGRAVTYQHTDSMARDIPGDNLEALTLEGKSC

SEQ ID NO: 1017496 - protein, 118 aa, Homo sapiens
VNIDVEVGHLGVHVVILLHLQAERGGEGQVFHLDGVDVYLLYEAGVGNQLFEVHHIHQGFLDGHIFDARYIEAINVLPPVDLVVFVLRSSVAVTYSVARSGKMRLLGASHLSGHRAQC

SEQ ID NO: 1017497 - protein, 103 aa, Homo sapiens
MAQFVRNLVEKTPALVNAAVTYSKPRLATFWYYAKVELVPPTPAEIPRAIQSLKKIVNSAQTGSFKQLTVKEAVLNGLVATEVWMWFDVGEIIGKRGIIGYDV

SEQ ID NO: 1017498 - protein, 103 aa, Homo sapiens; identical to SEQ ID NO: 1017497

SEQ ID NO: 1017499 - protein, 162 aa, Homo sapiens
GPGNAAIMARGFLFFSEGGVLAGERGGRADANMQIFVKTLTGKTITLEVEPSDTIENVKAKIQDKEGIPPDQQRLIFAGKQLEDGRTLSDYNIQKESTLHLGVCACEVGIIEPSRPTSLPRKYNCDKMICRKCYARLHPRAVNCRKKKCGHTNNLRPKKKVR

SEQ ID NO: 1017500 - protein, 162 aa, Homo sapiens; identical to SEQ ID NO: 1017499

SEQ ID NO: 1017501 - protein, 71 aa, Homo sapiens
GTQTPKGTPGASNNPPVRPETIKLSHFGAIRGNLEIKNSWGLVWKKSSQGGIRESMGRIILTLCGRKMSFK

SEQ ID NO: 1017502 - protein, 319 aa, Homo sapiens
AGGQMERRWPHFPSGRECNMAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDNIRNWIRNIEEHASADVEKMILGNKCDVNDKRQVSKERGEKLALDYGNPSSLEDQVQRPNINVGKNAFFTLARDIKAKMDKNLEGNRPPGEQPGESKITVEQQKEEQLFPDAVFCEDTVSAYSEPVLSQADCAARAAPALMLHPVAGSIGTCYLSVPAGLSTSKWRSPHCRSMSLQIGNGLLLGEGKWGGAEGQQGGPTQDEG

SEQ ID NO: 1017503 - protein, 298 aa, Homo sapiens
AGGQMERRWPHFPSGRECNMAKTYDYLFKLLLIGDSGVGKTCVLFRFSEDAFNSTFISTIGIDFKIRTIELDGKRIKLQIWDTAGQERFRTITTAYYRGAMGIMLVYDITNEKSFDETSLETCGSPTLVGAPRSCVRAVLKKDYYILRGNPRLVWLVDLGPRRTQVFPRERGEKKSWHFDYGNPSSLEDQVQRPNINVGKNAFFTLARDIKAKMDKNLEGNRPPGEQPGESKITVEQQKEGAAFSRCRSPVRTQSLPTLSLRSAKLTVPVLSEPLTQPGSLPPPKPRHARATGPRPPN

SEQ ID NO: 1017504 - protein, 127 aa, Homo sapiens
PSADCKRVYCTRATLGHKRTELVQSAGGPGQRDCFGCKKGGHFSRRSRRGDVPGLLRLITDGSTQSDSLSRPSASLTSAPAGVVGARAGLLWTSASSFFSLRFSLRILFFLPLRSHGAGVSRKMASC

SEQ ID NO: 1017505 - protein, 122 aa, Homo sapiens
MHAGAAPVASPIWAGCPLPAPRPPHLALRLDDVRVSEVVDAVAAHVVAGRRPPAPPSALRVVGRQVPEFSDHALLRPGPGVAWQRQEAECDQGQAQRQREVRTRHGRQCRRSPQSRECPVGR

SEQ ID NO: 1017506 - protein, 115 aa, Homo sapiens
KAELPFITDTAGLEMPSTMPKTQIAFAFGDLSHLHTVVLLGVERSSAREPQGPQKSTRQASSFCAPAARGQSGEVDVVSSDPGLAAVCAPHLHRQEVLDAGHQLLCALMMCVSRK

SEQ ID NO: 1017507 - protein, 90 aa, Homo sapiens
GHQSWPSTGKGIRFVATDVGWGGSGPQILHLFTRWTQEGYEPLCRGAPLAGAEPGLGEAGGPIGPCSAPPLPDDRAICLPRVYTLTDSRM

SEQ ID NO: 1017508 - protein, 131 aa, Homo sapiens
TTTKFAAASTDGCEERNHKRPLPKKTDMYTGITESPRKAKQSPQSQLSSPPNKNNTERPPMTHPTEAFRAAYRTSITPHYNPWLHAGFVLGYGLLCITLFWSTTQQIHPLEWLTIPFTLIFFNLCVDAAAN

SEQ ID NO: 1017509 - protein, 259 aa, Homo sapiens
MQAWLLPPGGLPVSSVMLEMCHDAWMDLMLGESGAPVLLCVCCVLSCAAKHDLYVCAGGREPGGCVLCDLKADALVNVGCGWSQWSLWLGGVWMHAFRLPLCGVPWTPACSVAAITGLPVWTMRTGPRRHELMPHPRRYHFLMMRGRPWGCYREHYRSRKHKLTKKSLRGQVVVTWTRRRSADEDMLPCPFSKAVMMIVRPTGGCMTGDTVAATDGNDYSRDRGDAYYDTDYRHSYEYQRGEQQLPQPAQQSGGSTIRA

SEQ ID NO: 1017510 - protein, 74 aa, Homo sapiens
KVRGPVKVLDSRRLYSCKWVQFQDNFSLQDALLLLLVSFLTFDLLHEARRSHFASSCGMPLTLLGLAFCLHPWA

SEQ ID NO: 1017511 - protein, 103 aa, Homo sapiens
MAQKPKVDPHVGRLGYLQALVTEFQETQSQDAKEQVLAKPRQLRLHDTQTTTEYHADKIAGPEIYYHRLRMSEETRAPGGRLAIGGHDDNTVTKTGDKKGAPY

SEQ ID NO: 1017512 - protein, 108 aa, Homo sapiens [sequence omitted]

SEQ ID NO: 1017513 - protein, 172 aa, Homo sapiens
ARGCVDPLWGTRYVRPFLMPETMAKAAEPKAPQSFEAAMAELEGLVASMEGGQLTLEASLAAYKRGAELLKYCQAALEDAQQQIKVLEATRWQTGPVQTIPSDFAGWMQAHQARIEAALERVLPAADIAPQRLHEAMRYAVLGGGKRIRPLLAYAGGEATGAPVDAVDRIAA

SEQ ID NO: 1017514 - protein, 740 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1017515 - protein, 740 aa, Homo sapiens; identical to SEQ ID NO: 1017514

SEQ ID NO: 1017516 - protein, 740 aa, Homo sapiens; identical to SEQ ID NO: 1017514

SEQ ID NO: 1017517 - protein, 690 aa, Homo sapiens
QKFFYHHHGFVAMFKFLSFRVRSIQEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1017518 - protein, 740 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGCLHFAGLPK

SEQ ID NO: 1017519 - protein, 723 aa, Homo sapiens
QKFFYHHHGFVAMFKFLSFRVRSIQEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1017520 - protein, 482 aa, Homo sapiens
QKFFYHHHGFVAMFKFLSFRVRSIQEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKVNFFYLKCNSYSSCSCMSVPVKNYTPLVVKSAFCYKKVKYLASDLQRS

SEQ ID NO: 1017521 - protein, 740 aa, Homo sapiens; identical to SEQ ID NO: 1017514

SEQ ID NO: 1017522 - protein, 740 aa, Homo sapiens; identical to SEQ ID NO: 1017514

SEQ ID NO: 1017523 - protein, 238 aa, Homo sapiens
MAVELGVLLVRPRPGTGLGRVMRTLLLVLWLATRGSALYFHIGETEKKCFIEEIPDETMVIGNYRTQLYDKACSGGCTSRPPRGLGMFVEGEGPRVTLVILARAVCAPMGRFTFTAHIPGEHQICLHSNSTKFSLFAGGMLRVHLDIQVGEHANDMQKIAAKDKLSDVAATKCDSWWNKVEQIQKRAELPGVAERSASGRPRESTNQRVLVVVHSERPFILRWLIELSGMMRDLKELL

SEQ ID NO: 1017524 - protein, 218 aa, Homo sapiens
GLPPSLPSSYSHSFHTHWLTHLLSLSISLTMTILGTTFGMVFSLLQVVSGESGYAQNGDLEDAELDDYSFSCYSQLEVNGSQHSLTCAFEDPDVNTTNLEFEICGALVEVKCLNFRKLQEIYFIETKKFLLIGKSNICVKVGEKSLTCKKIDLTTIVKPEAPFDLSVIYREGANDFVVTFNTSHLQKKYVKVLMHDVAYRQEKDENKWTVCSSTTLIK

SEQ ID NO: 1017525 - protein, 231 aa, Homo sapiens
GLPPSLPSSYSHSFHTHWLTHLLSLSISLTMTILGTTFGMVFSLLQVVSGESGYAQNGDLEDAELDDYSFSCYSQLEVNGSQHSLTCAFEDPDVNTTNLEFEICGALVEVKCLNFRKLQEIYFIETKKFLLIGKSNICVKVGEKSLTCKKIDLTTIVKPEAPFDLSVIYREGANDFVVTFNTSHLQKKYVKVLMHDVAYRQEKDENKWTACEFIQHKADTPAEKAPTGSNV

SEQ ID NO: 1017526 - protein, 131 aa, Homo sapiens
LGAGCVRWLAGAARRSPCSLCSVCCVLRRLELMPHDPGAWCGGGRPAGAALYVSAPTLTCAGESGKSTIVKQMRILHVNGFNGDSEKATKVQDIKNNLKEAIETIVAAMSNLVPPVELAKPENQVQSGLHI

SEQ ID NO: 1017527 - protein, 175 aa, Homo sapiens
SATTVVDANAEGTSQVYRATHRLLLLGAGESGKSTIVKQMRILHVNGFNGDSEKATKVQDIKNNLKEAIETIVAAMSNLVPPMEAGPTPEKTVPELDYIHAVCINMPRLLTSAPNSISIPMLYGTINDFIPTTNTPTITILLTVPHTCLTRSTLSTNLTLSLSIQTYFAYHILTF

SEQ ID NO: 1017528 - protein, 106 aa, Homo sapiens
SATTVVDANAEGTSQVYRATHRLLLLGAGESGKSTIVKQMRILHVNGFNGDSEKATKVQDIKNNLKEAIETIVAAMSNLVPPGCPPPLCCPPPLCCPGAGDLLGCP

SEQ ID NO: 1017529 - protein, 222 aa, Homo sapiens
LGAGCVRWLAGAARRSPCSLCSVCCVLRRLELMPHDPGAWCGGGRPAGAALYVSAPTLTCAGESGKSTIVKQMRILHVNGFNGEGSQEDPQLQGATAMSEKATKVQDIKNNLKEAIETIVAAMSNLVPPMEAGPTPEKTVPELDYIHAVCINMPRLLTSAPNSISIPMLYGTINDFIPTTNTPTITILLTVPHTCLTRSTLSTNLTLSLSIQTYFAYHILTF

SEQ ID NO: 1017530 - protein, 120 aa, Homo sapiens
SATTVVDANAEGTSQVYRATHRLLLLGAGESGKSTIVKQMRILHVNGFNGEGSQEDPQLQGATAMSEKATKVQDIKNNLKEAIETIVAAMSNLVPPGCPPPLCCPPPLCCPGAGDLLGCP

SEQ ID NO: 1017531 - protein, 196 aa, Homo sapiens
MGTATPDGREDQEGLWVSVEDAQIAQRSPSWLTVRPDMTVASLRDMVCLDYGFPPVLQPVALIGAAGWHETRRPCVPMGLRQHSGQLPNSNLGVSPKHFLQPQELALGSGIADVGTIWAFTGLYAETAGAPVEPVAPKRPGGPPEPGRGTPKIESRQSPPCGWKNPRVTLYTQHSARREKCSPCTRGYMSAAYIST

SEQ ID NO: 1017532 - protein, 122 aa, Homo sapiens
MDEKTKKAEEMALSLTRGKMAGRGMNKVGKCKVVPFWLGRDNCGAPEVCKIDSLMVSPSAREQFRFLMVAKIGDISSSIPAINITRTDMGRKTTPPDFFPKEHKLKKLYTASFRKFLVDQET

SEQ ID NO: 1017533 - protein, 159 aa, Homo sapiens
SRRECGCTHEHRKVLDTVANKHKDLKTHGFTLESCRSMIALMDTDVSGTVNRQEIEHLWDKINGWQNICRRYETGQCGSIDSYEMRNAVNDAVFHLNNQLYDIITMRHADKHMNIDFDSLICCLVRLEGMFRAFHAFDKDGDGIIKLNVLEWLQLTMYA

SEQ ID NO: 1017534 - protein, 220 aa, Homo sapiens
EDFDNRMVKHVIAEFNAMLIKDIYENPESLYEMLCRTCLLNDAYSVALCIRARPGPRNWEIRVAVSYERVHLNIRVTSMYLVPRFEHLNADLFRGTLDPVEKALRDAKLDKSQIHDIVLVGGSTRIPKIQKLLQDFFNGKELNKSINPDEAVAYGAAVQAAILSGDKSENVQGFAALVMSLLFPLVLKLLVELMTVLITSVIPPDSYLEPWTTRSFSYLF

SEQ ID NO: 1017535 - protein, 46 aa, Homo sapiens
ERSIVGRQLQHQIAPRITQSLSGGTEYRPEVDVGILWARVLTVTGY

SEQ ID NO: 1017536 - protein, 165 aa, Homo sapiens
MECHLKTHYKMEYKCRICQTVKANQLELETHTREHRLGNHYKCDQCGYLSKTANKLIEHVRVHTGERPFHCDQCSYSCKRKDNLNLHKKLKHAPRQTFSCEECLFKTTHPFVFSRHVKKHQSGDCPEEDKKGLCPAPKGTRPPRGPPSLVGREASPEISWSPPVS

SEQ ID NO: 1017537 - protein, 258 aa, Homo sapiens
NSEEKPEKGFECVFCNFVCKTKNMFERHLQIHLITRMFECDVCHKFMKTPEQLLEHKKCHTCPHPVGSTQDSGEFQTPLGAHSAFISTNRPAAMECHLKTHYKMEYKCRICQTVKANQLELETHTREHRLGNHYKCDQCGYLSKTANKLIEHVRVHTGERPFHCDQCSYSCKRKDNLNLHKKLKHAPRQTFSCEECLFKTTHPFVFSRHVKKHQSGDCPEEDKKGLCPAPKGTRPPRGPPSLVGREASPEISWSPPVS

SEQ ID NO: 1017538 - protein, 143 aa, Homo sapiens
MTTREVVKAKVSLRCLCLLPMAWPECCSWAPGDELLAQAGEHPLHPPCREELGWAFSIAILRNGVPIGGMRPWDEVLHLAGHDSILIFDCHEEVLEHHDAPGEAPGWAAGSKRHGQQPSQQHCFTLGLWTLQPCTSKSLLSQT

SEQ ID NO: 1017539 - protein, 143 aa, Homo sapiens; identical to SEQ ID NO: 1017538

SEQ ID NO: 1017540 - protein, 110 aa, Homo sapiens
YQVLRIAPLGNMTGLQPVWIIIIFNYRSLSALSAYHTGLIAPMKIRTEAPGNLRLYSGSPTRSEKEQVSISSFYYKERVSARAAAFDSYPFFLGFLFLIFLPGRRGLGFS

SEQ ID NO: 1017541 - protein, 155 aa, Homo sapiens
RQRFSYRLHSPTLSLPPYRRLRGLRGLRVVPDANIPFPRTSGARFCGASYLVYFTRPMTMHRAVSPTEPTPRSLSALSAYHTGLIAPMKIRTEAPGNLRLYSGSPTRSEKEQVSISSFYYKERVSARAAAFDSYPFFLGFLFLIFLPGRRGLGFS

SEQ ID NO: 1017542 - protein, 226 aa, Homo sapiens
DGSSVPRDSPHSLPTRRARGSSSPVRVPSRQRREQTPVDMAHVPGSNAYIDNLHGWTVDLSGPAIVGYKDSPSVWAAVPEENVRQHHASMRMEFLVGKDRIKIINDEWADTLEARNVTVIRRLTAAGWRNISMDLRTKSTGGDPQLQCHYVNKTDKTLDPCVMGNRRCPRRYDQQEMYEMDSQLRSSEYKWTHRYMIPKTPTSAGIPTKEIRNHIIYTIRKDKTYK

SEQ ID NO: 1017543 - protein, 139 aa, Homo sapiens
ALDQATMRGPELGPETSMEGDVLDTLEALGYKGPLLEEQALSKAAEGGLSSPEFSELCIWLGSQIKSLCNLEESITSAGRDDLESFQLEISGFLKEMACPYSVLVSGDIKERLTKKDDCLKLLLFLSTELQALQILQKK

SEQ ID NO: 1017544 - protein, 120 aa, Homo sapiens [sequence omitted]

SEQ ID NO: 1017545 - protein, 119 aa, Homo sapiens
MYSFPTTVVEEILSLSLQLIAFPTVSCEILLEITSQTNKKQTRETCYAHSAEEIGIIAGKRIHKTQAVPYICFLLRHQFISQSSHVRVEALYSLLFLGTLLQVGMRVLTSRCRLFRSEE

SEQ ID NO: 1017546 - protein, 399 aa, Homo sapiens
ERDRATPSVDTLLVTQRRRQSGEQVVKGTLHKRQRARGYPGAHPGQGTTSDSKIEPRPVRGVSTLGTSRHHINGALRNQAGLSKFGLRMLLKNEDFWWGERVTWRTSQVCATLLWLNKQFLEPLSRQAFQYNRWFLTCINQPQFRAVLGEVKLCEKMAQFDAKKFAETQPKKDTPRKEKGSREEKQKPQAERKEEKKAAAPAPEEEMDECEQALAAEPKAKDPFAHLPKSTYVLDEFKRKYSNEDTLSVAHAIFLGAHLIRTAWSPVVYSEVSASPERTHHQTFMSCNLITGMFQRLDKLRKTCLRQCHPFLEPTIAAPFLEYWVFRGQELALSAEIQIGKVELRSQYTMADNSRSLRSEDDHRSWLRRVLLRWEGAFQHVGKAFNTGQDLQVNNNLPI

SEQ ID NO: 1017547 - protein, 239 aa, Homo sapiens
MPWLPSRNGMVLNAPLPQWTWHAVLLWPLWFNHAWPCKILHDCNVPCNANGCAASAPAAPAVWCPILAHLCCCPTGSGTTLNGARLAAGFSLEELMGVPGIHNEGGPDHRHFCGSEECCEQVHWSPCRPTCSWLKDVPVQTHPLPQWSPRAPMKGDSSAEELKLAPSCPDLVMPVRNVYKKEKARVITEEEKNFKAFASLRMARANARLFGIRAKRATEAADQVVERKISLLGTLDQSA

SEQ ID NO: 1017548 - protein, 614 aa, Homo sapiens [sequence omitted]

SEQ ID NO: 1017549 - protein, 174 aa, Homo sapiens
TGSCTSALKTSQHCFLSHTRILKVGDFWLAREYGSPLEGLHPRSLVTLWFRAPELLLLFPKEYSTAVDMWSLGCIFGELLTQKLCSPGKSEIDQINKVFKDLGTPSEKIWPGYSELPAVKKMTFSEHPYNNLPKHFGALLSDQGFDLMKKFLTYFPRRRISTEDSLKHEYFPEY

SEQ ID NO: 1017550 - protein, 42 aa, Homo sapiens
MRNAGISSAPQWLDTRLAKTVTTILHSGIDMPRIIFSIIPSF

SEQ ID NO: 1017551 - protein, 58 aa, Homo sapiens
MRAVGSGLARLYAGALWVKSAGGTFTRGSNDNALILKASGEDIRISSSTLHGYEVPLV

SEQ ID NO: 1017552 - protein, 58 aa, Homo sapiens
MRAVGSGLARLYPGALWVKSAGGTFTRGSNDNALILKASGEDIRISSSTLHGYEVPLV

SEQ ID NO: 1017553 - protein, 135 aa, Homo sapiens [sequence omitted]

SEQ ID NO: 1017554 - protein, 145 aa, Homo sapiens
MVWATRQGQPRLRAHPTRKAQAQTQGSQRGRTAEQGLGKDPTLGYLGVKMCYFTHLTRSTRPRPCACPEGKLVEPCTDNSQSVGLGRTFPCEQQHQRLERRPSRSTVEGAELPWCAGSDSQKGDGGPQGRCSHGVIEVQGHLPPR

SEQ ID NO: 1017555 - protein, 177 aa, Homo sapiens
MCYFTHLTRSTRPRPCACPEGKLVEPCTDNSQSVGLGRTFPCEQQHQRLERRPSRSTVEGAELPWCAGSDSQKGDGGPQGRCSHGVIEVQGHLPPRSVCTVITCCHNTVTDLRVFSDSQLGLHRGLLWAHLRDHWAQLPRLRSIRTGLPTPAFPGLPHSFLAMSQSSVDDQWPGVAL

SEQ ID NO: 1017556 - protein, 224 aa, Homo sapiens
DLTEVHWGLAKSASFQAPERHSSFQGDPKFHLTSRPCESSLAPCFRQPRPRRLCSWSLPFLSLQAWQHFCGCKLLTPCWLYAAHQCRSLQTGGSAALSRRPHLSLSAAEMVSWIHRSHLMSSKPWCQPHPWPRLRAAWIEHFSDPQGLVPFCLYGACLTDCFPACILLISSKEKPGGTFHTAWKSQLDVQAHQLQVPLRTQQQSSSQPSSLLPPPVPSSTVISI

SEQ ID NO: 1017557 - protein, 69 aa, Homo sapiens
ILGHKSTDRVLGAHILGPGAGEMVNEAALALEYGASCEDIARVCHAHPTLSEAFREANLAAAFGKPINF

SEQ ID NO: 1017558 - protein, 246 aa, Homo sapiens
MNDWMPIAKEYDPLKAGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 1017559 - protein, 246 aa, Homo sapiens; identical to SEQ ID NO: 1017558

SEQ ID NO: 1017560 - protein, 279 aa, Homo sapiens
PCRLSRRSSRGSHRAPTDCPSGGNDSTTQSGHFPESTPSTYSSPTSTSWGSIDGTDEDPHDRAVWRAMLARYVPNKGVIGDPLLTLFVARLNLQTKEDKLKEVFSRYGDIRRLRLVRDLVTGFSKGYAFIEYKEERAVIKAYRDADGLVIDQHEIFVDYELERTLKGWIPRRLGGGLGGKKESGQLRFGGRDRPFRKPINLPVVKNDLYREGKRERRERSRSRERHWDSRTRDRDHDRGREKRWQEREPTRVWPDNDWERERDFRDDRIKGREKKERGK

SEQ ID NO: 1017561 - protein, 246 aa, Homo sapiens; identical to SEQ ID NO: 1017558

SEQ ID NO: 1017562 - protein, 246 aa, Homo sapiens; identical to SEQ ID NO: 1017558

SEQ ID NO: 1017563 - protein, 134 aa, Homo sapiens
KIKKSILENKRNSLDLIKSFHRSLAATARVPMVRSRTGCHSHSFCPAVWRSREQRKKTSQRYTVETKRQNKTHYSQVMSLCSGKLQTISKDNLKYFPGKNIGNIKRCQHVFGDQSQYTRCHCVSVISSHAKRKL

SEQ ID NO: 1017564 - protein, 405 aa, Homo sapiens
SAPLPFEMNVPGAPSRGFWSYSSVNAVMATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTDPSSCIMDKNAALQNGIFCN

SEQ ID NO: 1017565 - protein, 163 aa, Homo sapiens
WDKQPIERLLFRQFCDTNPTLKRHIEFLDAVAEYEVADDEDRSDCGLSILDRFFNDKLAAPLPEIPPDVVTECRLGLKEENPSKKVFEECTRVAHNYLRGEPFEEYQESSYFSQFLQWKWLERQPVTKNTFRHYRVLGKGGFGEVCACQVRATGKMYACKKLQ

SEQ ID NO: 1017566 - protein, 112 aa, Homo sapiens
RRKPQRKLQSTLLREIQQFGARKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 1017567 - protein, 102 aa, Homo sapiens
ARRPPFPLAADRVLPFQTGSPCCRRGDFPATATAAAATATTTGLICPDPFPPPAPSPTQDVRGFSKAAGKLQSSAPASCSCISGNGENEDLLQIEERFTTKL

SEQ ID NO: 1017568 - protein, 129 aa, Homo sapiens
MAEVEETLKRIQSHKGVIGTMVVNAEGKKTNTMSQSKNFRADSLWTRCSGECISYKNMLTYYSSSQLMASERFMHKNVHHHPISYKKYKVPNDQTIGDGLYVHKIVKYAVIKNNVDDIVNKDNLYVIIL

SEQ ID NO: 1017569 - protein, 122 aa, Homo sapiens
RELPGSSSLPCPGLTEDPGSRHFCSLSPGIPPLKVPTATQHGGLAQNQLTRVPIIQQAGGLEQKGCLPWGAELSWAGPAPSAVSATEATQPASCHSHLKNAQRPRRHNSYAPPQGNKGSFTP

SEQ ID NO: 1017570 - protein, 143 aa, Homo sapiens
LLLPDRGVGRRQTMWTLVSWVALTAGLVAWNAVPDGQFCPVCMPGPRRASYSCCRPHGQMAHNTGAGIWVAPCQVDAHCIMATPCIFTLRDFPVACPFPRGRLPGMITCCPRVHLQCRGRSCFQRSGNNSVGAIQCPDSQFEC

SEQ ID NO: 1017571 - protein, 147 aa, Homo sapiens
LFSCAGAAGQYSTMAPSGDSVLKPHFHKDWQRRSATWFNQPARKIRRRKARQAKARRIAPRPAPVPIRPIVRCPTVRYHTKVRAGRALKPGKELRVAGIHKKGGPGPSEFLLDSEEGGTSSTESLQANVAAAVKEYRSKLILFPQEA

SEQ ID NO: 1017572 - protein, 269 aa, Homo sapiens
NSRPRRREKTTEGGLTENHPGNPITAGHHEPHCANLLSCQQRPASQLRDAQGGAGSGYAGGAHNPAPPMSTVIHIRSETSVPDHVVWSLFNTLFIEQPAALGFIAFAYSVKSRDKEDGWRREPGPKAYAFTAKVAEPSGPWILGIFIDQFCSSSSQCGRPGPAIGSGGIIGGQDALPVTVSTYFYLTIPLPAPKRQGALPLTLLSSTPPSITRPVPTASPASALILTRFLQMAQYVFMSAKQHTRQHNKLARPQTFHHTVAGQMLRRQR

SEQ ID NO: 1017573 - protein, 192 aa, Homo sapiens
IRLTARCGPALEDCDCAQDENCKSTKRAIEPCLPRTSGGGAGGPGAGGVMGCTEARRRCDRDSRCNLALSRYLTYCGKVFNGLRCTDECRTVIEDMLAMPKAALLNDCVCDGLERPICESVKENMARLCFGAELGNGPGSSGSDGGLDDYYDEDYDDEQRTGGAGGEQPLDDDDGVPHPPRPGSGAAASGGR

SEQ ID NO: 1017574 - protein, 174 aa, Homo sapiens
RKGLVSGGLYESHVGCRPYSIPPCEHHVNGSRPPCTGEGDTPKCSKICEPGYSPTYKQDKHYGYNSYSVSNSEKDIMAEIYKNGPVEGAFSVYSGLPALQVRSVPTRHRRDDGWPCHPHPGLGMWRMAHPTGWLPTPGTLTGVTMASLKYSVGSGSSVESDADSGGWNVTQPTQ

SEQ ID NO: 1017575 - protein, 204 aa, Homo sapiens
MKQRKQQATAIMKEVHGNDVDGMDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKPEGKAELPDYRSFNRVIQWSWVTLVACNTKIFSSMVQDN

SEQ ID NO: 1017576 - protein, 197 aa, Homo sapiens
MKQRKQQATAIMKEVHGNDVDGMDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKPEGKAELPDYRSFNRVATPFGGFEKASRMVKC

SEQ ID NO: 1017577 - protein, 175 aa, Homo sapiens
MDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKPEGKAELPDYRSFNRVATPFGGFEKASRMVKC

SEQ ID NO: 1017578 - protein, 186 aa, Homo sapiens
MKQRKQQATAIMKEVHGNDVDGMDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKPEGKAELPDYRSFNRVHTIGG

SEQ ID NO: 1017579 - protein, 102 aa, Homo sapiens
GSVSPPGYRQPPFSPAQPDPRSPPNPDNIAPGYSGPLKEIPPEKFNTTAVPKYYQSPWEQAISNDPELLEALYPKLFKPEGKAELPDYRSFNRVQDFIGGSK

SEQ ID NO: 1017580 - protein, 197 aa, Homo sapiens; identical to SEQ ID NO: 1017576

SEQ ID NO: 1017581 - protein, 216 aa, Homo sapiens
ALATLIHQVLEAPGVYVFGELLDMPNVRELAESDFASTFRLLTVFAYGTYADYLAEARNLPPLTEAQKNKLRHLSVVTLAAKVKCIPYAVLLGGIYALRNVRQLEDLVIEAVYADVLRGSLDQSQTKQASRFDYSIRADIQRQDLSAIARTLQEWCVGCEVVLSGIEEQVDRDQTQHKEQQLGLKQPDWRVRLPTLRKRPINSYDGSSSRSHISGP

SEQ ID NO: 1017582 - protein, 250 aa, Homo sapiens
MAVEGGMKCVKFLLYVLLLAFCACAVGLIAVGVGAQLVLSQTIIQAATPGSLLPVVIIAVGVFLFLVAFVGCCGGLARRTMCLMITFAIFLSLIMLVEVAAAMCWLCVRDKVMSEFNNNFRQQMENYPKKNHSASILDRMQADFKCCGAVTTQIGKKIPSMSKKPSPRLLLALNVTGGAVGFNFNEKAIHKEGLCGRRIGGWLRENVLVVSCSSPGIAFGEVLGMALAAASEEFQKWARGDVGVRSASAS

SEQ ID NO: 1017583 - protein, 251 aa, Homo sapiens
MAVEGGMKCVKFLLYVLLLAFCACAVGLIAVGVGAQLVLSQTIIQAATPGSLLPVVIIAVGVFLFLVAFVGCCGGLARRTMCLMITFAIFLSLIMLVEVAAAMCWLCVRDKVMSEFNNNFRQQMENYPKKNHSASILDRMQADFKCCGAVTTQIGKKIPSMSKNPSPRLLLALNVTGGAVGFNFNEKAIHKEGLWWQKNWGLAEGKCAGGKLQQALELLLARFWELALAAASEEFQKWARGDVGVRSASAS

SEQ ID NO: 1017584 - protein, 458 aa, Homo sapiens
SRAESHCPGASPARPRPTVCARKPLPVPCCSLLLLSCLLPPGGWPWPAEVKKPAAAAAPGTAEKLSPNGWPLLCLMLQLPGLAFSLYQAMANGPGSGEHPGVTLWCVASSAGARVAGLARRPRLSQAKAVAESCLMHAAADRCDVLHCLCLVAKLLAAHSATPLVLQTVTWKLVQPDLYGPSSVSFADDFVRSSKQHYNCEHSKINFRDKRSALQSINEWAAQTTDGKLAEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEIAANQQSQLNASGWGRCMKKAVAISLPKGVVEVTHDLQKTLAGLGLTEAIDKNKADLSRIVMSLKDLYLASVFHATAFEFGLQMATPLTRTIYGREELRSPKLFYAEHPFIFLVLGTPKAAPLLFIGAPGPA

SEQ ID NO: 1017585 - protein, 207 aa, Homo sapiens
MGVLPKDNKTFQKGGNRKKRPQVANSARSPVGQQHVGYVCVWNPGDSLRTCQPVAHQIHCLGPQGQTRGKGRRLLIKAYPDIRGCSGSHQPIQYIGVIGLENKVFETSRKETSHSEQSSQGPPGHHKRPVAVVGARGLGVPFPKMLSGPVPRATMKEGMKGDHREVKMDAYRRAKHERQTGHKMGTNAHPVPWQTVGNRKLVEQNTR

SEQ ID NO: 1017586 - protein, 129 aa, Homo sapiens
ELPEGLRRAMKDCAQMQVLWPRSRTQSSCSPAKDREPGPEAGAAADGEYLGPGQEGEESSRNQLHMVEGTWEVKEPVLSAAQATPWNRCQVGKRVLGQLVPWPEQGPCSHTELFDLELIPDSQPLPHHL

SEQ ID NO: 1017587 - protein, 129 aa, Homo sapiens; identical to SEQ ID NO: 1017586

SEQ ID NO: 1017588 - protein, 122 aa, Homo sapiens
GARYRFGAAHGPVRARESPSGVGQVLRLCEERQLHLPSSSWLQHPDNNELDASDRFAKVRPLIIRMNCNFQKHAPLEEFYSFGESMCEYFGHRGSKQLHRGKPVDGYKISVWDNQQRLLGVV

SEQ ID NO: 1017589 - protein, 175 aa, Homo sapiens
MPFLELDTNLPANRVPAGLEKRLCAAAASILGKPADRVNVTVRPGLALAHERVHRALRRSCPISSIGVVWNRRRKTEAQRPLSCEFLTQGSSALAKDRNTYPVFPLGSPWQIGKIGTVNDFFNDVGTGGIQAICELACFFQRDLFARVRPGDNQLWIIPDATFLVITLILFFILI

SEQ ID NO: 1017590 - protein, 269 aa, Homo sapiens
MGRRSSDTEEESRSKRKKKHRRRSSSSSSSDSRTYSRKKGGRKSRSKSRSWSRDLQPRSHSYDRRRRHRSSSSSSYGSRRKRSRSRSRGRGKSYRVQRSRSKSRTRRSRSRPRLRSHSRSSERSSHRRTRSRSRDRERRKGRRITRTRDQEKDTGKDRELHNIKRGESGKHQSWIRTFLPPVEQAKARLQLVLEAAAKADEALKAKKEMEEEGKEHRNGGRTRPPGCTRFTEFTQLELERESLVRDIRFSRSPSRDFAVTRTSLGASCV

SEQ ID NO: 1017591 - protein, 269 aa, Homo sapiens; identical to SEQ ID NO: 1017590

SEQ ID NO: 1017592 - protein, 269 aa, Homo sapiens; identical to SEQ ID NO: 1017590

SEQ ID NO: 1017593 - protein, 62 aa, Homo sapiens
PDGRSSSPAMAESDDTVTVLRKKGPTAQGKSKQAILAAQRRGEDVETSKKWAAGQNKQHFYY

SEQ ID NO: 1017594 - protein, 276 aa, Homo sapiens
WAPGEWTVRALPLGPGPWLRPRDGSCSPRAEPVSILDAPWSLKSEKSPYPPTPPCAHFGVDHGVLQVHDGSICPSRTPVSERSKNDDPESRVTEERSQGVTEHSSVRIPSWDPHIRRSGPASTSCHTTDTSVEMARERSKNVTSFIQPVRRIDAADGEVPQSWLTPTMMALRWPLSGRQGTVLRKCWYLRDDTSSEDCSRIKGFRVPFLSIIWLGTHHTARALSYNIELTNADRLLEIKDSDEAQYAVVHSADNKEWTPGKPGTGNSKTRKKKRDD

SEQ ID NO: 1017595 - protein, 77 aa, Homo sapiens
KFMHPVTKASAVIYTTDLHLEKAVWRLHHCTHLVPEQLHSCPQPMPSSPVVVKVFPPMKVIPLKFGRGDCTQKMRKH

SEQ ID NO: 1017596 - protein, 103 aa, Homo sapiens
ANTKVNWPMFPESFGNWGQDNELLEPLSGVLPANRNVPFKLKLHGIAKVLVKGQDTWPLTLNHEGYWEGSCSTAGCQEVYVMVLENANHNFYSYILKYKVNAQ

SEQ ID NO: 1017597 - protein, 82 aa, Homo sapiens
MGSRTLLLLAALLLLLSGDGAVRWDTPATCTYLDLLGTWVFQVGSSGSQRDVPCSVMGPPEKNVVVYLQKLVPMMTLAFLAF

SEQ ID NO: 1017598 - protein, 243 aa, Homo sapiens
AVGRAEAPEFPLPRSPFHPRSPTHARRPPASPPLSRRARCPAPRDRLPWAGWLLGPWKRELFTYGGVVAPSPRTESARPLARPARGSRRRFPRSISRRCGSRCRSPGRSDQTPAAAQSRGDSYLFDDPASQHAYAGRKPGSREKTGRPARMLARFRMKELDQQQKEVEERPEKDFTEKGSRNMPGLSAATLASLGGTSSRRGSGDTVHLHLSTEASIREIKDSLAEVEEKYKKAMVSNASVRQ

SEQ ID NO: 1017599 - protein, 117 aa, Homo sapiens
QARQEPTGNAHHGGSLLHMFFVYPINLVHFRYFDIILASLIPRVETVSGAVVYAVGLQLFASSPTVFVWCQHEAELCAPYRVALDSEMSALTQRGAQLNVFTLWVTCFRTFGFAGHV

SEQ ID NO: 1017600 - protein, 1698 aa, Homo sapiens
GSGTAVAEMEAEVWEAEGYNLVLDSDLYDADGYDVPDPGLLTEKNELTFTEPSQVLPFLTSSQQWQSLTPRARARRLWLLLRTSLHEVVEKEKRAELRAARLTHGLEPLRRLEVAAGLRSVAQDPVGGRFVVLDGAGRLHLHKEDGWAQETLLAPVGLTGLVTVLGPLGAVGRFVGWGPAGLAILRPNLSLLWLSEQGVGRAPGWAPTCCLPVPDLRLLLVAEMNSSLALWQFRSGGRRLVLRGSALHPPPSPTGRLMRLAVAPVPPHHVLRCFAAYGSAVLTFDLHAWTLVDVRRDLHKTTISDLAYCEEVEAMVTASRDSTVKVWEADWQIRMVFVGHTGPVTAMTVLPNTTLVLSASQDGTLRTWDLQAAAQVGEVALGFWGQDKLSRRVGRLLAPVRPGWPVLSLCASSMQLWRVRELYSPLAQLPAKVLHVQLAPALPAPAHQSLPTRLVCACADGSVYLLSAATGRIVSSLLLEPEDCAAAVAYCLPREALWLLTRAGHLVRANAARCPMSVLHRVCPPPPPAPQPCCLHLYSHLTDLGGAFSSWEIVRQHWGELRCSSVACAWKNKNRYLPVVGHTDGTLSVLEWLSSKTVFQTEAHSPGPVVAIASTWNSIVSSGGDLTVKMWRVFPYAEESLSLLRTFSCCYPAVALCALGRRVTAGFEDPDSATYGLVQFGLGDSPRLDHRPQDDPTDHITGLCCCPTLKLYACSSLDCTVRIWTAENRLLRLLQLNGAPQALAFCSNSGDLVLALGSRLCLVSHRLYLPTSYLVKKMCRKAPDVVDDPPLPLMSQESLTSAQLQRLTNLHGAASLRSHGGLLSPPGGPPFLTLGGGLAVWGPLELIQACLSPGTPVWGWSLSQPLPQPTGMPPSIPPVPVPVCSEALSLIHRRRATSQHLVPKEDLDAIVARDRDLQQLRLGLVVPAAQPPPSWQQRQEGFDNYLRLIYGSGLLGMQSGRGSQQWSAGTLRVERETRDVCAVPQAAHCLARAEVSTAAQTVPTALSPQDLGALGQHFSQSPRVTVPIPPTHRRVHSKASQLLARSSLSHYLGISLDLQLQLEQLRGRTTMALDLPSSHLQCRIPLLPKRWDKEPLSSLRGFFPATVQPHKHCLRPICFPGYVPNSAVLQQMWLNAEPGASQDALWLWRPRPSQAQWQRKLLQWMGEKPGEEGEEDKKEEEEEKEDEELDWALASLSPHSNQQLDSWELEDQSAVDWTQEPRRRSCKVARTHPHPWHRHGSLLLDEHYGHLPKFLHFFIYQTWFKKLFPIFSLQAYPEAGTIEGLASLLVALLEKTTWVDRVHILQVLLRLLPNMSSDLQGQLQGLLVHLLNLDQPPSLQDQTQKKFVILALQLLLACSLESRDVVLELMSYFLYSPVHCRPELKKLLHGLGLQDPEGFLFKEMMTWVQGPDLDSKAGLRTCCHQKLEDMIQELQETPPQTSVVSGAPTRASVIPSGTSWSASGIFGRLSQVSEVPLMVVSPAEPHSLAPELQAQRMLAPTRSWGTPQLRLRVLSETLKSFCLEPEARLHPAGPAQLPGEPPPLEETDWSHSQLLDLGPIDALNFFCEQLRAQQRSSLQEKAAHPHPPVPYTVAPVPDMVVPPPREHWYHPILRLQEAKPQRSARSAMRLRGPMPSRLCAGRTLDGPIRTLKLPLPRVEPQPFPLDWPMPPRPLPPRLLQPALQRYFLPADADPDTYS

SEQ ID NO: 1017601 - protein, 2086 aa, Homo sapiens
GSGTAVAEMEAEVWEAEGYNLVLDSDLYDADGYDVPDPGLLTEKNELTFTEPSQVLPFLTSSQQWQSLTPRARARRLWLLLRTSLHEVVEKEKRAELRAARLTHGLEPLRRLEVAAGLRSVAQDPVGGRFVVLDGAGRLHLHKEDGWAQETLLAPVGLTGLVTVLGPLGAVGRFVGWGPAGLAILRPNLSLLWLSEQGVGRAPGWAPTCCLPVPDLRLLLVAEMNSSLALWQFRSGGRRLVLRGSALHPPPSPTGRLMRLAVAPVPPHHVLRCFAAYGSAVLTFDLHAWTLVDVRRDLHKTTISDLAYCEEVEAMVTASRDSTVKVWEADWQIRMVFVGHTGPVTAMTVLPNTTLVLSASQDGTLRTWDLQAAAQVGEVALGFWGQDKLSRRVGRLLAPVRPGWPVLSLCASSMQLWRVRELYSPLAQLPAKVLHVQLAPALPAPAHQSLPTRLVCACADGSVYLLSAATGRIVSSLLLEPEDCAAAVAYCLPREALWLLTRAGHLVRANAARCPMSVLHRVCPPPPPAPQPCCLHLYSHLTDLGGAFSSWEIVRQHWGELRCSSVACAWKNKNRYLPVVGHTDGTLSVLEWLSSKTVFQTEAHSPGPVVAIASTWNSIVSSGGDLTVKMWRVFPYAEESLSLLRTFSCCYPAVALCALGRRVTAGFEDPDSATYGLVQFGLGDSPRLDHRPQDDPTDHITGLCCCPTLKLYACSSLDCTVRIWTAENRLLRLLQLNGAPQALAFCSNSGDLVLALGSRLCLVSHRLYLPTSYLVKKMCRKAPDVVDDPPLPLMSQESLTSAQLQRLTNLHGAASLRSHGGLLSPPGGPPFLTLGGGLAVWGPLELIQACLSPGTPVWGWSLSQPLPQPTGMPPSIPPVPVPVCSEALSLIHRRRATSQHLVPKEDLDAIVARDRDLQQLRLGLVVPAAQPPPSWQQRQEGFDNYLRLIYGSGLLGMQSGRGSQQWSAGTLRVERETRDVCAVPQAAHCLARAEVSTAAQTVPTALSPQDLGALGQHFSQSPRVTVPIPPTHRRVHSKASQLLARSSLSHYLGISLDLQLQLEQLRGRTTMALDLPSSHLQCRIPLLPKRWDKEPLSSLRGFFPATVQPHKVRPPPSSWRATPLQASLLCLPSPLCYKSLCPNLTQGPCPPTTRGPGCSLPRTPHPSPFTLCLALFQYSCVCGHRLLAALGADIRQSQSPQPVMPHTPFPRGGAGRAGPLGTFPGRSESLPFRGAKSREPGPLESTVFPPSRTPGAQAGLSPSPSIFLALSPAHVGIDSLGLGATIMLFIALSPSSFLSSLAPVLLLDFLVPGLGPSPVRSLQGVRAPTSQHFSRFPFSFVRADAQLRASPLVSQGSPAICVESRGCQLSQLSEAWQAELDWRLRGSEEVIQVTKGGVQAGGIQVLSIPCCAHLQHCLRPICFPGYVPNSAVLQQMWLNAEVSSLGSPTQLASQRKLEARGRAGGFAGGEGSAVLATHQAPSLAPLQPGASQDALWLWRPRPSQAQWQRKLLQWMGEKPGEEGEEDKKEEEEEKEDEELDWALASLSPHSNQQLDSWELEDQSAVDWTQEPRRRSCKVARTHPHPWHRHGSLLLDEHYGHLPKFLHFFIYQTWFKKLFPIFSLQVGGNWGCMRSMGWVRDRGEGRGWLGCDMGAGPQHATLQAYPEAGTIEGLASLLVALLEKTTWVDRVHILQVLLRLLPNMSSDLQGQLQGLLVHLLNLDQPPSLQDQTQKKFVILALQLLLACSLESRDVVLELMSYFLYSPVHCRPELKKLLHGLGLQDPEGFLFKEMMTWVQGPDLDSKAGLRTCCHQKLEDMIQELQETPPQTSVVSGAPTRASVIPSGTSWSASGIFGRLSQVSEVPLMVVSPAEPHSLAPELQAQRMLAPTRSWGTPQLRLRVLSETLKSFCLEPEARLHPAGPAQLPGEPPPLEETDWSHSQLLDLGPIDALNFFCEQLRAQQRSSLQEKAAHPHPPVPYTVAPVPDMVVPPPREHWYHPILRLQEAKPQRSARSAMRLRGPMPSRLCAGRTLDGPIRTLKLPLPRVEPQPFPLDWPMPPRPLPPRLLQPALQRYFLPADADPDTYS

SEQ ID NO: 1017602 - protein, 95 aa, Homo sapiens
RKSSMCRFYEMKPDRDVNLTHQLNPKVKSFSQFISENQGAFKGMKKISCSDRPLHHTASFLSDPFPLYGTTFMLTEHAGMQLFATPKNFLRSPLQ

SEQ ID NO: 1017603 - protein, 168 aa, Homo sapiens
MAEPSIAWSHRCRPRGRLCLLTIVWPDSPHPEDRRGKDTTSSSSADSTIMDIQSRHEPQMQSTQNSSPPLQTQPGLLMKHHNPRPRTQQLEREPDWALLVDRIPRDNTKSTKSKFIPLMAPEVSERPIPSTRRQTRTPDLSIWFSMRMAFFFGGTPSGRGVASGCIKV

SEQ ID NO: 1017604 - protein, 271 aa, Homo sapiens
PRVAHASVVIKFVDALQERGFRDPCHRFFDKVFTSVKLMSILRKKGVKATGTVREYRTERCPLKDPKELKKMKRGSFDYKVDESEEIIVCRWHDSSVVNICSNAVGIEPVRLTSRHSGAAKTRTQVHQPSLVKLYQEKVGGVGRMDQNIAKYKVKIRGMKWYSSFIGYVIDAALNNAWQLHRICCQDAQVDLLAFRRYIACVYLESNADTTSQGRRSRRLETESRFDMIGHWIIHQDKRTRCALCHSQTNTRCEKCQKGVHAKCFREYHIR

SEQ ID NO: 1017605 - protein, 258 aa, Homo sapiens
MRETLRDFFFFFEFAFLCLHFFIEFFSFFEPFLLFLLAWLLFLLPPPPTVFPLLFTYLLLSFPNRIMFEGPGLLEAASFFFGFCFACGFLAGSGASMGSWKFLRDLPRVPGPPTLHLLPHRPHLHVPAGPQILASFPPPGVCMVGSPGWRGLFDAGLLLRAGGGAGLFPQGARAVPSWWVMAAFKRVVSTVLRSRQGCRFSTSPSAPGPLPVPALHPLCLGHGVSALPAFLPSPLFFPAPCTFGVLPPGCELLGAGPQ

SEQ ID NO: 1017606 - protein, 276 aa, Homo sapiens
APARCCPAAPLCQALDMYRGFSVVVGPISPPSSCMTPTHLKGVLVVRVCVSLLSPPGCSFSCPLPPLCSRLLFTYLLLSFPNRIMFEGPGLLEAASFFFGFCFACGFLAGSGASMGSWKFLRDLPRVPGPPTLHLLPHRPHLHVPAGPQIPASFPPPGVCMVGSPGWRGLFDAGLLLRAGGGAGLFPQGARAVPSWWVMAAFKRVVSTVLRSRQGCRFSTSPSAPGPLPVPALHPLCLGHGVSALPAFLPSPLFFPAPCTFGVLPPGCELLGAGPQ

SEQ ID NO: 1017607 - protein, 142 aa, Homo sapiens
PRAPEPPRHEARRPPGDLRGPVLQLRAFLSGLGKPVSLSLRWSRRRRRRDPGNPLGTLNPLKLLLSSLGIPVNHLIEGSQKCVAELGPQGRGGRRSLETALAGGLDSVWLSRRLEASTPGGQDAAHPRGLENPAAGKDRPSP

SEQ ID NO: 1017608 - protein, 259 aa, Homo sapiens
SPHDNKSWEMFEEMITTAEEFYQSLGIPYHIVNIVSGSLNHAASKKLDLEAWFPGSGAFRELVSCSNCTDYQARRLRIRYGQTKKMMDKVEFVHMLNAYHVRHYPYHLQPSWRYYQTEKGITVPEKLKEFMPARPDKNLIPFVKPAPIEPVSQSKKAEESNMRAAKKKAASKRRSPLEKQAGRNNGRIHTTAFETFHWTPLFGQAFISVLREMIRALPKQQGKPKHPFIPLPPIWAGVGEEGKKCPCTTTDVPVYSAWA

SEQ ID NO: 1017609 - protein, 179 aa, Homo sapiens
MAVQFDGGVVLGADSRTTTGSYIANRVTDKLTPIHDRIFCCRSGSAADTQAVADAVTYQLGFHSIELNEPPLVNTAASLFKEMCYRYREDLMAGIIISELVTLKKEGQVYSSGLMGGMMVRQFFAIGGSGSSYIYGYVDATYREGMTKEECLQFTANALALAMERDGSSGGVIRLAIAE

SEQ ID NO: 1017610 - protein, 226 aa, Homo sapiens
ASDPGGLEPAGRVVASERLVVDCGSGEVGAEIIVCRFSCAGVGNPPGQWNCGRSSSFRVQPAWARGAGPDDTLRSPFLPGYVDCGAGLLWPQRRAEVECVPAEVASQCRERGGGRAMSRVLQESDAPKLYTQGWPLGWVKIPCLYPRFHTLVWVTGCRMNCRSRGAGGSGCEGAGMCEEAMLAVLHTVLLQPDTGKFHYKEVRATYSIGTVGQPRIVDCDFIDSLM

SEQ ID NO: 1017611 - protein, 238 aa, Homo sapiens
NFGHKENLITFPRIQPISKDDFRRYRGAIARKRIRLGRKYVISHKEEVPLCIHWDISKQIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSYFNHMSASILPYFAGNLGGWSKSIEETAASCIQFLENPPDDGFVSTF

SEQ ID NO: 1017612 - protein, 276 aa, Homo sapiens
NFGHKENLITFPRIQPISKDDFRRYRGAIARKRIRLGRKYVISHKEEVPLCIHWDISKQASLSDSNVEALKKLAAKRGWEVTSTVEKIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSLMKHLQINWLCQIAKNLLIYPDVLINCNLVICVHTMGILRSSFRIIYSRRSPRRLGS

SEQ ID NO: 1017613 - protein, 266 aa, Homo sapiens
NFGHKENLITFPRIQPISKDDFRRYRGAIARKRIRLGRKYVISHKEEVPLCIHWDISKQASLSDSNVEALKKLAAKRGWEVTSTVEKIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSYFNHMSASILPYFAGNLGGWSKSIEETAASCIQFLENPPDDGFVSTF

SEQ ID NO: 1017614 - protein, 119 aa, Homo sapiens
LLTHNLLSSHVRGVGYRGYPLRLQATKVRICPVEFNPNFVARMIPKVEWPVFLEAADNLRLIQVPKGPVEGYEENEEFLRTMHHLLLEVEDIKGTLQVPGILDEYVPIKPRESQTMLLK

SEQ ID NO: 1017615 - protein, 119 aa, Homo sapiens
LLTHNLLSSHVRGVGYRGYPLRLQATKVRICPVEFNPNFVARMIPKVEWPVFLEAADNLRLIQVPKGPVEGYEENEEFLRTMHHLLLEVEDIKGTLQRPEYGPMLPIRPGILNMLVSEE

SEQ ID NO: 1017616 - protein, 321 aa, Homo sapiens
MLVLSPLDPLKLQGTIPFSLGESFGSRWDTECCRGGTGQGRGGSEHKHRLRHSSKHHVHYFEDTGATEPGVEVGVARSIRPSESMMRRVRNSQEPKPSHLTCSLGGRWMRSTEARSRLHAALRPAVPLSSSDLFGDMDGAHRRQEVYLWGTCCLQRTLPSLSRVVKSGAGKMAVLANGVMNSLLRIAYRVPTDPSSVTHALLLGDGNRERPHGSQSLGTAIALWKLGRICYFGSVWCVCGVAFEALTRCDGVMVTYQALVLCLWLSPFIARLDIHTLSVIVEDFLGPSVHAPHSVLLTYRCHTGKGGSPTMCLFWVQTFPR

SEQ ID NO: 1017617 - protein, 119 aa, Homo sapiens
IGTPKTLPDVSSPAWAKSSLAPRLGPACGQGQVFPPPGKPLPSSCPVVRRPPAVTLRVASGAKSDPPDTITRRPSSTCTHPHLPQQPLPAALAKISARPGPVAHTCNPSTLGGQGRHIT

SEQ ID NO: 1017618 - protein, 119 aa, Homo sapiens; identical to SEQ ID NO: 1017617

SEQ ID NO: 1017619 - protein, 73 aa, Homo sapiens
AEDGGGWGWPSEAGGIGSAAAEPPACPPGELSAPARLYHKKVVDHYENPRNVGSLDKTSKNVGTGLLGAPCMW

SEQ ID NO: 1017620 - protein, 146 aa, Homo sapiens
GGSAVRRSFAERLCLAAVMKRHSRLQEAGSSLYRDLLRAGRGKPGQRRECWAEFRQHAGLPRSDVLRIEYLYRRGRRQLQLLRSGHATAMGAFVRPRAPTGEPGGVGSQPDDGDSPGKPPGQHGGHRRPGPKDGDRRKKRIRSMAC

SEQ ID NO: 1017621 - protein, 199 aa, Homo sapiens
MLAYSSVHCFREDKMKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 1017622 - protein, 112 aa, Homo sapiens
DEAGAEVRCGGHPSVELPGYAPSDPDLNASYPYCCLAALRDAAALGDPSGLLIPRAGPPSRGPRLRSTHPAPLRTPAAREDGQRGGVQARPQGRRLFHVALQPPAWPPLRAP

SEQ ID NO: 1017623 - protein, 116 aa, Homo sapiens
MAEGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTEVKWDRDM

SEQ ID NO: 1017624 - protein, 116 aa, Homo sapiens
MAEGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKMSMPAE

SEQ ID NO: 1017625 - protein, 140 aa, Homo sapiens
MAEGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTDRQMTYCLARVATNVNFCSQGPKHSQRGDRRT

SEQ ID NO: 1017626 - protein, 202 aa, Homo sapiens
MAEGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTDTDNLHCSWELVFLFETGLVPSAWGSSRGPAGWPRPCGVFAAAGEWPCVRRLRRTEVRSRCPGLLYRARSPAHGFCCLACFGLSRTVFVRHCCP

SEQ ID NO: 1017627 - protein, 111 aa, Homo sapiens
MAEGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKR

SEQ ID NO: 1017628 - protein, 149 aa, Homo sapiens
MAVGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTECSTRDRKTSLNAPLKKDEYACRVNHVTLSQPKIVKWDRDM

SEQ ID NO: 1017629 - protein, 111 aa, Homo sapiens; identical to SEQ ID NO: 1017627

SEQ ID NO: 1017630 - protein, 177 aa, Homo sapiens
MAEGGIPEADSIRAEMSRSVALAVLALLSLSGLEAIQRTPKIQVYSRHPAENGKSNFLNCYVSGFHPSDIEVDLLKNGERIEKVEHSDLSFSKDWSFYLLYYTEFTPTDTHRHARRVHHGASHPPPPRLASSPRPPPPSSPRGPPPHPNLRRPPPAPLPPPPPPPSDLPPGQPNLPP

SEQ ID NO: 1017631 - protein, 786 aa, Homo sapiens
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSSLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCIYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 1017632 - protein, 786 aa, Homo sapiens
MTSIFHFAIIFMLILQIRIQLSEESEFLVDRSKNGLIHVPKDLSQKTTILNISQNYISELWTSDILSLSKLRILIISHNTIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 1017633 - protein, 195 aa, Homo sapiens
MAQVLRGTVTDFPGFDERADAETLRKAMKGLGTDEESILTLLTSRSNAQRQEISAAFKTLFGRDLLDDLKSELTGKFEKLIVALMKPSRLYDAYELKHALKGAGTNEKVLTEIIASRTPEELRAINTVYEEDYGSSLEDDVVGDTSGYYQPHVGGFSFRLTENLMLEMNEAQVEQYDQALFQAGVIKWGTDEEKS

SEQ ID NO: 1017634 - protein, 151 aa, Homo sapiens
TDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIDEGD

SEQ ID NO: 1017635 - protein, 165 aa, Homo sapiens
IEGKSWSGEFFTCNWKMKYVTFEDEEQANLIYGNSRFTDLHSIIRNIQSCKEVKGRTAFNGVSFNLLQFVQLLETFVGEDAPLSVSETLTSFFKEGYVETEQEKMNALEQFSQNAFQVRQRLLLEAIFQKWDSDGSGFLDLKEVDELLYTYKEGMEKESMKKGKI

SEQ ID NO: 1017636 - protein, 43 aa, Homo sapiens
MARFPGAWFGSFKLGFEGPRLFHHTGPIEEACSGLLDPLVEGL

SEQ ID NO: 1017637 - protein, 281 aa, Homo sapiens
AACVLRPPLFRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASRLSTAANTGQIDDPQEQHRVISSNLALIQVQATRSVGASLACLGGLRPAVGRGCLRRRDRGLVRPRGGSLASCCQPCCSLNVALPYGKPLCPLGVAEWACIRAIGARKPRGSTQKPLPRPIGRPPGTPSFPL

SEQ ID NO: 1017638 - protein, 248 aa, Homo sapiens
AACVLRPPLFRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQANTGQIDDPQEQHRVISSNLALIQVQATVVGLLAAVAALLLGVVSREEVDVATGGTLLCASSVLTAFLAAFALGVLMVWYSDWCFKSSGFNQYNMATPIASLGDLITLSILVSSFFYHKDSRYLTPLVCL

SEQ ID NO: 1017639 - protein, 284 aa, Homo sapiens
AACVLRPPLFRRRLGGDPGCQAPSCAQMDGTETRQRRLDSCGKPGELGLPHPLSTGGLPVASEDGALRAPESQSVTPKPLETEPSRETAWSIGLQVTVPFMFAGLGLSWAGMLLDYFQHWPVFVEVKDLLTLVPPLVGLKGNLEMTLASRLSTAANTGQIDDPQEQHRVISSNLALIQVQATVVGLLAAVAALLLGVVSREDVDVATGGTLLCASSVLTAFLAAFALGVLMVWYSDWCFKSSGFNQYNMATPIASLGDLITLSILVSSFFYHKDSRYLTPLVCL

SEQ ID NO: 1017640 - protein, 141 aa, Homo sapiens
MYNVSPAKGGAKCCVSSCFFPFPGTLCPSVRGTRACCCQEWGHRVDANAPGACLVCVASQMVEGAGSWQGPSRQSQPLPAAPNRLSNKTGEGVGEPASQRAVPAGNPCDIRTSSSVTCVCVCAQVSEEDSGRPNPFDLEYS

SEQ ID NO: 1017641 - protein, 235 aa, Homo sapiens
MLEPWSSFSVTSVPALLDSVAVYVIWPPSLTALGAVSVTVVVLSVPGVSVTVVFTAVVPGTRFSKCSPPVTPLIAVVTVWSPLYTSSGAITETLTARLVYADGDGFAVIEGDGQRVGDVGHRRAVLIHKAGGVNDVAAFTHGSGGGQNYIHLVDGVVDRGGCAVACHFQFFEVAAEASVILTVCVLLSMNTSSVGAGTVTVPTVSPALIVIDEPLSNFNVTSFPALLVMARKRST

SEQ ID NO: 1017642 - protein, 106 aa, Homo sapiens
MAETEALSKLREDFRMNKSVFILGATEETGRVLLKEILEQGLFSKVTLMGRRKLTFDEEAYKNVKSQKWWTLKKVDDYASAFQGHDVDSCCLGTTRGKAGAEGLSV

SEQ ID NO: 1017643 - protein, 71 aa, Homo sapiens
PYIFIPSSITRAVKRENYFATSRFVAKIAAIFQLLDKNVTVSSHRLELLSPARDAAIAREAILHGADAVYI

SEQ ID NO: 1017644 - protein, 73 aa, Homo sapiens
FWTDRLTLADCSFLPKLHIVDTVWAHFRQGPIPAELRGVRRYLDSALQEKKFKNTCPHSAEILAAYRPPVHPR

SEQ ID NO: 1017645 - protein, 67 aa, Homo sapiens
PSPSRGAVKQPQRGQGPRIPQHDARAVKGSRRRGDAHGFLGGVVFSTSALRDRLEARAAVSLRQPFH

SEQ ID NO: 1017646 - protein, 115 aa, Homo sapiens
EIGGDWPVVLHVGGGAFGFGREWLKDSWCRFGFSGRIPRSQPFPMADPEELQVSSPPPPPPSSPSSSDASAASSPGGPVSLGWPVPSRSSGPTVDQLEEVELHDRRRSLFINQTS

SEQ ID NO: 1017647 - protein, 105 aa, Homo sapiens
HFHCQCDPGYAPPDCEPAMSSPGGSINDGFWLTVEKSVPLLPKRRAAPKNNGLLISFYIFSPLLILIAIVSLKWNKMKRFWSKVGTVSSRSISEDSSSNSSQSQS

SEQ ID NO: 1017648 - protein, 196 aa, Homo sapiens
MDKAMYAYMGSTVAVAVEKVFQIFGLINTMFSQLNMTVMLSSLEIWSDHNKISTSGHADEILQRFLPWKTKFLFQRSPDMTYLLIYRNHSTYVGATYHGMACDPKFATGIALYPKKITAEAFSVVMAQLLGINLGLTYDDIYNCYCPGTTCIMNPDAIRSHGLKWNKMKRFWSKVGTVSSRSISEDSSSNSSQSQS

SEQ ID NO: 1017649 - protein, 358 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDRCNGGYTAEAWNFWTRKGLVSGGLYESHVGCRPYLHTLPVSTTSNGSRPPCTGEGDTPKCSKICEPGYSPSYKQDKRYGYNSYSVSNSEKDIMAEIYKNGPVEGAFSVYSDFLLYKSGVYQHVTGEMMGGHAIRILGWGVAKDTLLVVASETLTGVTWVLNTRGRTRGTAHMGGEPAEQRKNNAGVALRPQENVISTQKEEAGTTRKLTW

SEQ ID NO: 1017650 - protein, 358 aa, Homo sapiens; identical to SEQ ID NO: 1017649

SEQ ID NO: 1017651 - protein, 312 aa, Homo sapiens
MWQLWASLCCLLVLANARSRPSFHPLSDELVNYVNKRNTTWQAGHNFYNVDLKLPASFDAREQWPQCPTIKEIRDQGSCGSCWAFGAVEAISDRICIHTNAHVSVEVSAEDLLTCCGSMCGDRCNGGYTAEAWNFWTSIPPCEHHVERVPAPMHGGGRYPKCSKICEPGYSPSYKQDKRYGYNSYSVSNSEKDIMAEIYKNGPVEGAFSVYSDFLLYKSGVYQHVTGEMMGGHAIRILGWGVAKDTLLVVASETLTGVTWVLNTRGRTRGTAHMGGEPAEQRKNNAGVALRPQENVISTQKEEAGTTRKLTW

SEQ ID NO: 1017652 - protein, 338 aa, Homo sapiens
MWQLWASLCCLLVLANARSRPSFHPLSDELVNYVNKRNTTWQAGHNFYNVDMSYLKRLCGTFLGGPKPPQRVMFTEDLKLPASFDAREQWPQCPTIKEIRDQGSCGSCWAFGAVEAISDRICIHTNAHVSVEVSAEDLLTCCGSMCGDRCNGGYTAEAWNFWTSIPSCEHHVERVPAPMHGGGRYPKCSKICEPGYSPSYKQDKRYGYNSYSVSNSEKDIMAEIYKNGPVEGAFSVYSDFLLYKSGVYQHVTGEMMGGHAIRILGWGVAKDTLLVVASETLTGVTWVLNTRGRTRGTAHMGGEPAEQRKNNAGVALRPQENVISTQKEEAGTTRKLTW

SEQ ID NO: 1017653 - protein, 81 aa, Homo sapiens
GCTVRVFGSTQADHEVKRQSPSWPHGKTPFLLKIQKLAGCGGRRLWSQLLGRLRQENLFNRGGGGCGEVRSRHCTSAWATE

SEQ ID NO: 1017654 - protein, 86 aa, Homo sapiens
QKLSSKARKIYTDFIEKEAPKEINIDFETKTLIAQNIQEATSGCFTTAQKRVYSLMENNSYPRFLESEFYQDLCKKPQITTEPHAT

SEQ ID NO: 1017655 - protein, 86 aa, Homo sapiens; identical to SEQ ID NO: 1017654

SEQ ID NO: 1017656 - protein, 179 aa, Homo sapiens
PRRAGGFPLSHNLTDHEALETTQYLNSFSHVGAGVVHLINAIVRSQRGGPGARRLSFVFLTDGVTGNDSLHESAHSMRRYVVPTVLALADVDMDVLTTLSLGDRAAVFHEKDYDSLAHTLASSTRFILLDLLSAAALGPSSRRVVKPTPSIGAKAGPGPTRPAPLLHSDALGLHLSSSS

SEQ ID NO: 1017657 - protein, 147 aa, Homo sapiens
MYLLMNSLTVMRVWDHSSSVYLEPTSTGTVRQPAISWIYSKLAERHTLASSLLISVGHSTKCALHVVPFHPRPAWRGGAPCSRLCGSYTVLCSFADRAGKSGWLGCSSSLLANSLLTSFFAHFVTKLRTFEQIADSVAGGSLLDSAL

SEQ ID NO: 1017658 - protein, 67 aa, Homo sapiens
MRVKFSYLMIGLQVVGCIFMVIEGKKAAHHDSEHVMIKLELRKESSSERGSSYEGPTQSSRGIRVGW

SEQ ID NO: 1017659 - protein, 179 aa, Homo sapiens
PCPSIGAHKVGHSDFLRHVGPRRGDPYSKVWEQSGAQRRVTACQGASKDSERLAAQGVIDLLKYVVNSFYPVYQTLWMNNLYNVNTSKQCHEKTEVTDYTCRTMEQEQQLRGMTQMRPNVKMEFDGGVHDGFCLSEGTYLDDDDNEDRGEDQLELIKDDEKEAEEGEDDRDSANGEDDS

SEQ ID NO: 1017660 - protein, 133 aa, Homo sapiens
MASTDYSTYSQAAAQQGYSAYTAQPTQGYAQTTQAYGQQSYGTYGQPTDVSYTQAQTTATYGQTAYATSYGQASHWLYYSNVPPRHTASLFQGYGTGAYDTTTCVRCQHSSRLGRSLVRASRLAISGDFKPCR

SEQ ID NO: 1017661 - protein, 165 aa, Homo sapiens
MASTDYSTYSQAAAQQGYSAYTAQPTQGYAQTTQAYGQQSYGTYGQPTDVSYTQAQTTATYGQTAYATSYGQASHWLYYSNVPPRHTASLFQGYGTGAYDTTTATVTTTQASYAAQSAYGTQTCLSQPMGSSQQPLTPTRPQDGNKPTETSQPQSSTGGVQTSPA

SEQ ID NO: 1017662 - protein, 69 aa, Homo sapiens
QAGRVRRLVPNFRWIPNRHIEHNEARDDVERFVGQMMEIKRKTREQQMRHYMRFQTPEPDNHYDFCLMP

SEQ ID NO: 1017663 - protein, 147 aa, Homo sapiens
KLLQCCELEAGELGMAVPQPWLLGRAARLDGPVVLSSGPSRYVLGMQELFRGHSKTREFLAHTCTRWPGSCDGRPKPRGPSTRRPASSCLEKDLVGQKKTIIGDMGIVWTSFVGIQVILDLFVTASGDKTIRIWDVRTTKCIATCEH

SEQ ID NO: 1017664 - protein, 68 aa, Homo sapiens
YASPTQSPNPQGPSVHPENKPETYAPGMQHEISQACSLYHITEDNSTMRKRNKPADTHNNTDNSQKQC

SEQ ID NO: 1017665 - protein, 346 aa, Homo sapiens
MSGVRWLTRALVRPPGTLGHGEVLSTSAAAHAASRSQAEDVRVEGSFPVTMLPGDGVGPELMHAVKEVFKAAAVPVEFQEHHLSEVQNMASEEKLEQVLQFHEGEQSGIIWKRFIPPDGSIKGGELGLLMILRVEGVTLDLFLPNGKSILKVTLPWGYMNSGTNNLDPGWFIRRARQKGEYSFSWNMHKCTRAVIDVSERFVTTSQVSADLQQFAFDYATQERGGAKVHLLSTRPNIMTLGDGCPAGCEGKLLSGTPKSIGHMDLDAWRCTGSEILPVVVSVLPPFGTFSTCARGGAWVCRGEQEKQLEGAPIRGGIHPARQAARDPNGKRGSEPPTGAPACSARR

SEQ ID NO: 1017666 - protein, 116 aa, Homo sapiens
RLLLLVMSGRGKAGRVLAKAALTRVKVLRDNIQGITKAAIPHFARRGAGKRFSGLIYEETRGVLKVFLENVIRDAVTYTEHAKRKTVTAMDVVYALKPGAAPSYEFSVVERPFLTN

SEQ ID NO: 1017667 - protein, 104 aa, Homo sapiens
SGGGFRGGANLDKRRMLLYQTLDFIATCSLPFLQSPSTPDDPGLLLHIPCMCFLWTLPASSPIPVCKVLDGRNRVFHLLSSSTNTFLPMTTHTHTHTHSHTHSI

SEQ ID NO: 1017668 - protein, 134 aa, Homo sapiens
MSEPWPAGPANMDPLFQQTHKQVHEIQSCMVRLETADKQSVHIGEKRESKQASRPDIQPSRTSGGFSPGKEPPNRERQKCQYFGLDQLKYDVQHLQLGSETSSIGAMQGSSRRDSEKSFCLETFEPANDSDSHT

SEQ ID NO: 1017669 - protein, 130 aa, Homo sapiens
MEVEKTDLNEEPEKLRSQLSHQPRWVHACGIPGPRLQDSPPRDPSDCAVTVVRHSHQPECSPHRGHVWLLQSQACREGSRKPAQAQRSGVPRMIFLSQDEHAAQRGSGMWLRPQLNASLDPIIKRTCSSE

SEQ ID NO: 1017670 - protein, 392 aa, Homo sapiens
ANTLDILFAYRPPQTPFFPTKLNRLAGRTHLVVAATPDLRKEDRLNAGIQGYRDYGQPLHSTLGQAQPLSLKKKFHNVHWFVDAGLKPLPPVLLLVTAVTAEDAFSDHVHSSARKSSGSLDFAALKVSNALAEHVQSSSTAAPCCNVSVTVFGEVTKRARSESEDSELKSVIRVTNQLRDLSANYVMCTGPGLLPVPKEPGGVSDRLGLSQLTAISNKRTSEPLRAPQSRTISCILLTLSTSRDHMASVATSCCFAFAFLSRLGFRRATIPAPLRSTSSRSQGTCLPLFTWDSPLHSQNPPRSKCRFQPIKRQLAQTFEGHPLPPMIFKSSPAPRFVGRGQPPRWPICCRKGIPGTDERTNQVKRRRGRAFLIGNCVRKRDGPRTTKLRFDW

SEQ ID NO: 1017671 - protein, 394 aa, Homo sapiens
SLMVGPVDEVRELQKAIGAVPLIQGEYMIPCEKVSTLPAITLKLGGKGYKLSPEDYTLKVSQAGKTLCLSGFMGMDIPHPAATLDLGEFIGVLMCLTVTQQGAPRCRSSSQGVARSTETEESPEQEALASGPPTHTHTLARSLSWAPWKPAAKPDLLFCSVVFPSLGFRNAALPVCLSICLVGVELIQSTDLFRALEDPTLSLAAELVYPVGSLHLQESPPRPYQRPLGLSPYPTPRPSSRALPGNLPCTEGPHLTSLGHSLGSATLPVPCTRARSTDEAVQRPDGLSCNGVTKADLNPPPLLDALDRGWLAWVHWYQSPGGQWSCTARVSSTATRRGMRAKPPTLPPGLHPSLLSTSTRSGTALTSHPSFHHMHHYKLGWPPGPYTFQPHHSH

SEQ ID NO: 1017672 - protein, 300 aa, Homo sapiens
EAMDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQGSSEAHGIFCYPLLFHQTLPVELVPSYDSATFVLEISALCVREQILFT

SEQ ID NO: 1017673 - protein, 105 aa, Homo sapiens
EAMDEQSVESIAEVFRCFICMEKLRDARLCPHCSKLCCFSCIRRWLTEQRAQCPHCRAPLQLRELVNCRWAEEVTQQLDTLQLCSLTKHEENEKDKYVLNFFVQY

SEQ ID NO: 1017674 - protein, 181 aa, Homo sapiens
MKKMKRTGGHTFKPLAEIYEQHVTKVNEEVAKLRRRLMELISLVQEVERNVEAVRNAKDERVREIRNAVEMMIARLDTQLKNKLITLMGQKTSLTQETELLESLLQEVEHQLRSCSKSELISKSSEILMMFQQGSSEAHGIFCYPLLFHQTLPVELVPSYDSATFVLEISALCVREQILFT

SEQ ID NO: 1017675 - protein, 211 aa, Homo sapiens
EAMDEQSVESIAEVFRCFICMEKLRDARLCPHCSKLCCFSCIRRWLTEQRAQCPHCRAPLQLRELVNCRWAEEVTQQLDTLQLCSLTKHEENEKDKCENHHEKLSVFCWTCKKCICHQCALWGGMHGGHTFKPLAEIYEQHVTKVNEEVAKLRRRLMELISLVQEVERNVEAVRNAKDERVREIRNAVEMMIARLDTQLKNKLITLMVAVL

SEQ ID NO: 1017676 - protein, 127 aa, Homo sapiens [sequence omitted]

SEQ ID NO: 1017677 - protein, 244 aa, Homo sapiens
GEGSNAVVQGAIRPPSDAKKERLRVFVVFVAGDDDSLPDQVGKDDKVQKASSTSFVAIKIDTKVEACQSQIYPVVCVPSSFFIGDSGIPLEVIAGSVSADELVTRIPQGPTRFICLKVETSVAKCQSVQKVPVSYSICVILNLNNTCENFSVPEMPELCEIPPTSDTKSDTAPGGESAGHATSSQEPSGCSDQRPAEDLNIRVERLTKKLEERREEKRKEEEQREIKKEIERRKTGKEMLDYKR

SEQ ID NO: 1017678 - protein, 263 aa, Homo sapiens
GEGSNAVVQGAIRPPSDAKKERLRVFVVFVAGDDDSLPDQVGKDDKVQKASSTSFVAIKIDTKVEACQSQIYPVVCVPSSFFIGDSGIPLEVIAGSVSADELVTRIPQGPTRFICLKVETSVAKCQSVQKVPVSYSICVILNLNNTCENFSVPEMPELCEIPPTSDTKSDTAPGGESAGHATSSQEPSGCSDQRPAEDLNIRVERLVDARDQRPAEDLNIRVERLTKKLEERREEKRKEEEQREIKKEIERRKTGKEMLDYKR

SEQ ID NO: 1017679 - protein, 461 aa, Homo sapiens
MSSSHPEPGPWAPLSPRLQPLSQSSSSLLGEGREQRPELHKTASSTMWQAQLGEASTRPQAPEEEGNPPESMKPARASGPKARPSAGGHWRSSTVGNVSTMGGGDLCRLRAPSAAAMQRSHSDLVRSTQMRGHSGARKASLSCSALGSSPVHRAQLQPGGTSGQGGQAPAGLERDLAPEDETSNSAWMLGASQLSVPPLDLGDTTAHSSSAQAEPKAAEQLATTTCHALPPAALLCGMREMREVGAGGCCHALPATGILAFPKLVASVSESGLQAQHGVKIHCRLSGGLPGHSHCCAHLWGPAGLVPEPGSRTKDVWTMTSANDLAPAEASPLSAQDAGVQAAPVAACKAVATSPSLEAPAALHVFPEVTLGSSLEEAPSPVRDVRWDAEGMTWEVYGAAVDPEVLGVAIQKHLEMQFEQLQRAPASEDSLSVEGRRGPLRAVMQSLRRPSCCGCSGAAPE

SEQ ID NO: 1017680 - protein, 461 aa, Homo sapiens; identical to SEQ ID NO: 1017679

SEQ ID NO: 1017681 - protein, 183 aa, Homo sapiens
MQRCASTPLAPRSLRRWERPSLSTQILAVRTGPSSAMSVTAALSEEASLKRHTLQTHSDKPYKCDRCQASFRLQGQPRQPQDRPYTVRNPYRLQHLVGLQLQPGQLNRENPTPRIALWSRSHYKVRNLSEPRFDTGGPHSVPMCCSTLVRSPIHCEICGTRFRHLQTLKSHLRIPTERASGIL

SEQ ID NO: 1017682 - protein, 134 aa, Homo sapiens
FGELSTFDAVRGPHRRCPPDADPVPPGLALPGRLLVSHSRRTPPASPGPLPRPIFSARASNGPAGPRSSGFCLPRRRRLLPQLRKNVSVKTTSWPVNCFVNNNPSMPSVLQLVHKILSFAQSWAAKCLGDEEQK

SEQ ID NO: 1017683 - protein, 226 aa, Homo sapiens
MYFSNFLAQEDFDLLHMSFYNDLSSRLYRTHFADVMTRNTHTHPPHDTPPLTHRHSHINKASQPTRRSTTPPPKGTTQQGPTATSQENTCTSNTRPRNHPQSTKPRGHTDTPGTKPQTSNRGHTGRNTTAQRTRHQLPSTRTSTTAREHRRRRQHERRTHRHTHHAGSLQHTTATQHETNPPPVPTTHPTPPAAQTSRETKTRARRTAQDSHHPPQTPTQAARTQY

SEQ ID NO: 1017684 - protein, 141 aa, Homo sapiens
MFWEKKIEHHARHLQNEDIRVRRSALNKLRVGWAEQLEGRNKMLQGPGRCPDRVPEATESLHTKDKKGGLRAHELQTLHELPEGHGEGTPRVGSKHPRQSSQDLHHGNGPHLADPVIIPPRGPRCSRVPGFSSASLVPNKT

SEQ ID NO: 1017685 - protein, 278 aa, Homo sapiens
TQLGAPLLSSPSPVCLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELANLKKNHEEEMNALEGRWVAEINVEKDAAPGLDSRILNEMR

SEQ ID NO: 1017686 - protein, 280 aa, Homo sapiens
IQPPSPPMAGRLRVIGRGCSAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELANLKKNHEEEMNALEGRWVAEINVEKDAAPGLDSRILNEMR

SEQ ID NO: 1017687 - protein, 275 aa, Homo sapiens
RNSDELQPFSCVLPPAAATMTTSIRQFTSSSSIKGSSGLGGGSSRTSCRLSGGLGAGSCRLGSAGGLGSTLGGSSYSSCYSFGSGGGYGSSFGGVDGLLAGGEKATMQNLNDRLASYLDKVRALEEANTELEVKIRDWYQRQAPGPARDYSQYYRTIEELQNKILTATVDNANILLQIDNARLAADDFRTKFETEQALRLSVEADINGLRRVLDELTLARADLEMQIENLKEELANLKKNHEEEMNALEGRWVAEINVEKDAAPGLDSRILNEMR

SEQ ID NO: 1017688 - protein, 232 aa, Homo sapiens
MFRELKKTQPHQKLLQPGKEQSSVFEDPGHQINSPTWMMIGGNKVLARSLMIQTLEAVKRKQFEKYHAASAEEQATIERNPLHHLPSSTETTVSLCIGLVPILKGGRFYQVPVTPTRRGVARFLAMKWMITEVPGYKSTSGTLMPGESLWHKLLEAFHNQGPVIKRTAMTCATLTDGQRPTVPGPHTLVVESPGGVPGPSGAKTTVCATATLKTNLVRYGWYVLRNGWARPS

SEQ ID NO: 1017689 - protein, 256 aa, Homo sapiens
MPVGGANLRTEKIVQKQRQQQTSELLFRELKKTQLIKSCSSQGKNKVLCLKTQSSDKFTNMMMIGGNKVLARSLMIQTLEAVKRKQFEKYHAASAEEQATIERNPYTIFHQALKNCEPMHWAGTHPQGEGRFYQVPVTPTRRGVARFLAMKWMITEVPGYKSTSGTLMPGESLWHKLLEAFHNQGPVIKRTAMTCATLTDGQRPTVPGPHTLVVESPGGVPGPSGAKTTVCATATLKTNLVRYGWYVLRNGWARPS

SEQ ID NO: 1017690 - protein, 234 aa, Homo sapiens
GPHGPGILTTLVLAALLLALGVERGLRYPRYAPNVQGACKICQVAFYCKTTRELMLHARCCLNQKGTILLDLQNCSLETLVQTIIRHITTVIIDLQANPLKGDLANTSRGFTQPQTLTLPQHVNPGGNAWKTITSNIDNKSVKGKRTFAITLGTQKCVLRMALVYLMVPGLLQCVCADGFHGNKCAPGLVLTAYVLRDSGSHHSIRLHSALGDPAPKSQDFMNYIGLTIDLRSI

SEQ ID NO: 1017691 - protein, 536 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKSSKYWSSRKSKQHILLNFFVLFKFINDAFFGICPFKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQ

SEQ ID NO: 1017692 - protein, 581 aa, Homo sapiens
MEVSPLQPVNENMQVNKIKKNEDAKKRLSVERIYQKKTQLEHILLRPDTYIGSVELVTQQMWVYDEDVGINYREVTFVPGLYKIFDEILVNAADNKQRDPKMSCIRVTIDPENNLISIWNNGKGIPVVEHKVEKMYVPALIFGQLLTSSNYDDDEKKVTGGRNGYGAKLCNIFSTKFTVETASREYKKMFKQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQRELCNGAILAHCNLRLMGSSDSPASASRVAGIAGGCHHTQLIFVFLVETGFHHVGQAGLERLTSGDPPASASQSSGITDVKVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQ

SEQ ID NO: 1017693 - protein, 138 aa, Homo sapiens
IDEDPANRLREHRDPLWSRRRRIPTGGEKVNKHIDYSFQMSESLSSRETSFLINEETMFQKNQQSKDSIFFRDGIRQIDFVLSYVDDVKKDAELKAERRKEFETNLRKTGLELEIEDKRDSEDGRTYFVKIHAPWEVL

SEQ ID NO: 1017694 - protein, 288 aa, Homo sapiens
LLLARAFRRCAARGYGEVAEQVSALGCRADRLDGKPCVRVYAWLLAPAPSYELRPDRASLTVDGYDSSHSTGVTKRRDVSRYRQLLTRHEAASSDEVQAASATVYIPAGIGYTKGVPLASPSVRFHDKRDAEDAMDAMDGAVLDGRGAAGANGALRLSPGPHTTAAGDRTPQVRGRWLRTPEPQALGGVAAADPGVGAVPGLAADLATAARSLGPALVLDLGRPPSPDPYEGPSPRSSAGSRSRSRSRSRSRARSLPQVSNEGIPIQGRDRKSHPKSPEEDERWSFRN

SEQ ID NO: 1017695 - protein, 222 aa, Homo sapiens
MRVVTSLKGGHTDLPHLARHGMRLRLPMNVQAASATVYHPQQGSAYTKGVPLASPSVRFHDKRDAEDAMDAMDGAVLDGRGAAGANGALRLSPGPHTTAAGDRTPQVRGRWLRTPEPQALGGVAAADPGVGAVPGLAADLATAARSLGPALVLDLGRPPSPDPYEGPSPRSSAGSRSRSRSRSRSRARSLPQVSNEGIPIQGRDRKSHPKSPEEDERWSFRN

SEQ ID NO: 1017696 - protein, 50 aa, Homo sapiens
KTRRSHLFCPGLGFPEHLSFLSQIVFSFSFKASGSAATLPGSLCKDGGVK

SEQ ID NO: 1017697 - protein, 294 aa, Homo sapiens
MSLQNPAWDRQVQDARTSQSLVVFPSHLLGKDKMSQMASVPEREPESAPSAPSAELQSTQHMEAQPVESDADHVTAGANGQHGPQAASTTKSAEEKAEHPKAPHPEAEALPSDESPVAMGANVVDSLGDLQTWFFPPLQQAVCPRRLGPTRWPGEKAPGTQLYTASEENSYMRSMNSLLDRGEGSISSLADILVWSETTMGMAIATGFLDSGHSTVADLLHSSGPSLRSVPSLVGSVSSAFSSGLVSGTSSALRTITRVLETVEQRTVEGIRSAMRYLTSHLTPRQAQADPNYD

SEQ ID NO: 1017698 - protein, 135 aa, Homo sapiens
NGLQSNMPKFYCDYCDTYLTHDSPSVRKTHCSGRKHKENVKDYYQKWMEEQAQSLIDKTTAAFQQGILYFILCSSLQGPMIHSPSFPVSRLYDAPIWGPPDAMMASLWICSGLSDRHGNAYAGPCLCRHMSIAVL

SEQ ID NO: 1017699 - protein, 95 aa, Homo sapiens
MTLIGQPYRREGASVNRRRPQPLQGFQVHRCRIALMPADAITRVDQFDSCHFTITADLGQDDAAAIAGTLVSPLTSAFAGINFRQRVPPIIASLG

SEQ ID NO: 1017700 - protein, 163 aa, Homo sapiens
NDARKATQPHTTRNPSKPHKPQKKTKNLRTPDPPPKSSKKASSRSPAGAKAPSRPPNKKKRNKPENIKRQQKRQATAPQEKKEKETKEAKRKATGGQKQRAQFLNEPKKKGVPNNQAWPPGVCGHSGPWAGAPRLTLRCCCWVCFGFGVCWEGHQVPFPSCAL

SEQ ID NO: 1017701 - protein, 154 aa, Homo sapiens
LPGLRKMQGSGGEKKEPLLPPRLLGLGWFCPLKWSGYRTRAAPPHPAWAPRRPLLLPWPGHAGELLTPTPTVQPGLFPESASRWHQLFGPRILPGPPKGGSPEQTQGVRLLLSAGHSGPWAGAPRLTLRCCCWVCFGFGVCWEGHQVPFPSCAL

SEQ ID NO: 1017702 - protein, 202 aa, Homo sapiens
RLPHHGVWALHPPALPQPPGCIFEAAWPPGASYSDRLSLSLSRLLAPWHACKDSSERRRETWTPSCMPPRLLGLGWFCPLKWSGYRTRAAPPHPAWAPRRPLLLPWPGHAGELLTPTPTVQPGLFPESASRWHQLFGPRILPGPPKGGSPEQTQGVRLLLSAGHSGPWAGAPRLTLRCCCWVCFGFGVCWEGHQVPFPSCAL

SEQ ID NO: 1017703 - protein, 143 aa, Homo sapiens
MAAQCVTKVALNVSCANLLDKDIGSKSDPLCVLFLNTSGQQWYEVERTERIKNCLNPQFSKTFIIDYYFEVVQKLKFGVYDIDNKTIELSDDDFLGECECTLGQIVSSKKLTRPLVMKTGRPAGKGSITISAEEINTIIEWSC

SEQ ID NO: 1017704 - protein, 143 aa, Homo sapiens; identical to SEQ ID NO: 1017703

SEQ ID NO: 1017705 - protein, 132 aa, Homo sapiens
MAGMAAAHFAVDRAIIRDRGVTPVDSGGADVNRVTYQGYSPYQLTGGRPSTRIQQQLGQLTLENLQMLPESEDEESYDTESEFTEFTEDEAESVNSFGALTNEVPFPSPSQAPRAAPYQRGIYIMSLSNFCA

SEQ ID NO: 1017706 - protein, 102 aa, Homo sapiens
MAAAHFAVDRAIIRDRGVTPVDSGGADVNRVTYQGYSPYQLTGGRPSTRIQQQLGQLTLENLQMLPESEDEESYDTESEFTEFTEDELPYDDCVFGGQRLTL

SEQ ID NO: 1017707 - protein, 111 aa, Homo sapiens
MPLLRDLLHPSLEEEKKKHKKKRQYTSPKFLLYGCKHVQVATRSPRYFRHAQTVVLMCRLSTVLCQLQEERPDSQKVYHLAFSTPSDEMTDYTVSIFTCKVYQHILSDYQK

SEQ ID NO: 1017708 - protein, 285 aa, Homo sapiens
MERAGVIGRGWQQGTAAEGVPSRGPPGEVIHLNVGGKRFSTSRQTLTWIPDSFFSSLLSGRISTLKDETGAIFIDRDPTVFDPILNFLRTKELDPSGCPRFQHSLHEAQYLWAHSSRYRQTMQHSRGVGSMLLVETSSSSGYLPSTSSSQLKAADTEHSLVGASGSSGVTASPLSDGASTMTPQAWQMQGCLGRMLDEKIPPSPSGQPVGAGDGAPGVWTAIIGSLWLYPVSSLLQVAGSLWLALVYSRSPAGRGPSNDWRSQAGLHGGALGEPDQIVGPAHRAE

SEQ ID NO: 1017709 - protein, 107 aa, Homo sapiens
PEMESRCVTQAGCSGTISAHYNLHLQGSCDSPTSASQVAGITGTRHQARLIFVFLVETGFHHVGQSGLGLLTSGHPPCLSLPKCWDYRCEPRAGLQFEFQSLLYNLG

SEQ ID NO: 1017710 - protein, 327 aa, Homo sapiens
MRVSDYSTNDVFLPLLATRFPLEDATVPVTVASSRVQASPLPLGAQQLPTPPSQPRARKRRDHGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQVEFKKSGRGTSLGHTEEELPLHGVLSQQFVELINKCNSMQSEYREKNVERIRRQLKITNAGMVSDEELEQMIGQWASEVFCPYPDGQAGTRKANEIGRKETALNPIGADTFTFCSKEAGKTTMKHRSGGRGSQAHQEENFLCSPEGGT

SEQ ID NO: 1017711 - protein, 175 aa, Homo sapiens
MKQELQNLRDEIKQLGREIRLQLKAIEPQKEEADENYNSVNTRMRKTQHGVLSQQFVELINKCNSMQSEYREKNVERIRRQLKITNAGMVSDEELEQMIGQWASEVFCPYPDGQAGTRKANEIGRKETALNPIGADTFTFCSKEAGKTTMKHRSGGRGSQAHQEENFLCSPEGGT

SEQ ID NO: 1017712 - protein, 115 aa, Homo sapiens
MRDRTHELRQGDDSSDEEDKERVALVVHPGTARLGSPDEEFFHKALSVTLPRSGQFGRLLSNWGIKSRSWRNSRSPSWPRPFPRRVSETPAAGRMLRPRDCGGCSSTQVVARVVC

SEQ ID NO: 1017713 - protein, 121 aa, Homo sapiens
MRDRTHELRQGDDSSDEEDKERVALVVHPGTARLGSPDEEFFHSPLGHPPQVRTIRQTIVKLGNKVQELEKQQVTILATPLPEESMKQELQNLRDEIKQLGREIRLQLKGELLGPQTDPSL

SEQ ID NO: 1017714 - protein, 184 aa, Homo sapiens
ERRQEDDVELGTHAVSKEGEIKQLGREIRLQLKAIEPQKEEADENYNSVNTRMRKTQHGVLSQQFVELINKCNSMQSEYREKNVERIRRQLKITNAGMVSDEELEQMIGQWASEVFCPYPDGQAGTRKANEIGRKETALNPIGADTFTFCSKEAGKTTMKHRSGGRGSQAHQEENFLCSPEGGT

SEQ ID NO: 1017715 - protein, 253 aa, Homo sapiens
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTQHGVLSQQFVELINKCNSMQSEYREKNVERIRRQLKITNAGMVSDEELEQMIGQWASEVFCPYPDGQAGTRKANEIGRKETALNPIGADTFTFCSKEAGKTTMKHRSGGRGSQAHQEENFLCSPEGGT

SEQ ID NO: 1017716 - protein, 114 aa, Homo sapiens
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKGELLGPQTDPSL

SEQ ID NO: 1017717 - protein, 237 aa, Homo sapiens
MRDRTHELRQGDDSSDEEDKERVALVVHPGTARLGSPDEEFFHKVRTIRQTIVKLGNKVQELEKQQVTILATPLPEESMKQELQNLRDEIKQLGREIRLQLKAIEPQKEEADENYNSVNTRMRKTHSMQSEYREKNVERIRRQLKITNAGMVSDEELEQMIGQWASEVFCPYPDGQAGTRKANEIGRKETALNPIGADTFTFCSKEAGKTTMKHRSGGRGSQAHQEENFLCSPEGGT

SEQ ID NO: 1017718 - protein, 213 aa, Homo sapiens
RSHYLGGFLAPEEEAGSHSLHVKNLTVEMAAQKIKGLEHLAKTKKYLKGFLKWKPNYNSAASEYGKTTVAFKNAKQFEQTKDACLKEAVAHENNRALFHAAKAYEQAGMMLKEMQKLPKAVQLIEKASMMYLENGTPDTAAMALERAGKLIENVDPEKAVQFYQQTANVFENEERLRQAVELLGKASRLLVRGRRFDEAALSIQKEKNIYKIE

SEQ ID NO: 1017719 - protein, 96 aa, Homo sapiens
LWGGLRKTTIMAEGDGGASTSHGQEQQEVEEVLHTFKQPHLMRTHYLHNSTKRDGVKPGETSPMIQSPPTKLHLQQWELQFNVKFEQRHRLKPYQP

SEQ ID NO: 1017720 - protein, 174 aa, Homo sapiens
PRLRFTQISWPMMVEESGRDEMRPWVAVSVPLASHSCCGLPSPVAAATVSVVRNTTPSPSGPRVVTASWLWPALVHSTSLVSFPYKESLCTVSSVWRVTSLSFRDPDRAPASLAQHCQWDLPWGVTVILCHVLIKGEGLPVEERSQNGDHGTVKLLKLNAQRWIVRALFLERRS

SEQ ID NO: 1017721 - protein, 156 aa, Homo sapiens
MYHNSSQKRHWTFSSEEQLARLRADANRKFRCKAGGQRGRFFRMIQSFLSLMKNMTLCKYYETQVIGNLSVFKASNAKICVWVRLCMYFKRFYLNNLSKWNITPKDNNGSLVWHFCGLAKVDELQLYLVLSCVGKPSGRSPSVDQGEGTLKQILGI

SEQ ID NO: 1017722 - protein, 328 aa, Homo sapiens
MNSCDSAEAVLSSETSVAPSVLRLAMTSYSYRQSSATSSFGGLGGGSVRFGPGVAFRAPSIHGGSGGRGVSVSSARFVSSSSSGGYGGGLRRRPDRVRTGLLAGNEKLTMQNLNDRLASYLDKVRALEAANGELEVKIRDWYQKAGGLGPPATTATTTRPSRTCGTRFLVPPLRTPGLSCRSTTPVWLQMTSETKFETEQALRMSVEADINGLRRVLDELTLARTDLEMQIEGLKEELAYLKKNHEEEISTLRGQVGGQVSVEVDSLRAPISQDLSDMRSHMRSWRAEPEDAEPGYSRTEELNRESLAHGAAPDEQVEVLTAPSLEID

SEQ ID NO: 1017723 - protein, 101 aa, Homo sapiens
VKSSLPPIIIKFYWNTAMPINLQIVSGCFCALTAELSSCIRDLKTRIWLKSLKYVQKYFASTDFKNCTVIKPGRFITKQFLYFQYVMVQDMLSPSPMGRPE

SEQ ID NO: 1017724 - protein, 112 aa, Homo sapiens
MRCRPATVLSAGVRQEGWVEAPACLNLKGRALTRTGGQVTTRTQGARPLSPGGARGCAGLVQPKGFTQPAGKIHFFHLGPLDEGVVCEHLQVRPLRWVLDEAFIDKLLEVGG

SEQ ID NO: 1017725 - protein, 140 aa, Homo sapiens
EPRPSPRVVSPSWTKPMYILHILIDVSCLPKMYKTKLCPDHLGHMWSGLPEAVSRACVLNLGKINFLNWLRPVSDTLGSHKETGSRDLVSISFSKHNVSTVLGCVCLVSPSWLPSGTGFLSSLLPSLSGSTLQMLEFLRV

SEQ ID NO: 1017726 - protein, 140 aa, Homo sapiens; identical to SEQ ID NO: 1017725

SEQ ID NO: 1017727 - protein, 212 aa, Homo sapiens
MAHEWELGAEAGGSLLLCAALLAVGMRPEAMRLGRVQVAADLDALIWLCYYALVHFALEGPFVYLSLVETLANSDGLIASLWKEYGKADARCGLFLSNHCVCWKFVTVALAWVSGLMFLIYGIVKEKYYRHFLQITLCRVASCMAAWMTFLPEWLTEKSPNLNTSEHGLVLLAFSVYLAQRGVWAPDPRDCYCGQSWIGTLRRTASRKESQF

SEQ ID NO: 1017728 - protein, 112 aa, Homo sapiens
ILPLLQNCQWWFPMTTPQSQGLPWPSRLAQSDPANVPSATICQPLLAPAPGLHMLFSLPRMPFPQPPGSDGEHLLILQSQAGREHLWRCRLTSQAEGVILPGDVVTSLTTLG

SEQ ID NO: 1017729 - protein, 112 aa, Homo sapiens; identical to SEQ ID NO: 1017728

SEQ ID NO: 1017730 - protein, 300 aa, Homo sapiens
QVSGFRTIRDGGGWFRLLYRGQDPGGGAHRPDLFAEGLLEFLRPAVQQLDSHVHAVRESQVELRDQIDNLATELCRINEGQKVALESGPHILRRFLVPGDAVVWYHHPNRMLRTGLETAKPQLCARKQPQGEAMLVCGNYPPWLPQAITDEPMDFSKLKYLFPSLLVSTDYARILGDQSPIDLQDLKGERNVCWTHSVYPIYVGGPGDLTEQNESKDYINMVWFFTNELSSTFLGVRGLLLRIVTEALDVMPVMGGRASRISSGTGGAQKILPFAGTAGLIIKKGRDRREVLSSFCYIVD

SEQ ID NO: 1017731 - protein, 239 aa, Homo sapiens
MGLTIFSQLQVLHCVPVHVPMKMKSSLQWTCSWGLPQVLCVLNGTEAALAEPPKSQDGKGRAPPPCPARPCPQQQDRGCRPASSSEAGSLQACPGARQVAAPGLSLPAGSAALRRGGRHASCADHAPGPPERPAGPGRGTAGTGRSPPPSAARQCTRLVDFAAPGGAFPGGRGRREAASMHFMWRLLAPPVASCSAGRPAPSGGPAADQLAGVETRLLTPPCMQRHLEAARPLRLWVWM

SEQ ID NO: 1017732 - protein, 98 aa, Homo sapiens
NLSSASAIMGNPKVKAHGKEGADFLGRCHESTWMIFKGTFAQLSELHCDKLHVDPENFKLLGNVLVTVFAIPFPAKNFPRQSCQKMVTVASALSSRYH

SEQ ID NO: 1017733 - protein, 90 aa, Homo sapiens
MLSVAARSGPFAPVLSATSRGVAGALRPLVQATVPATPEQPVLDLKRPFLSRESLSGQARSAVPFGSGLPDEVPYNIVAVILGIRYNLPE

SEQ ID NO: 1017734 - protein, 288 aa, Homo sapiens
RLLALYAWKRRPVTGLAVGAAVAMLSVAARSGPFAPVLSATSRGVAGALRPLVQATVPATPEQPVLDLKRPFLSRESLSGQAVRRPLVASVGLNVPASVCYSHTDIKVPDFSEYRRLEVLDSTKSSRESSEARKGFSYLVTGVTTVGVAYAAKECRHPVRNPSMSASADVLALAKNRNQVIRYSRRQEHGFHKWRGKTPVLCVIEPRKEIEQEAAVELSQFEGPQSDLDRVKKLNGYPDRCMPHLGSVSLANAEIGGIRPCMVPHDALAGNMGRSLTVSHVVPDNGWG

SEQ ID NO: 1017735 - protein, 75 aa, Homo sapiens
RLLALYAWKRRPVTGLAVGAAVAMLSVAARSGPFAPVLSATSRGVCATLQKLGERTIKAWTETRLRQRFPKGEFE

SEQ ID NO: 1017736 - protein, 132 aa, Homo sapiens
RSSKVTQSACFLVPSALLQPTACPVPSGLRGAPVPESGMTERGRFQGSPDCVELRTQYRFSGTLRSLWQAWSGSPGGQRAQWCPQQGGGQANPWDLMCTIHSFESLDANSGPVTVDGMPAIGRLWYRCPPRA

SEQ ID NO: 1017737 - protein, 212 aa, Homo sapiens [sequence omitted]

SEQ ID NO: 1017738 - protein, 570 aa, Homo sapiens
DHASDEFHDIYNGHMKEKKIHQMGLLLGGVKSTYMFDLLLETRKPDQVFQSYKPGEVMVKVHVVDLKAESVAAPITVRAYLNQTVTEFKQLISKAIHLPAETMRIVLERCYNDLRLLSVSSKTLKAEGFFRSNKVFVESSETLDYQMAFADSHLWKLLDRHANTIRLFVLLPEQSPVSYSKRTAYQKAGGDSGNVDDDCERVKGPVGSLKSVEAILEESTEKLKSLSLQQQQDGDNGDSSKSTETSDFENIESPLNERDSSASVDNRELEQHIQTSDPENFQSEERSDSDVNNDRSTSSVDSDILSSSHSSDTLCNADNAQIPLANGLDSHSITSSRRTKANEGKKETWDTAEEDSGTDSEYDESGKSRGEMQYMYFKAEPYAADEGSGEGHKWLMVHVDKRITLAAFKQHLEPFVGVLSSHFKVFRVYASNQEFESVRLNETLSSFSDDNKITIRLGRALKKGEYRVKVYQLLVNEQEPCKFLLDAVFAKGMTVRQSTRGINFLSSGQQCGSELSIRQVSSNGKQQHGTRILAPVFPGLIIFYEGRLFLFPATGKVSLKFLMGLQKIHV

SEQ ID NO: 1017739 - protein, 72 aa, Homo sapiens
QHRVTPKPLVDSNSPVGAREAERSRVYLSAQSFSAFSVGQGRKQAGPGSQFSKAAGPTRGHSPSPLDVANQN

SEQ ID NO: 1017740 - protein, 161 aa, Homo sapiens
MPGNHPAPSPGPVAGRLSRRLGAFRKAPDRRPRVKLPYPATSQAALPEALSKGRETPRPATHPARSQDVKPLSCPFDFLRDNVEWSEEQAAAAERKSPGEQYPAVCARRNKVDYEIKCPQILECISTKIQENWVFQRIDNWLLNGNFPEVWNLAKKIKKSL

SEQ ID NO: 1017741 - protein, 102 aa, Homo sapiens
MPGDNVEWSEEQAAAAERKSPGEQYPAVCARRNKVDYEIKCPQILEWISTKIKENWVFQRIDNWFLNGNFPEAWNLAKKIKKSFEGTGSWRTRVKYLNVRQQ

SEQ ID NO: 1017742 - protein, 230 aa, Homo sapiens
SVTCLLSPGPSPWLREGLAGRVLVASSVRLSELCCGLGDRGLSQGAGWGGPRSSEYLETQAHCVLELGHPSCCFSRPLPTPFLPAFLPPFLLFPHPLHVWKPPAWTTACTCVMALGASKEWTAGPDQAVTLRDSPSTLGYTAAAPLQGSPGPVLGISRPGPVTVRTTPADPGPVSPGPAPSQSATHTWLWASATSSSVGNSAAFSTQEALGAASCRRSCLRAPGSAGAAA

SEQ ID NO: 1017743 - protein, 230 aa, Homo sapiens; identical to SEQ ID NO: 1017742

SEQ ID NO: 1017744 - protein, 109 aa, Homo sapiens
MAKALPASSRVRRGHRPWSPTWRVRAPFGQRPLALAVISLPGALRVPDDCGVTLNGKARRLHLRMYAGPEGQRGEQEPNGHAGWETCVLFTAHLRLPAFSLTVCHEPHS

SEQ ID NO: 1017745 - protein, 145 aa, Homo sapiens
HNKYESGGGGGGGFGSSGLSARISMILQRLFRFSSVIRSAVSVHLRRNIGVTAVAFNKELDPIQKLLCDKIREYKSKRQTSGGPVDASSEYQQELERELFKLKQMFGNGKMDYFHTSQFVEYPNMRCPRKTTEVLKIMTVYINAW

SEQ ID NO: 1017746 - protein, 142 aa, Homo sapiens
LPRNLSSATIRGTTFRLSSRHSRTLHCLCLLGFVKNAAVNRGVPLPVWVPAFHFFGRYVERRLRGHVVILFGSWRRHPVFHSSSAIKWHFLSDTSRISPHKCISPHKHCNSWAHLPSPVTCHCGTLQVWPEPTRRQPREGQQ

SEQ ID NO: 1017747 - protein, 142 aa, Homo sapiens; identical to SEQ ID NO: 1017746

SEQ ID NO: 1017748 - protein, 216 aa, Homo sapiens
MAGAAGRSNHGAQPNGMVLKPHFTKDWQRRVATCFNSRPRKIAKRKARQAKARRIAPRPALGPIRPIVRCPTVWYHTKVRAGPGFSLEELRVAGIHKKVARTIGIFVDPRRRNKSPESLQANVQRVKEYRSKLILFPRKPSAPKKGDSFAEKLKLAPQLAGPVMPVRNVYKKEKARVIPEEKKNFKAFASFRMARANARLFGIRAKKAKEAPEQDV

SEQ ID NO: 1017749 - protein, 128 aa, Homo sapiens [sequence omitted]

SEQ ID NO: 1017750 - protein, 102 aa, Homo sapiens
HSIEQHRGLAGHNWGCVCFLAHSAHMATHTIASSATHCFSQLTILALIVALSGFLATSTIVMSFVHPEQIVCLCHPMFSPLHAMLGQPAVFSWMRQTPEGKE

SEQ ID NO: 1017751 - protein, 157 aa, Homo sapiens
RLAYQGQQRLLGGHLASASEADEPSMLIRSRQSRIYFGGNFFDYPLKPGMDLVQKMGPLRCLQFAGSYMASAARPIQPEQTLEDFFINRFGRQLYLQFFKDYTEKVWGVPCRDINADWGAQRIKSLSIGSAAKQALKKIVTGKTDTQHTSLIESFLY

SEQ ID NO: 1017752 - protein, 198 aa, Homo sapiens
PDHPRDFLFIALRRRVLALLAPFIPRGSAGSALGRAALRFVRWAHCFWEGRADMVAAPPLLGLACRGRSRYPVAGSLERQPRGGMGSRRGSGGSAGELEVVQCCVDDQRNVQARWASGLWGRGNPWSRKSDGPLRALRRGGTGRRGWRGPVAPCACGLRGARVAGGSADQNRLIGKNLDKSRCCGPLSESFGGGTWRS

SEQ ID NO: 1017753 - protein, 76 aa, Homo sapiens
WYFCICVIQYNNLAYLEPFTIRGVLNEYFHNVCELDLVFNFYKVYTVVDEMFLAGEIRETSQTKVLKQLLMLQSLE

SEQ ID NO: 1017754 - protein, 259 aa, Homo sapiens
AYRRYGYPAGMPPDSPRELVPKQAPCSPSDPALPWTLGHGNQPPAVVPEPKARWSRGGRGEARRFFGVYLLYCLNPRYRGRVYVGFTVNTARRVHAAQMCVCLHKKGGGLCVTSCGEVPCGDGALLCVTGVFPVLLCACPSCGEMWGVWEARLDVPRCRALAALVGPSACERETCRSLSTVLRALAAQLLAAAAGALVTRTSRIHSIAALGVLPMNLRDREASMTFHELAWTEWLPSWAISGATPKRTPKVTPGHQRVD

SEQ ID NO: 1017755 - protein, 142 aa, Homo sapiens
MRNWSLAVVVSTPLSWTMLRPKDVTDSFIYDYATLSPSNLKSNLILVALPPSQHTGASREHGQVKVKKERMAYRCCSVRTVSKPESQDASLRIRLKTNKIREIQESWSRKRREGSVESIREQLLFQHSGDFTPGPEGASLFH

SEQ ID NO: 1017756 - protein, 254 aa, Homo sapiens
CFSPPGCSRALSAPWPFPFRRVLVCFPAFSAPAPPPVVCLRLSRLGASFRVALPAPALCLLGGACRLRPGPRGPCVFAWGALWRKGRLPSPHASAAQEPSWVHWTSFCDFSPVGHVDKHVSPPPTLIFWSSRLRARGDIMTFCPGLLIPGHREGSWAVSVCVPSCCPSVLDVSWARGPPGKLTPPVLGGGHGTPQVPPTLALKQPPGKQPESRTAGSLSGFLRPGGGSPAHGAVVPAAGLSVGASWGSLAPGRL

SEQ ID NO: 1017757 - protein, 103 aa, Homo sapiens
LSIRVGINLAVSRCLGFSLGLMLIYTISTRHVFSQRRMADRAMRFALFALIGGAGLLLTEALLWLLVRQIGVAPLAPSSAALWSFLFNFSVAKSLLFTSLNPT

SEQ ID NO: 1017758 - protein, 329 aa, Homo sapiens
MQAHEDTGVSGKCTQTVVFPFWLKKKNFVINIPLKSKREKKKLDAFIRAFGISSPRFHVQFIGKCYRHQQTPVSKNKCQEGKSMNNRKLQRRLHAALGSVEADGVQKGAATLSPRTPAAASSISFSMSCRVLDTLAELTDEQRPQGGLLVVVLDVTIDHVHRQAGLLFSGIQICHHLVIHSLFASEDQIKQVFAVRGISLAGALILSFLSSTSAKIPSVYRVLCPFLRRSVVHLVISWFLQTHKHLGLSGAGPGSFIVSPMFTKDRTLNAPEYAEDDQCTYHAPGSGCIEHTHRHTRHAGTTAWRQAAKSRGISRLGSHPTAAIPREPA

SEQ ID NO: 1017759 - protein, 142 aa, Homo sapiens
PSPHMYWEKDGMALDEVWDSSHFALQPGRAEDGPGASHGIAHPWRTRLHGLPAVYVCHARNGTATQQAGALLQGGTSPPARPRTPTKAPAPGGGALKCAPKTFWVNEGKHSQVPLLRDGQARARDRMALGGPPAAGTGRRLN

SEQ ID NO: 1017760 - protein, 108 aa, Homo sapiens
MAVWPMSGGRAHGVAQAQRAGRVQADAYGGRAAGYGVLYKGGILPWVAKFDCPRRECEHVCVWGQFFLMSGVRMPGPSGLSVCCQPPTGGTAVHNQCRVCCCGTVVNR

SEQ ID NO: 1017761 - protein, 39 aa, Homo sapiens
GLISEDPSAAAILMEGSYNKVFLAKGNIPAESYTFFIGH

SEQ ID NO: 1017762 - protein, 84 aa, Homo sapiens
VSLILHQLFGPSTFFFPCLFPEPGGLSSTRSWSGLPCQGHTDQLSYIKHPVFPGAITLMEGSYNKVFLAKGNIPAESYTFFIGH

SEQ ID NO: 1017763 - protein, 211 aa, Homo sapiens
MTLRKLLFFSRPPLPRLCPGGGAYPAVSQGGLVAARVGSAFPLWESLGQHEPKGCGQAWCSRVLWLHRLPKKDNPRRGLWLANCQRMDPSGQGLWELASEYIYFCSKHFEEDCFELEGISGYHRLKEGAVPTHIGVFSKLRRTSKTKGHSYPAGPLKSAGSDDAGSAVSEGRGPTTPFSPLHLLMSPAFLWNRSQICQFGGLPVWEAEAWP

SEQ ID NO: 1017764 - protein, 149 aa, Homo sapiens
MTLRKLLFFSRPPLPRLCPGGGAYPAVSQGGLVAARVGSAFPLCGSLGQHEPKGCGQAWCSRVLWLHRLPKKDNPRRGLWLANCQRMDPSGQGLWELASEYIYFCSKHFEEDCFELVGIRWASLPADAWGRMWGSRTDLGQVQGHGMST

SEQ ID NO: 1017765 - protein, 269 aa, Homo sapiens
FPVNGPRGPSLNWAGPTDRILAAIRTGTKGPDKGIDPCRTCGRASGLRVSQEGDMVERPTRYGLHLQLDLKRGRRVSLEKRLVAEEEEDEEEVEEDGLSSCSEEDDSELLQEITDNRDGKKEIQIEKIHLDTSSFVEELAGEKDLAHVVEIYDFEPALKTEDLLARFSEFQEKGFRIQWVDDTHALGIFPCRASAAEALTREFSVLKIRPLTQGTKQSKLKALQRPKLLRLVKERPQTNATVARRLVARALGLQHKKKERPAVRGPLPP

SEQ ID NO: 1017766 - protein, 160 aa, Homo sapiens
NIELAPVSRLPVILRNDFLKDGYHIQTLIFYDKQFHPIDLINTTFEDQADKYIFWRYAADRAKITNAYGFIWISELWLRKASIYSNKPIHTMPIIDERLQVIGIDSNNNQKCISWKIVRENEEKKPTLEISTADSKHDEKPYFMRSVLKAIGGDVNTMNN

SEQ ID NO: 1017767 - protein, 500 aa, Homo sapiens
MATVIPGDLSEVRDTQKVPSGKRKRGETKPRKNFPCQLCDKAFNSVEKLKVHSYSHTGERPYKCIQQDCTKAFVSKYKLQRHMATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPTQTQDLQDPANTIGLGSLHSLSAAFTSSLSTSTTLPRFHQAFQ

SEQ ID NO: 1017768 - protein, 44 aa, Homo sapiens
MVPPVKTRFLHLPGHLNAPAHTVPLPGVMELGQPLLGFSFSLGV

SEQ ID NO: 1017769 - protein, 242 aa, Homo sapiens
AASTPASRSGPFRRSRPGTGHVGKLWDAVAEGAVSASAGPRSQHVVFIASRFHGPRRPVVAPNPRRGTAQVGGQTPAPQPLPAPRPAPALRLRLRDRGLGPASASGLAWEALGQVGARGSAGLQAAGSGREGGVRAVAHLAGRAGRHVVQPLVPVGSELREAGPGAQGEVIRVRETRAAPAKLLEQALRARRRELRVPLVLLLVELVTVEVAGLEAEVVAVAEERLPRHLPRGREVLHGARA

SEQ ID NO: 1017770 - protein, 135 aa, Homo sapiens
LLLAPRPGMFLAMGRSRRTAAPRASLARQMKATAAPTLDEIHRELRLRDPHDPSPTQTPSSTPTCQGAACTLSGLREVLHRFHQPEPLPQRQEKAEAAELRALQSGRGGEGSGYGILCAPQAAQCHGKFPLRLEM

SEQ ID NO: 1017771 - protein, 96 aa, Homo sapiens
ADKLQLIQLMTHDASERPSQDRVSRPPDPQAICFHEDDPFFYGEHLRKRGLFVAELLFITGIIILTSGKCRQLSRLMPESLQVSPSETGADNPLGT

SEQ ID NO: 1017772 - protein, 229 aa, Homo sapiens
GSELIFASTGARAVAHSPQPTAMGWDLTVKMLAGNEFQVSLSSSMSVSELKAQITQKIGVHAFQQRLAVHPSGVVLQDRVPSCPAQGTVVPWSALVLLAGGDIDATNLWNILVRNNKGRSSSYEVRLTQTVANLKQQVSGLEGVQDDLFWLTFEGKPLEDQLPAGEEYGLKRPEHQVHEVCACGEAAQSLAGGAKGLHQTSEAGSRAGNKGCCTRRNKHNTKTHKQKQR

SEQ ID NO: 1017773 - protein, 311 aa, Homo sapiens; identical to SEQ ID NO: 884578

SEQ ID NO: 1017774 - protein, 336 aa, Homo sapiens
ATADERGVLESRTRSRHRAPRLPPAMPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYKGTVPRLGRVCLDVAIVFVIYDEVVKLLNKVWKTD

SEQ ID NO: 1017775 - protein, 311 aa, Homo sapiens
ATADERGVLESRTRSRHRAPRLPPAMPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHKYRNTWDCGLQILKKEGLKAFYLPLSHMIPVQ

SEQ ID NO: 1017776 - protein, 311 aa, Homo sapiens; identical to SEQ ID NO: 1017775

SEQ ID NO: 1017777 - protein, 336 aa, Homo sapiens; identical to SEQ ID NO: 1017774

SEQ ID NO: 1017778 - protein, 336 aa, Homo sapiens; identical to SEQ ID NO: 1017774

SEQ ID NO: 1017779 - protein, 112 aa, Homo sapiens
MCPPCGLCVTPPLCPSVWPSHGWMCIWPMTLCPLVHVLTVNPVPVFHVLCHVTLCPASRGARVAWVLGPVALARSQSGAFHPALAYHSCLRASAWLHRIPGAAAPCFSRHWP

SEQ ID NO: 1017780 - protein, 336 aa, Homo sapiens; identical to SEQ ID NO: 1017774

SEQ ID NO: 1017781 - protein, 311 aa, Homo sapiens; identical to SEQ ID NO: 884578

SEQ ID NO: 1017782 - protein, 211 aa, Homo sapiens [sequence omitted]

SEQ ID NO: 1017783 - protein, 365 aa, Homo sapiens
GFRLDVCWARRDPQERRERGTRVQSSGTWIGAGAMGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 1017784 - protein, 274 aa, Homo sapiens
GFRLDVCWARRDPQERRERGTRVQSSGTWIGAGAMGGEQEEERFDGMLLAMAQQHEGGVQELVNTFFSFLRRKTDFFIGGEEGMAEKLITQTFSHHNQLAQKTRAGDEMMMALACDVPDAGRVMNGWDAGLCHDLCQWKPHVMDDLSVPPGVNVDANLIEGWHDDVACMLMQDFGPTQNWDCQKTSMKGPMSSKEDWVQSFDIPPYERAMPEKYPMSDVNDINVTGTALKTGTNCSKTLTPPSLMQPCGRTLSKITRVTQNPCPELVPGRSLSG

SEQ ID NO: 1017785 - protein, 365 aa, Homo sapiens; identical to SEQ ID NO: 1017783

SEQ ID NO: 1017786 - protein, 132 aa, Homo sapiens
GSAAQKQKISFLENNLEQLTKVHKQLVRDNADLRCELPKLEKRLRATAERVKALESALKEAKENAMRDRKRYQQEVDRIKEAVRAKNMARRAHSAQIAKPIRPGHYPASSPTAVHAIRGGGGSSSNSTHYQK

SEQ ID NO: 1017787 - protein, 110 aa, Homo sapiens
FASHADFRSESVGQGARRCLSGLGEQTLGYRPGENVKGMKSSRGEDYWIRLLTARSKHFLKMERFNGRVCVSCSRVVTLHTPSYARMKNLYSPPPATAARATHLKLMSLR

SEQ ID NO: 1017788 - protein, 92 aa, Homo sapiens
FASHADFRSESVGQGARRCLSGLGEQTLGYRPGENVKGMKSSRGEDYWIRLLTARSKHFLKMERFNGRVCVSCSRVVTLHTPSYARMIMSLR

SEQ ID NO: 1017789 - protein, 112 aa, Homo sapiens
MASSSGSKAEFIVGGKYKLVRKIGSGSFGDIYLAINIANGEEVAGKLGAEKARHPQLLYESKLYKILQGGVGIPHILWYGQEEDYKVLVMDLLGPSLEDLFNFCARRFTMRT

SEQ ID NO: 1017790 - protein, 112 aa, Homo sapiens; identical to SEQ ID NO: 1017789

SEQ ID NO: 1017791 - protein, 135 aa, Homo sapiens
ATLLPVHKRPSLLCLNMANKGPSYGMSAEVQSKIEKKYDEELEERLVEWIVVQCGPDVGRPDRGALGFQVWLKNGVILSKLVNSLYPEGSKPVKVPENPPSMVFKQMEQVAQFLKAAEDYGVIKTDMFQTVDLYE

SEQ ID NO: 1017792 - protein, 106 aa, Homo sapiens
IFFKRLSLVLSSRLECNSTIIAYCSLKLLASSNPPASDPQVAGTTAMWHYTWLIFKTFLVEMGFRHVGQAGLELLTSGDPPTSASQSARITGVTYRAGRTSCFLAE

SEQ ID NO: 1017793 - protein, 229 aa, Homo sapiens
MNLERVSNEENIGTLCRKYYLGGVCFLPFLWLVNIFLFFREALPCSQPTPEQEPKSTGYVVALKLWGFLFWVIVLTFLITIFQIYPAPVWCPCGEIPLSSPYPVVHPLKKCLQNTGALCNSSQDRLLKARGAWYWEALSSDSPKELVSSGPHGSLVTIPQRRDPELTKNTTTQRKKRGGRRRTESLKPAWEGPTEAANGPGTRDRQEGGSTKNGDGLDTQPERQKATNR

SEQ ID NO: 1017794 - protein, 229 aa, Homo sapiens; identical to SEQ ID NO: 1017793

SEQ ID NO: 1017795 - protein, 102 aa, Homo sapiens
RFTVFNNAHAFGGGKGAFQIVGEIFCTAGRGENSQCHCCADSQVGNAEVAAANSVPTSTVVTTKRRRPSQRLRRIPECGGSRKSINLFGNTVSFGEATIPIA

SEQ ID NO: 1017796 - protein, 447 aa, Homo sapiens
MESGIVKITSLDGHAYLCLPRSQHEFTVHFLCKVSQKSDSSAVLSETNNKAPKDKLVEKTGKICIRGNLPGQRLKNKENEFHCQIMKSKETLKKMSCVNGTEGREELPSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTYRLTHQNMNSIEIYSGDGSVFKSEGAYFGNYFTYYSIQEGSGKREEKTYSVNNLPPDRPGSPFTVGSLIKQATRILQHCVKMRLSLSHNYRICCWKMVPGINDSNILPLVLKESLIPSVGRFLAYSDDKVHAIFLDGITLTLNWNFSSPIEKRQVNQGLNLGWCKLTFPDGQEQLIQIEHPEPYERYVTTVTSWCRRLTQTSPREMPTHSSSSVLQENWYLSF

SEQ ID NO: 1017797 - protein, 564 aa, Homo sapiens
MAAELRMILYEDDSVQVQYVDGSTLQLSPCGSEFLFEKSPPVSAHPLEQPERIRQRTHFVISTYREQLQRALDFRNSSATCPFLSETIIPSERKKHIFIDITEVRWPSLDTDGTMIYMESGIVKITSLDGHAYLCLPRSQHEFTVHFLCKVSQKSDSSAVLSETNNKAPKDKLVEKTGKICIRGNLPGQRLKNKENEFHCQIMKSKETLKKMSCVNGTEGREELPSPGTKHTCVYTWVKQCWSVAACPEEWKYPLSLALHFHNKISNMSKIDAHITQSRFLTSDISEERGKVVSVLPRALSLSCPVPHLHRWNFCDSLLQRQSDEYSYPELVKMVWYKGVTYRLTHQNMNSIEIYSGDGSVFKSEGAYFGNYFTYYSIQEGSGKREEKTYSVNNLPPDRPGSPFTVGSLIKQATRILQHCVKMRLSLSHNYRICCWKMVPGINDSNILPLVLKESLIPSVGRFLAYSDDKVHAIFLDGITLTLNWNFSSPIEKRQVNQGLNLGWCKLTFPDGQEQLIQIEHPEPYERYVTTVTSWCRRLTQTSPREMPTHSSSSVLQENWYLSF

SEQ ID NO: 1017798 - protein, 268 aa, Homo sapiens
HSFLNVTQYVVKPKNPANPVHRILGEQLDATRVSLRVRWCPSIILTRGAALITESLDCGPREDISSCNHPEKCNRKDIAPTLTLYVGKKQLVEIEKVVSTPNYSQVDIGLIKLKQKVSVNERVMPICLPSKDYAEVGRVGYVSGWGRNANFKFTDHLKYVMLPVADQDQCIRHYEGSTVPEKEDTEEPCRGAAHTELNTPSVLALSKYQEDTCYGDAGQCLCRSRPGGGHLVCDWDLKLDKSCAVAEYGVYVKVTSIQDWVQKTIAEN

SEQ ID NO: 1017799 - protein, 112 aa, Homo sapiens
KKKFQFYLERSHFQHTCCLATLSRGDHSSQLTAALSTSQTCSPSTCPPWHLPLSHIMRAESRGLFLRTLEVQHGPGRARRRIRSVPEDMQQLLLISVKCVKPCTGLWTTLSC

SEQ ID NO: 1017800 - protein, 320 aa, Homo sapiens
ERSGIMRESALEPGLCPRRRLGGPVHAVTVVTLLEKLASMLETLRERQGGLARRQGGLAGSVRRIQSGLGALSRSHDTTSNTLAQLLAKAERVELARQAPPKSARCAAQPQVQRLEANHGLLVARGKLHVLLFKEEGEVPASAFQKAPEPLGPGGPVRAWAQEQPEGRKLEESSERRSRWSPGAQQAVGSTGLQEGTEPFRKGPFRGRKGPEAPTIHSRSEPRRLGPGPERKKPRRNAQTCAWSPRWSQSLRRTTEEDPGRTGAAEKALGPIGRVLALKGWMFGLTTLVLVPLYQNKSFRPYNHAYEGGNPINKGGALDY

SEQ ID NO: 1017801 - protein, 95 aa, Homo sapiens
CPIIDMASAWAKRARGNVFMYHAPENYGHGSLELLADVQFALGLPFYPAYEGQFFLEEKSLSLKIMQYFSHFIRSGNPNYPYEFSRKVPTFANPL

SEQ ID NO: 1017802 - protein, 182 aa, Homo sapiens
SGRRARRGLKMAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKAEPNYRSQT

SEQ ID NO: 1017803 - protein, 195 aa, Homo sapiens
QDPPSGDRLSSLRRLGLVYFLYLFLFSGLENTLSSFTHQRFQFSSLQQGKMFFLIGLTMATIQGAYARRIHPGGEVAAVKRALLLLVPAFLLIGWGRSLPVLGLGLLLYSFAAAVVVPCLSSVDAGYGSPGQKGTVMGTLRSQGALARAAGPLKTTWGDWLAGAQACFTTWSGLFLLPFFLLQKLSYPAQTLKAE

SEQ ID NO: 1017804 - protein, 236 aa, Homo sapiens
QDPPSGDRLSSLRRLGLVYFLYLFLFSGLENTLSSFTHQRFQFSSLQQGKMFFLIGLTMATIQGAYARRIHPGGEVAAVKRALLLLVPAFLLIGWGRSLPVLGLGLLLYSFAAAVVVPCLSSVDAGYGSPGQKGTVMGTLRSQGALARAAGPLKTKGAGGPPGEGAGRRRGRLGAKHQPPPPKRQPPRGLGDATVSPQWTGWLGAQACFTTWSGLFLLPFFLLQKLSYPAQTLKAE

SEQ ID NO: 1017805 - protein, 250 aa, Homo sapiens
IELVPLAHKDSQSTGITACATVPGLVQIKFYWNTATPTGKAKPTWLLCYNNRVEWRRSRTVWASKSKLLTSWLFIETFSDPQPKSSQADGTGLGFPVLVWLAPLSPDCLFPAFQKQAGGLGKKWNLQGVISPKPMLKDAMPSTRLFCALHRTGGLEQGRWTFRLEPGFLWWDVLWVPRPPYCIFRDRIWLGLRVYLALSDLYSGEIDVSFPDTDVAKQTGSGAGFAKARHGSGGLDRAPANSCCLTKDRM

SEQ ID NO: 1017806 - protein, 108 aa, Homo sapiens
GNISNVDTNGEHLESYEAEISTRPCLALAPDSPDNDLRAGQFGISARKPFTTLEVTVAPVCVYRILSAPNCMKCEARFTFTKRRHHCRACGKVFLCFPAVSPENVNLF

SEQ ID NO: 1017807 - protein, 236 aa, Homo sapiens
ARPSVDIYPLALRPCRIAEIQAQRDTREPTMAPFEPLASGILLLLWLIAPSRACTCVPPHPQTCFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGCDLQSLGSQIA

SEQ ID NO: 1017808 - protein, 388 aa, Homo sapiens
MASLLGAYPWPEGLECPALDAELSDGQSPPAVPRPPGDKGSESRIRRPMNAFMVWAKDERKRLAVQNPDLHNAELSKMLGKSWKALTLSQKRPYVDEAERLRLQHMQDYPNYKYRPRRKKQAKRLCKRVDPGFLLSSLSRDQNALPEKRSGSRGALGEKEDRGEYSPGTALPSLRGCYHEGPAGGGGGGTPSSVDTYPYGLPTPPEMSPLDVLEPEQTFFFLPLPGGAWPSPPDSPTCQGTRTHRSTPKPSPCCHPLGSLALGQSPGVSMMSPVPGCPPSPAYYSPATYHPLHSNLQAHLGQLSPPPEHPGFDALDQLSQVELLGDMDRNEFDQYLNTPGHPDSATGAMALSGHVPVSQVTPTGPTETSLISVLADATATYYNSYSVS

SEQ ID NO: 1017809 - protein, 111 aa, Homo sapiens
MASLLGAYPWPEGLECPALDAELSDGQSPPAVPRPPGDKGSESRIRRPMNAFMVWAKDERKRLAVQNPDLHNAELSKMLGKVVGRGRWNSILFVDYSLRGRRRLVCILLGL

SEQ ID NO: 1017810 - protein, 189 aa, Homo sapiens
GRPKLINQGPGRGCGLSWTPRPVRGPGPRLPRQAKRGDPRAAMASLLGAYPWPEGLECPALDAELSDGQSPPAVPRPPGDKGSESRIRRPMNAFMVWAKDERKRLAVQNPDLHNAELSKMLGEERAAERAGGRGRAAGGWRHCRAGASAEPVEDPARGTRALFVPAWLAICASVGARGAQDSERGHLAR

SEQ ID NO: 1017811 - protein, 122 aa, Homo sapiens
MRLCLKQLPSTLSTYVLPAYTFRQTSLCARAILVTAVYFSGPPQYPVSPGFLTVPACIPVGAPLCDTPFLLCETPPHRCGCRGTHHCLGQSLCLPDAVRSSLVVVVRRACDGVLSIVWGAAH

SEQ ID NO: 1017812 - protein, 53 aa, Homo sapiens
MAELQMLLEEEIPGGRRALFDSYTNLERVADYCENNYIQSADKQRALEETQSL

SEQ ID NO: 1017813 - protein, 112 aa, Homo sapiens
VKGEARPADFPADPPVASCRAVEPILSNASKVSEADAEAATFRANDHQHIRYNPLQDEWVLVSAHRNEGGPGQGSTVGRPKLSEEQVPRHDPFFKPSGVPGAIRSQEKVKPV

SEQ ID NO: 1017814 - protein, 99 aa, Homo sapiens
PGAVAHSILQALWRGQSKLILSPGVRNWPVQHGETLTLLKLQKLAGCGGAFLQSQLLRRLRHENHLNPGAGDYSELRLCHMHSSLGERVKLCLKNNKIK

SEQ ID NO: 1017815 - protein, 185 aa, Homo sapiens
MLPLSLLKTAQNHPMLVELKNGETYNGHLVSCDNWMNINLREVICTVQGLGTKFWRDALKCYIQRHAPSMYLRIPNKIINMVNGGVWWPMAAAAEACSIISIIKATAWAALAEVCLVAGANVGSQTHAYAIHIIILAYMLTNSERPPIPAAAPPPTKVANSTPQSQTDLLIKEDACTMGNPLHNL

SEQ ID NO: 1017816 - protein, 103 aa, Homo sapiens
MLPLSLLKTAQNHPMLVELKNGETYNGHLVSCDNWMNINLREVICTVQGLGTKFWRDALKCYIQRHAPSMYLRIPNKIINMVNGGVWWPMVPAGLRECHCMHA

SEQ ID NO: 1017817 - protein, 120 aa, Homo sapiens
MFKFHQMKHIFEILDKMRCLRKRSTVSFLGVLVIFLLFMNLYIEDSYVVEGDKQLIRETSTHQLNSERYVHTFKDLSNFSGAINVTYRYLAATPLQRKPTQEAEEAKAQESPEPGRWRLQ

SEQ ID NO: 1017818 - protein, 544 aa, Homo sapiens
SGRITHASRLHRALLDLAERMFSLSLGINWFLYSTDYDSVFLKRQVLTTLPRLVSSSGPQAILPPQPPKALKLQTKRMFKFHQMKHIFEILDKMRCLRKRSTVSFLGVLVIFLLFMNLYIEDSYVVEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIARKIKVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSTYLRLGEFKNGTLKCQGVNPKIPFDIPCMRIYVTKTQKEW

SEQ ID NO: 1017819 - protein, 117 aa, Homo sapiens
RREDGRPAPDEEAGEAAASRMEQMKQRIAEENIMKSNIDKKFSAHYDAVEAELKSSTVGLVTVNDMKAKQELVKEREQLAKKEQFKELQMKLEKLREKERKKEAKRKISSLSFTLEE

SEQ ID NO: 1017820 - protein, 201 aa, Homo sapiens
RLSGNGSVGRNSNQRFHAAWSRMRSSNEEVAANCWKAAAETADIDSVHRRPRAQGTRSPASSRCHLPERITTREVTPLDQQPLDIQPVLRHDKEVLWTCMHGSPKTTSLAAFAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 1017821 - protein, 201 aa, Homo sapiens; identical to SEQ ID NO: 1017820

SEQ ID NO: 1017822 - protein, 110 aa, Homo sapiens
GENYDDKLRGMGGPVRWVTPILCPKGLPCPPWETCRIYCWVGERQAPPCRPFPAGPSNVMRFQSLGQNPDELDLSAGDILEVILEGEDGWWTVERNGQRGFVPGSYLEKL

SEQ ID NO: 1017823 - protein, 184 aa, Homo sapiens
GLEPTFALIRKMNLCWSNTKKEEKELERRKELKKIRVKYGLQNTEYEDEKTLKNPKYKDRAGKRREQVGSEGTFQRDDAPASVHSEITDSNKGRKMLEKMGWKKGEGLGKDGGGMKTPIQLQLRRTHAGLGTGKPSSFEDVHLLQNKNKKNWDKARERFTENFPETKPQKDDPGTMPWVKGTLE

SEQ ID NO: 1017824 - protein, 184 aa, Homo sapiens; identical to SEQ ID NO: 1017823

SEQ ID NO: 1017825 - protein, 184 aa, Homo sapiens; identical to SEQ ID NO: 1017823

SEQ ID NO: 1017826 - protein, 109 aa, Homo sapiens
LDDRCMPPCLAHFSTLGRDGGAPCSSSWYQHSWPQAVCFPWPPQVLGITGVSPCARRIPFNFAETISHSPFSASSYLLLPPPGLLCMTDSQLAASVELSVLTGNSLTLL

SEQ ID NO: 1017827 - protein, 79 aa, Homo sapiens
GSGVLGVRGAVRRVGPSGSAEVGTCCRPECYRLLDLWMRKRILRRRIVLNWFPLRRRKARRRKSLASAPRSQSQLSPGI

SEQ ID NO: 1017828 - protein, 113 aa, Homo sapiens [sequence omitted]

SEQ ID NO: 1017829 - protein, 411 aa, Homo sapiens
MLPAVGSVDEEEDPAEEDCPELVPIETTQSEEEEKSGLGAKIPVTIITGYLVIQRLSAEKDEQISWSQNNVFQTCPLGPFPYCSLGAGKTTLLNYILTEQHSSLAVSQGGELYEEWLELRNGCLCCSVKDNGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 1017830 - protein, 429 aa, Homo sapiens
MLPAVGSVDEEEDPAEEDCPELVPIETTQSEEEEKSGLGAKIPVTIITGYLVIQRLSAEKDEQISWSQNNVFQTCPLGPFPYCSLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 1017831 - protein, 113 aa, Homo sapiens [sequence omitted]

SEQ ID NO: 1017832 - protein, 395 aa, Homo sapiens
MLPAVGSADEEEDPAEEDCPELVPMETTQSEEEEKSGLGAKIPVTIITGYLGAGKTTLLNYILTEQHSKRVAVILNEFGEGSALEKSLAVSQGGELYEEWLELRNGCLCCSVKDNGLRAIENLMQKKGKFDYILLETTGLADPGAVASMFWVDAELGSDIYLDGIITIVDSKYGLKHLTEEKPDGLINEATRQVALADAILINKTDLVPEEDVKKLRTTIRSINGLGQILETQRSRVDLSNVLDLHAFDSLSGISLQKKLQHVPGTQPHLDQSIVTITFEVPGNAKEEHLNMFIQNLLWEKNVRNKDNHCMEVIRLKGLVSIKDKSQQVIVQGVHELYDLEETPVSWKDDTERTNRLVLLGRNLDKDILKQLFIATVTETEKQWTTRFQEDQVCT

SEQ ID NO: 1017833 - protein, 216 aa, Homo sapiens
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQALINVIKVSELDGRKMGDAQPEMFDKVLVGCSVFK

SEQ ID NO: 1017834 - protein, 220 aa, Homo sapiens
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQALINVIKVSELDGRKMGDAQPEMFDKVLLLHCDKLMDAQ

SEQ ID NO: 1017835 - protein, 301 aa, Homo sapiens
GTKLLKAGLRRHGGYPESLAGRARFRRRHSLWVRDPGGGGPRPYWPGAGPRFRLGAGGTGAAGGGEVPASPRALSLKQGLVPRRSRPRPLGAGCPAAACAEALVSSYPLLGAQRQVFSSPGPLVPSLVTYFIISLESSACLQAVIVLGVSFLGVRSSSKPATWPGCPCDQREEGWALHDVDLRRFKTYILLPRMVLSLVLFPQHPETTETSNPIPEKFGGKMEAPGGPGQDPDVWKPMEQIRNLHEEFQSPGQFQVVKDDVSLMCRRVEKQFYPIGQKREQIKVLEGGATEASGGNKSRAR

SEQ ID NO: 1017836 - protein, 98 aa, Homo sapiens
IALVVPPRGLDPKLRPLSILNNGKGLPLVALRLLHLSDFPDQGGRIGVQPGFPSMATIPLAQCSALPRASVSPSVELSVASTSKMWTLVRSRWLTPGL

SEQ ID NO: 1017837 - protein, 111 aa, Homo sapiens
IALVVPPRGLDPKLRPLSILNNGKGLPLVALRLLHLSDFPDQGGRIGVQPGFPSMATIPLAQCSALPRASVSPSVELSVASTSKMWTLVRSRWLTPVSNPSTLGDQGGPIT

SEQ ID NO: 1017838 - protein, 133 aa, Homo sapiens
MRLGDTGWSFTSFLLDPGLAGEGGSGTGLTCSDPRCRATRDTLWLHSRAAATKRLAPPPTGAGFEDARLPRGSSSAGLCSYVHSFDITSRGCVRSCVVSISHPLCAALLPASRMYNVEIHGTKFLQRPCRMVP

SEQ ID NO: 1017839 - protein, 298 aa, Homo sapiens
WDPGHRVRHKGRPGEHSTARSSYQQGPQGPGQAHAGVRHLEASIVPGHRPGGLGIKGYGQNACAIPETTVVIVTWWNVAPAAFAFRPWTLRVMGSAPPGPLLPSSVLDLGLPVTQPVSCLCTVSCPLGIPQSHPTPPKSKLQVRPCPESFSRCDLAYPGRLPCHDSNSLPIRAQGTWAVARLGRLKNLRMEAAVRGPDGAHHPGPKSSSWRASRLLPGYRAEAITMDAYVGRDLECGTTSPSPARNPSHSHGDTSAPITQREQDGAQRLLDTGPSPLSRDPPLMTDSTPLTLGSDPVG

SEQ ID NO: 1017840 - protein, 66 aa, Homo sapiens
SLQENGKKPKHPKGLVPVEDIKAKMQASKKKRIEQRAPTCKLSPKMGRKEKESQKIVHTEVINNPD

SEQ ID NO: 1017841 - protein, 137 aa, Homo sapiens
FGTEGRESEFSRVLPKLVWNSWAQAILPPPSVEIIGMSRGQFGQGQEPLDMFFWVNEISGEITYPPQKADAPAVSPESPQKKPPFQPRSVQEAPCSPQGPPAQRPALAPPSKPSLKDSGSRNPCPSAPTWARPKPEE

SEQ ID NO: 1017842 - protein, 274 aa, Homo sapiens
HQSLLSSDDQIFIYETAGVLIVNSEYPAERKQALMRNLLTPLMEKFKILLEKLMLAQDEERQASLADCLNHAVGFASRTSKAFSNKQTVKQCGCSEVYLDCLQDILASPQLSLTKGYSQKWSPYFPSSNDYCLEEEVLPFIPSASEHMLKDCEAKDLQEFIPLINQITANSRYRYPRFYNRCSCPCFMQFLEVLLRPAEENDQSAALEKQMLRRSYFAFLQTVTGSGMSEVIANQGAENVERVLVTVIQGAVEYPDPPNQQHHQTAAPPGQQTT

SEQ ID NO: 1017843 - protein, 271 aa, Homo sapiens
HQSLLSSDDQIFIYETAGVLIVNSEYPAERKQALMRNLLTPLMEKFKILLEKLMLAQDEERQASLADCLNHAVGFASRTSKAFSNKQTVKQCGCSEVYLDCLQDILASPQLSLTKGYSQKWSPYFPSSNDYCLEEEVLPFIPSASEHMLKDCEAKDLQEFIPLINQITANSRYRYPRFYNRCSCPCFMQFLEVLLRPAEENDQSAALEKQMLRRSYFAFLQTVTGSGMSEVIANQGAENVERVLVTVIQGAVEYPDPIAQKHMFYHPLKSW

SEQ ID NO: 1017844 - protein, 177 aa, Homo sapiens
DKEKIKIIRELQLTKRVGRSASSSNCCLQFLEGSGEKNAPTAVLRKRQEEMRPLDIDEVEAPEEVEVLEPEEDFEQFLLPVINEMREDIASLIREHGRAYLRTRSKLWEMDNMLIQIKTQVEASEESALNHVQHPSGEADERVSELCEKAEEKAKEIAKMAEMLVELVWRIERSESS

SEQ ID NO: 1017845 - protein, 177 aa, Homo sapiens; identical to SEQ ID NO: 1017844

SEQ ID NO: 1017846 - protein, 177 aa, Homo sapiens; identical to SEQ ID NO: 1017844

SEQ ID NO: 1017847 - protein, 115 aa, Homo sapiens
NIRSGSEARVLSDVTFTFCRIVRPRQPPGTDPHPSPLITLETQKDTRIKLMKTHGRTSVSGTLEVKSYLLGVEQQNPWMVLSLTFLYPSLWTPPHQPFKTLMGKRSCRPVALAST

SEQ ID NO: 1017848 - protein, 147 aa, Homo sapiens
LVGRAEAGALGSARPAAIRGGTRRRATIMPGHLQEGFGCVVTNRFDQLFDDESDPFEVLKAAENKKKEAGGGGVGGPGAKSAAQAAAQTNSNAAGKQLRKESQKDRKNPLPPSVGVVDKKEETQPPVALKKEGIRRVGRRPDQQLQG

SEQ ID NO: 1017849 - protein, 81 aa, Homo sapiens
SGHVDKFDFMVKDVKNGEFRADHLLKAHLQKLMSDKKCSVEKKSEMESVFGPSLYYTMDMQDTCGIFFVYYNVKSITGNDL

SEQ ID NO: 1017850 - protein, 169 aa, Homo sapiens
GISNELPDIGDAAWLEDYLRTPMSSGNLRALGPTRLYPMNKLLCWSPSVSRKSFNIKLLGGLPKITQALLKTQRSGNPNRFGDEMGKTRAAPRREERPENPEIGLVKGADQVPGAAPRPVRLPSPPARTVPTPRSSSPSPPAPPCTADPGPPGKRPGLTWLGALGRSQV

SEQ ID NO: 1017851 - protein, 208 aa, Homo sapiens
KAAAAVAFGAEVGVRLALFAAFLVTELLPPFQRLIQPEEMWLYRNPYVEAEYFPTKPMFVIAFLSPLSLIFLAKVLKKADIKRQQTSLPGCQPCLLSLIFLAKFLKKADTRDSRQACLAASLALALNGVFTNTIKLIVGRPAPRISFYRCFPDGLAHSDLMCTGDKDVVNEGRIELHPVGHSSVYEYTYGSLPYAVVFHIIEFNLERD

SEQ ID NO: 1017852 - protein, 195 aa, Homo sapiens
MAWETGHLNEVVRASEVDRVRTGSRQRKATLPSKVIREWRRTARSAMLTRLKITFLCSRGSYADTGFFRAAPPDDEHSVRFSLSEVSIENKALHIAVQVFIAASVTAHSAVLVIEDSLRSRWCDLSGIGCCQAHVQQQCAPSSSERHVVALGPLGLQQKTLLLGLEAEGEHVHRLRLTPRGKRRRWHRRRRNRVC

SEQ ID NO: 1017853 - protein, 91 aa, Homo sapiens
VWRMPLFEHYTRQVVDCQLADVNNIGKYRSAGACTAAAFLKEFVTHPKWAHLDIAGMMTNKDEVPYLRKGMTGRPTRLSSRFLLRFNQDNA

SEQ ID NO: 1017854 - protein, 79 aa, Homo sapiens
LPQPRIARLDRFIVLQHITFAPIAVTQPEEALVTDSGLEDRAKRAPRSPDCLFHEDWSLPFVNVMCHYILHVSLGMHLL

SEQ ID NO: 1017855 - protein, 137 aa, Homo sapiens
IVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKENPGSGEYDFRYIFVEIESYPRRTIIIEDNRSQDD

SEQ ID NO: 1017856 - protein, 126 aa, Homo sapiens
IVVLFGISITGGLFYTIFKELFSSSSPSKIYGRALEKCRSHPEVIGVFGESVKGYGEVTRRGRRQHVRFTEYVKDGLKHTCVKFYIEGSEPGKQGTVYAQVKEVWESWDVGSEVLSAVLFKFWKGK

SEQ ID NO: 1017857 - protein, 137 aa, Homo sapiens; identical to SEQ ID NO: 1017855

SEQ ID NO: 1017858 - protein, 221 aa, Homo sapiens
LGHLLPLSSPDSGILSSEPTIWGPAFRHHPKGFPTFACPGVCPQGPLSGHGQKGPGPGSWGCGHSALSWITPVGDRSERAEAPCGVAPQARITGGSSAVAGQWPWQVSITYEGVHVCGGSLVSEQWVLSAAHCFHSEHHKEAYEVKLGATKTPTPRTQGQHLKDIIPTPATPGGLQGDIALNSADHTFSATSAICSQQRSSQRLTDCTGWGMWPVSSDAKH

SEQ ID NO: 1017859 - protein, 119 aa, Homo sapiens
MTGDEATQSQAVQEPGPAPDAAPEGCTYDRPCRWLQMADLRAETPDMLADGTRLQLAGVPVGVLRTPGLRCFYCCTGCGKVFWDGSHLGRVATHFRDMLESAPSPCEPSPAPSPASSPF

SEQ ID NO: 1017860 - protein, 174 aa, Homo sapiens
PMQQAKAVLKHFNVRVTHADIFSRCQACNCDQLPKGLQDMMKQLMWLSSHQEGPRSSGDEATQSQAVQEPGPAPDAAPEGCTYDRPCRWLQMADLRAETPDMLADGTRLQLAGVPVGVLRTPGLRCFYCCTGCGKVFWDGSHLGRVATHFRDMLESAPSPCEPSPAPSPASSPF

SEQ ID NO: 1017861 - protein, 115 aa, Homo sapiens
MAVRLGALGQPPDAVTTDAAPCVIWCCLALRGGLAGDWVSPLVPHVTALDTERGSVGGVDKGPLVTCPPDGLSSHTCTRISDRELQVGLAWEGGIHLSDSYGSIYTLRLDPSDPH

SEQ ID NO: 1017862 - protein, 115 aa, Homo sapiens
MAVRLGALGQPPDAVTTDAAPCVIWCCLALRGGLAGDWVSPLVPHVTALDTERGSVGGVDRDPWGLAPPTVSVVTPAPESLTDSCRLAWPGRAVSTLSDSYGSIYTLRLDPSDPH

SEQ ID NO: 1017863 - protein, 292 aa, Homo sapiens
LRARADVHRRGAGMGPLTLGAALHEHQPRARTEASRWLTRTLLASAPVQQMVASRHRGACGYLLSFIDAPLCTVVEGFACKFSAALPMASELGLPFLPRTCGGLSLYQKWKCLRVIARGVRGASCTLVAPKWCPVVLPTVGFQGPLTRFHVGTKWVCPSVERLGEGAPRGNPSDPSWRRLPAPPLVDDCVAKLSRAILMFDRALLNPKCERAFPCGWVLTPLDPCCTFYRHPFVLGWGGGLGPAFVDTWWTVWTPGPPLGGLSAWDKCLQGLHADVVRTRDVWGCLGGSELA

SEQ ID NO: 1017864 - protein, 122 aa, Homo sapiens; identical to SEQ ID NO: 789318

SEQ ID NO: 1017865 - protein, 86 aa, Homo sapiens
RFRGRRIDFTTVEKEDPAHFVISRKPRDSPEERLKSRKTGKSESPGACAAQSASRGCSREDPSASHCIRRPDLTYPLAFYPCAAVA

SEQ ID NO: 1017866 - protein, 272 aa, Homo sapiens
EFKPLLLNDLLMVLSPRLDHTRAVNYLQAKVKQLPLVKPHYAFSSEPVNNKSVNESLYQDFLLQEEDYQALRASLDAFDKFEKLSLAQSLEKNMNSLSSEEIAAYLFDRQQDAGNRVYELCTERQPLQGMQCSMLLNLGILIVWAEELLQWFCRKKKESAWSLSVYLLRSFKARCRPRNCMEAQYHGFAMPYFIQVMKEYFDKVATLDGSESLRTRRKNKLQRHNQCLWSSPSVMLAAGASVAVPPQATLVYGYTAPAVWTATRLVWVRHVE

SEQ ID NO: 1017867 - protein, 542 aa, Homo sapiens
SNTPGSYTDVSASSGYHLFQLTENHCEDIDQCDFPADCVGGDGININGSYRCLCPQGRSAGGWHEMPTHRSVQPRYPETMLTFPYGGACQEPFDGHPYDVCLAHEGFDRTLPEVPARVVREVEAVPTTETECYLNFDRLQWFFAELGSNYGHPKRDTQTRSAACSLGAGWGDHCEICLFSRSPAAAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKGRLRGAAGPHGGLRSPAPPADGAATPPSAQTSVITGGISREARAHFWPRLVGSGPRDPSGPGEPFPGRLENPEAPLTGPPSPG

SEQ ID NO: 1017868 - protein, 350 aa, Homo sapiens
CAQPTPPGCSCGTGAASVCHPADIDECMLFGSEICKEGKCVNTQPGYECYCKQGFYYDGNLLECVDVDECLDESNCRNGVCENTRGGYRCACTPPAEYSPAQRQCLSPEEMERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKGRLRGAAGPHGGLRSPAPPADGAATPPSAQTSVITGGISREARAHFWPRLVGRDPGPFKGPENPSRGALRTPRGPYGAPIPG

SEQ ID NO: 1017869 - protein, 589 aa, Homo sapiens
SNTPGSYTDVSASSGYHLFQLTENHCEDIDQCDFPADCVGGDGININGSYRCLCPQGRSAGGWHEMPTHRSVQPRYPETMLTFPYGGACQEPFDGHPYDVCLAHEGFDRTLPEVPARVVREVEAVPTTETECYLNFDRLQWFFAELGSNYGHPKRDTQTRSAACSLGAGWGDHCEICLFSRSPAAAEFHSLCPDGKGYTQDNNIVNYGIPAHRDIDECMLFGSEICKEGKCVNTQPGYECYCKQGFYYDGNLLECVDVDECLDESNCRNGVCENTRGGYRCACTPPAEYSPAQRQCLSPEEMDVDECQDPAACRPGRCVNLPGSYRCECRPPWVPGPSGRDCQLPESPAERAPERRDVCWSQRGEDGMCAGPLAGPALTFDDCCCRQGRGWGAQCRPCPPRGAGSHCPTSQSESNSFWDTSPLLLGKPPRDEDSSEEDSDECRCVSGRCVPRPGGAVCECPGGFQLDASRARCVDIDECRELNQRGLLCKSERCVNTSGSFRCVCKGRLRGAAGPHGGLRSPAPPADGAATPPSAQTSVITGGISREARAHFWPRLVGSGPRDPSGPGEPFPGRLENPEGPLTGPPSPV

SEQ ID NO: 1017870 - protein, 198 aa, Homo sapiens
LGKTLQVISFIDVLFRHTPAKTVLAIVPVNTLQNWLAEFNMWLPPPEALPADNKPEEVQPRFFKVHILNDEHKTMASRAKVMADWVSEGGVLLMGYEMYRLLTLKKSFATGRPKKTKKRSHPVIIDLDEEDRQQEFGEQFEKALCRPGPDVVICDEGHRIKNCQASTSQALNNIRSRRRMVLTGYPLHNNSLSTGAWL

SEQ ID NO: 1017871 - protein, 226 aa, Homo sapiens
MTKGLVLGIYSKEKEDDVPQFTSAGENFDKLLAGKLRETLNISGPPLKAGKTRTFYWACIRTFPPWCVGPAKQGPGEHGKPGLMAKKSLLLPRGAGFTGSRLWWIPVGTLLLRRCLVSLRPAKKKNGCVGAWGSGLKSPVCFWKLGPENAANKITTQFAEIIRISKVLVVKPRSISDPSLGLRNRQWDHSSVWPKDLTSPQSSWKFTTKAAPMQTNHPWCLLGKYL

SEQ ID NO: 1017872 - protein, 173 aa, Homo sapiens
MDDEEGEGEEDDDDDEEEEGLEDIDEEGDEDEGEEDEDDDEGEEGEEDEGEDDYNRTLMDSNLPFFKFSPVPGSKLQSFFFFFFPLLWLSRPVFLRSLFSTPGFSIYWGGNTLSRIQWGKESLPLFCPKVHFYPFLSEQNLFGINTTELVVGKKKNRVPFALRGTLEGARPRV

SEQ ID NO: 1017873 - protein, 82 aa, Homo sapiens
MDDEEGEGEEDDDDDEEEEGLEDIDEEGDEDEGEEDEDDDEGEEGEEDEGEDDYNRTLMDSNLPPLIIIFIFFTFILISLLR

SEQ ID NO: 1017874 - protein, 124 aa, Homo sapiens
GEWGRATVTLVTGAARLARRQPARHGEEAVGSRRRHLREVPWKPPFIGGEVQSRWAALGASEREASKSLGGAASLAFWGPTFWGPPLRSRTLESEAIFCWRRRRRWRFPEVGLYSVSVRGKRSL

SEQ ID NO: 1017875 - protein, 94 aa, Homo sapiens
MWTFLGIAHFAPIYTEVGDFITCANREVLSVRAGVPLAWAWCSPYLLSATDNGGVSIGADKQTRSQVTPSSSDILSGLPFMASPVPHPPESNLV

SEQ ID NO: 1017876 - protein, 225 aa, Homo sapiens
MAYKAGLRHFQAFPLCWHGLDVYGASPETSCWLEVSAQFSSCQRTKAQQGRFLRLRWTGDCLQGSGGAIDRGPCLQQMLQTIHLGVAIQQQHFPPKADDKSPWTVQRGETLAAPRQVRMRRLALARENLKTAGTSGPALGSRAPAPVTPEQPNPQRPGPCPAPPRPHVHKHWHVEPGAGGRGRGRAREAIRRLASCGCVRPSHLGAGPAAAPRSLSGVRRVSQWA

SEQ ID NO: 1017877 - protein, 43 aa, Homo sapiens
MTQILSRASRSLNGVGNRSPTQVLSTSSFFPYPGVQNLRLEVD

SEQ ID NO: 1017878 - protein, 48 aa, Homo sapiens
MAPPVRVTLYAKSQNCLAENIKWMLECYFSVALGNKHFAFLTVQAPAF

SEQ ID NO: 1017879 - protein, 93 aa, Homo sapiens
MEKTELIQKAKLQAAKRYDDMATCMKAVTEQGPELSNEERNLLSVAYKNVVGGRSRPGGSSLASSRRPDTSDKKLQLIKDYREKVESELRSSA

SEQ ID NO: 1017880 - protein, 69 aa, Homo sapiens
FGTMGEVQDEPALPFVTVAMEKIKSPDSPSSSGGLGISKSDGSGRWRNGILLGAQEACPRDAAVHCRCP

SEQ ID NO: 1017881 - protein, 69 aa, Homo sapiens; identical to SEQ ID NO: 1017880

SEQ ID NO: 1017882 - protein, 34 aa, Homo sapiens
MCCEIYYRLLVLKMEKKSEELRNMDGLGNVEKGH

SEQ ID NO: 1017883 - protein, 34 aa, Homo sapiens; identical to SEQ ID NO: 1017882

SEQ ID NO: 1017884 - protein, 108 aa, Homo sapiens
DKCEKACREEECLALNSTWGCFYNFDNHMERLHLKLFLHLSHLHPSPQAVSFLRTRTSSFSNIIGQINEEIGCILSLYPLTSSIILLLSSRRRRNSFTGKVEEIFPFW

SEQ ID NO: 1017885 - protein, 47 aa, Homo sapiens
MWLWWYSTAGAQEAPIKKKRPPVKEEDLKGARGNLTKNQEIKSKTYQ

SEQ ID NO: 1017886 - protein, 149 aa, Homo sapiens
MLRAPGCSSGPSVAPAGPWLALLSSLARCSLLEPRDPVASSLSPYFGTKTRYEDVNPVLLSGPLRLLWLWTPELLEGVTCTPGADMVSPHSAHGNTYPTVKQIRKLRQLHGFAAGHAGPRDGRGKIVPGTAADLGCSAGRLALCWYADL

SEQ ID NO: 1017887 - protein, 110 aa, Homo sapiens
SGLQCCPDAFYITVKRLLVWLLPGLAGLAVHQINLQTPPLYFVLCRSGHTCISDCLALTTLKQPTNFFSDLFPRLLMILIPCLNKSVFSFWMCSLTPSYHHTFCSLLLQA

SEQ ID NO: 1017888 - protein, 151 aa, Homo sapiens [sequence omitted]

SEQ ID NO: 1017889 - protein, 233 aa, Homo sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCKNPFLKPTGRAPQQTAFNPFSLGFLLLRIF

SEQ ID NO: 1017890 - protein, 259 aa, Homo sapiens
SVWSAQSGHPPHPPHPSMALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCRTPQLIIPNQNPFLKPTGRAPQQTAFNPFSLGFLLLRIF

SEQ ID NO: 1017891 - protein, 259 aa, Homo sapiens; identical to SEQ ID NO: 1017890

SEQ ID NO: 1017892 - protein, 143 aa, Homo sapiens
MTSWPRLGMWLLQEGWRGRWLWEMRTGRDGPHLGLLWSGTGVYTACSLQPLRVFMEPRTNFDLYKSCTQCGLRMSVTVITAVSRCLFDSALARLFLLLLHNPPVFDSLRCTGAPCRACSAFLVDFLLLRSQSSISTLLKLSNL

SEQ ID NO: 1017893 - protein, 117 aa, Homo sapiens
MILILIIVRAEVLGASYGAHLSRLYPSSTKVDPSREAQAATEYYVKTTPPHSRTNSLTHTHGAAAPVVGLVHAQCPSAHRLCPASLRPPRAVDIWAHSSPLKAPGAQPSRSALCNAG

SEQ ID NO: 1017894 - protein, 74 aa, Homo sapiens
HFLPLDELEHSLGESAQGSWWSGALGELGKYKNQGIMSGHQGVYGHYTGALHPERDQWGPSLQSSPVLRPWPCV

SEQ ID NO: 1017895 - protein, 341 aa, Homo sapiens
RRLFELVRKPLLTPIGTVHTDLPSQLQRDKQHSKNQALNSTNGELNADDPTGHSNAPITAPARGGGGRMKPNAAVSSRGERENAAATQVTLGRVQPPESSPCLGRDLVLSLGAHPRAPRDACWKPERRLRGPGLAQAAPTPGTWGHFLHVRLWPKFLHLCLVLPSKSINYLKQGKEEKKNRGPPLPHSFPIRFFAEVSSVILEAPRGVTAARTAGQGYVCKVRALSPSIQRPFARRRGQPGRDGVLLELSCQALLGGGQALLPGVTAVAQVSPKPKGDRAEEEEDSEMKPDPPKQECCTTSSGAAGHGCCQLFPPGPGTGRWGARRMLSSLVRRRPGLTEW

SEQ ID NO: 1017896 - protein, 140 aa, Homo sapiens
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIVSEDKTLADNVASKKLKNENKDPDSCCN

SEQ ID NO: 1017897 - protein, 29 aa, Homo sapiens
ENHGLHPGLLTFEQMRISKQEHTNQAPPA

SEQ ID NO: 1017898 - protein, 342 aa, Homo sapiens
ESQRCAVCGPFLGHQFLCFPPWLPPSPGSQLLLALVRPLPCGLSGFSGLNLRSATSMLTKPLQGAYPVPARGPHASLQEARIGKRSRPSIDSDPLLGQGGFGTFFARTPPHRSTPGGHQSDSPESCAAAGPPLSDSVHMPTTKYALLWKVGAGGVAPLACSDCYDWLRDTRQGIHSLAPSQRRIMHRPGTPLSTYTQQSKRPHLRARTAQRTDMTTHHEHKCTMRTPTTYQPAPYPTLQCIVATTDRTLHNRIRHKQHIPWIQNINSPRWGTRCPHRPSHSERYLAVPMRLASLDLSNGLGNALLASLGPFSDNGALKAACIPCTPYQENVGNTYSRDNPCN

SEQ ID NO: 1017899 - protein, 133 aa, Homo sapiens
MQPWALPTVGELWVCGRLARRSVCQRVMMPSRTNLATGIPSSNSEIFKALQHRRWATFDPSVYEKPLLKIPYKGQSHFATVLFLDWAPFSIIIGSLLLCSGYISKGGADRAVPVLIIGILVFLPGFYHLRIAY

SEQ ID NO: 1017900 - protein, 144 aa, Homo sapiens
MQPWALPTVGELWVCGRLARRSVCQRVMMPSRTNLATGIPSSNSEIFKALQHRRWATFDRSLLLCSGYISKGGADRAVPVLIIGILVFLPGFYHLAHRLLMHPKATVVTPMMTFQTLMTSTHPIAEEESQWNCPSFKISSRNYS

SEQ ID NO: 1017901 - protein, 133 aa, Homo sapiens; identical to SEQ ID NO: 1017899

SEQ ID NO: 1017902 - protein, 114 aa, Homo sapiens
MEVWQLEQVTKNKPFRVPPSFTPHMGCLWRLGHLVSNGSRTQQESMCSAWWLCVVGLLGACGLGMDAVEDTPCARLAGARADRVDRAWTFWMKSQWPQGRNDTRVTHQNVPPRL

SEQ ID NO: 1017903 - protein, 68 aa, Homo sapiens
GVPIPEVQKSFLSPVSSNAFLVALGSESILSCSLPVVVVTCKSPISHCLARAPYVDHLSAPVQQTGAL

SEQ ID NO: 1017904 - protein, 289 aa, Homo sapiens
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSAGPYFNPRSRQRIPRDLAMCVTPSGQFYCSMCNVGAGEEMEFRQHLESKQHKSKVSEQRYRNEMENLGYV

SEQ ID NO: 1017905 - protein, 288 aa, Homo sapiens
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSGPYFNPRSRQRIPRDLAMCVTPSGQFYCSMCNVGAGEEMEFRQHLESKQHKSKVSEQRYRNEMENLGYV

SEQ ID NO: 1017906 - protein, 288 aa, Homo sapiens; identical to SEQ ID NO: 1017905

SEQ ID NO: 1017907 - protein, 132 aa, Homo sapiens
SGGVVQESHFENQCFGQSPCRESSQASDCKFILDRFDHELRTSMLRLEGHDWYILNIISPVFQRDRDLTRYGPQPRGEDSRDEVESRCEKEIEKESREDQGYTLRTSTVPAVERGLLSVFRVELHLRMKSYN

SEQ ID NO: 1017908 - protein, 84 aa, Homo sapiens
GGELLPAGWPWRFTFPRLRALPRCSRRERNTFQALEEAVYRNIQACKELAQTTRTAYGPNGNEQKLVINHLEKLVCDKRCSNVF

SEQ ID NO: 1017909 - protein, 95 aa, Homo sapiens
RRVNCFLQAGHGASRSQGSGLCPDAQGGSESKWLQQATGMSTFQALEEAVYRNIQACKELAQTTRTAYGPNGNEQKLVINHLEKLVCDKRCSNVF

SEQ ID NO: 1017910 - protein, 85 aa, Homo sapiens
MTVFARTRSVRPFRGGFQVTKICCSLFVGHNDACWSVTSPMVTEMVRILRTVPFLAACYSGCVDDSQYLQQAGLYQTTPSSPDLP

SEQ ID NO: 1017911 - protein, 238 aa, Homo sapiens
RILPVEMAAAVAGMLRGGLLPQAGRLPTLQTVRYGSKAVTRHRRVMHFQRQKLMAVTDIYPPETSHPPIMPAISIPDSPHIREGDRRIIQVLLRLGEIAGMLLCHVTRPICDYVPVMRRKCVASEMVEDGNKVFISCDDPSLAGRTSERLRCSETVFARTRSVRPFRGGFQVTKICCSLFVGHNDACWSVTSPMVTEMVRILRTVPFLAACYSGCVDDSQYLQQAGLYQTTPSSPDLP

SEQ ID NO: 1017912 - protein, 72 aa, Homo sapiens
MEQRGQNAPAASGARKRHGPGPREARGARPGLRVPKTLVLVVAAVLLLDTISQKTVEIASPANMDRTIALTG

SEQ ID NO: 1017913 - protein, 91 aa, Homo sapiens
MEQRGQNAPAASGARKRHGPGPREARGARPGLRVPKTLVLVVAAVLLLVSAESALITQQDLSSPAETPHNKEVSPSEDGHLTHIQRRRVRV

SEQ ID NO: 1017914 - protein, 101 aa, Homo sapiens
PEGDRRPKEKLPVSAQVHVPEEKPTSQRNDDHFLKPGFGFARWLPKLISSGLCEDAWFTTCLQLVTPKTPWSPLEGQHLPSASLQVLPHPRTTWTIIYLVF

SEQ ID NO: 1017915 - protein, 139 aa, Homo sapiens
AGPPPAPPAEKPGWSRSVSPRKPAVYLGIKPARAGGKGRGAGSGKRGGGGMLSARENNNKIRVRGRCPRRNSEQTRGPALAPRPGAQEGDRQRRHEAGDAALVSSARGGGGGGGGGDLGAAGRGRAPNGRGLPSPAAGP

SEQ ID NO: 1017916 - protein, 76 aa, Homo sapiens
MRVSRNDSRGGGVPRPGKKKKPRAVEGGSQKGLWQEKPTTPEVGGRQGGGTRCVGSPHTRGERGGRSPIAIQKSNP

SEQ ID NO: 1017917 - protein, 116 aa, Homo sapiens
MRSAPHPPPPSRVCGHKRTPHLPPRRPPPRSTPTPPRTPPPPLTLCQSELPHSVAQAAPAGPPPAWALWGKYWVPRLERWTEAQWVKALKSTQKPWPPRELETMYMLQSHYGRDTL

SEQ ID NO: 1017918 - protein, 337 aa, Homo sapiens
MVSQCLFLFYWPFCLPTSLGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCRSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDEN

SEQ ID NO: 1017919 - protein, 415 aa, Homo sapiens
MANEDCPKAADSPFSSDKHAQLILAQINKMRNGQHFCDVQLQVGQESFKAHRLVLAASSPYFAALFTGGMKESSKDVVPILGIEAGIFQILLDFIYTGIVNIGVNNVQELIIAADMLQLTEVVHLCCEFLKGQIDPLNCIGIFQFSEQIACHDLLEFSENYIHVHFLEVHSGEEFLALTKDQLIKILRSEELSIEDEYQVFLAAMQWILKDLGKRRKHVVEVLDPIRFPLLPPQRLLKYIEGVSDFNLRVALQTLLKEYCEVCRSPKENKFCSFLQTSKVRPRKKARKYLYAVGGYTRLQGGRWSDSRALSCVERFDTFSQYWTTVSSLHQARSGLGVTVLGGMVYAIGGEKDSMIFDCTECYDPVTKQWTTVASMNHPRCGLGVCVCYGAIYALGGWVGAEIGNTIERFDPDEN

SEQ ID NO: 1017920 - protein, 124 aa, Homo sapiens
PAALAMAAPATGLISVFSSSQELGAALAGWPSAMLLAGAAPVSRSACRAGLRLDASPRATRRRRPCRAKLSLARWTLGFCDERLVPFDHAESTYGLYPDASSLQELADSKKAKVNNLNPEVAFG

SEQ ID NO: 1017921 - protein, 47 aa, Homo sapiens
MELKFHRLSVSYQMYVGVLEQVFLHLLGAHRTISKGSLNGCFGTAHY

SEQ ID NO: 1017922 - protein, 83 aa, Homo sapiens
MSAVNRAACEAVLRQYTDPYLNQDPVSAGCVRAIDVQGDKVSVQLELGYAAGLFKSGWAQMLQMAIEGLDGVTLAKVDIQCVI

SEQ ID NO: 1017923 - protein, 110 aa, Homo sapiens
MVRVVSGEGLAVDCQFFIGAYNNCEVLDLPSPPTGALPEVLRQAVPLSMKKVIFLLMGVEENRGPVSSSLFGFSTGPIQDQISLSNLSKRKCPSLYSVRAAASLCTEYAQ

SEQ ID NO: 1017924 - protein, 107 aa, Homo sapiens
MVPRGPTATARFGVPAEGRTPPPFPGEPWKVCVNVHSFKPEELMVKTKDGYVEVSGKHEEKQQEGGIVSKNFTKKIQLPAEVDPVTVFASLSPGLLIIEAPPGPSLL

SEQ ID NO: 1017925 - protein, 102 aa, Homo sapiens
ANGQEDSKAPDGSTLALGLPQPDFLLACILGPGVPSAFVDTCVPARAWKNIFHDFREIEVEVYMEACHSPVVSQLETGTSSMHAITKKHAALPVSMGFMLLG

SEQ ID NO: 1017926 - protein, 82 aa, Homo sapiens
PIWCVIQKKEQRGEGTLAWQPGDTGQPSCFRLHLVPAPASHTRAEALLLGEVQPMLGPAAAAASRSFNPSWGTQAAWDTAMR

SEQ ID NO: 1017927 - protein, 67 aa, Homo sapiens
MRKPQAGTGEAARDPSLRPARTVLVGDQDEYTAAENKSPRGTLCPTGEQRIHAREDACIFSRLFSEK

SEQ ID NO: 1017928 - protein, 141 aa, Homo sapiens
TALTTPSGSASLPCFWAGSPPALQPCVLASLLKRRLQSVPRVSEHLVDVWEIPTWWDLPACRALSWRAWYSLGSESSLPQPNRVGCGAWEAANSGFHRVEVRHEAARQVGPLPRAQASDPEDALASAVSGTQRLPQPSLCG

SEQ ID NO: 1017929 - protein, 131 aa, Homo sapiens
WNHAAFQRRQHHAGEVDKAHAGTAIAPFATDGGFYTTNRCVVISVLRFNTEFNKFRDHDFVVVERRHPEAATDHLYAGVEEIVAHSCMVTHAEVRLSGTQATAGFEDRVREWIHRVHWLTINQILPANSDV

SEQ ID NO: 1017930 - protein, 142 aa, Homo sapiens
LILLLSLFPAPAVVPGTPCRTLNEGKGRDFILQNVMNCLENHEFSVGGELRLGGGATSRTKAVSAQLENAVGDGVSSPKTPSTPAVGSTHWGLHPDGLPELKWVLCPCWINMWRCWWVGQVSYTTLYVLQMIWGYHCYFNKF

SEQ ID NO: 1017931 - protein, 72 aa, Homo sapiens
FGTMYVLEINKRITEEQARKAFDRATKLEQEFTECFSAIVEGDSFEEIYHKVKRDIEDLSGPYIWVPARERL

SEQ ID NO: 1017932 - protein, 72 aa, Homo sapiens; identical to SEQ ID NO: 1017931

SEQ ID NO: 1017933 - protein, 71 aa, Homo sapiens
GPGGSCRIMQLGRGGHATPQPQPSNQVTVILPSPRPQGFPSAPGGFPVASSWGLVKNNLGIIYFEVEDVCA

SEQ ID NO: 1017934 - protein, 99 aa, Homo sapiens
VADLQEPQGSSERRIPTTATTVPLSEINRNFGVHRATETRTPGGEWRRPEPQLRDDVSREKSWEWGSQFAHGGYPETESGRRWGWLNIHPRVWTGVRSV

SEQ ID NO: 1017935 - protein, 124 aa, Homo sapiens
MKRKQLKTQELPGECTLLVPPLLVPPQRPRNVPCVTFRSACRVFSTQQLVVNVSASCGFSVTLMILESLFHTFTTMSVAGRLRHNNFSNVINCEHLKVNFSQLPDEFSGAIYFSQIASSPRGMV

SEQ ID NO: 1017936 - protein, 93 aa, Homo sapiens
MGLASLGLTGVTVASLASRVPLPPPGSPGEQGPSGASGPAGPRGPLALLVLLAKDGLICLLALFGLVRAPATGDAILLPPSTWDSCPLSRAVP

SEQ ID NO: 1017937 - protein, 145 aa, Homo sapiens
THDHRKISCFPTLPNSFLPCNLMEIILQTRWNLRRSHLIPLSILRHADSSFWSTGVLQGQNNQAVMNCVLSSVRGMLKFCICVISAFSISRALTSLIFSSLSLLGEAIFVQVTTQIRELWYLTVSGSWIENTISVTNNEFAFILS

SEQ ID NO: 1017938 - protein, 214 aa, Homo sapiens
STDPNKQETGNVHVSERLQPGAPERASAEASGHAGSPRSLVFALVILVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYELGSENVKVPIFEEDTPSVMEIEMEELDKWMNSMNRNADFECLPTLKEEKESNHNPSDSES

SEQ ID NO: 1017939 - protein, 159 aa, Homo sapiens
QRVPPPQAPPLGQNGPPGDQPPRNSRVGACVQKGSPGNYEELENSGDTTVESERPNKVTIPSTFAAVTIKETLNANINSTNFAPDENQLEFILMVLIPLILLVLLLLSVVFLATYYKRKRTKQEPSSQGSQSALQTCKIQLSWKVIPAFCLESSHRNAL

SEQ ID NO: 1017940 - protein, 199 aa, Homo sapiens
STDPNKQETGNVHVSERLQPGAPERASAEASGHAGSPRSLVFALVILVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTYELGSENVKVNRRLQQLYKYLNKSWSETEEPNPTLDLVHADNKPRSA

SEQ ID NO: 1017941 - protein, 184 aa, Homo sapiens
PRLFALTRARLGHGAGAFRPARVRGELRQGPGVPDTKAAFLLTILGFIDIFRRPAAGFVAGLGKVRPYSVYLFSFSMFFNGIADLAGSTAGDYGGLVVFCIFFGISYGMVGALQFEVLMAIVGTHKFSSAIGLVLLMEAVAVLVGPFGRQTPGCDPRLHVRVHSGGGRGAHLLPDFAAGQLLLH

SEQ ID NO: 1017942 - protein, 131 aa, Homo sapiens
GSSKPFNQNKNRYVDIPPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVN

SEQ ID NO: 1017943 - protein, 270 aa, Homo sapiens
APAPIQEVLRWGKLEDERAEQSLGELIGTLNAAKVRPDTEVVCAPLLPYIDVRPAEARFQDCVWLRRTCYKVTNGAFTGEISPWHDQRLAGPTVGGRLEATLERRHVFGESDEVIGQKVAMFWQRDSEIIACIGEKLDDEGKSWTSAEKVVITMRDKWSSHDNVKDWSKVCPGLMSLCGPLVLGKDCNSPTRSQEVTREVSDGLAVMSNVSDAVAQSHPFIYGGSVTGATCQAAGQPTDVEWFLVGGGYLKPECVDVILAKKEPIHFLPS

SEQ ID NO: 1017944 - protein, 68 aa, Homo sapiens
MMKPQAETGEAARDPSLRPARTVLVGVSLTKSRAAVCDLEDGSACVPLGCSLTRGSFSSKSRTPDPQG

SEQ ID NO: 1017945 - protein, 240 aa, Homo sapiens
GGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYN

SEQ ID NO: 1017946 - protein, 118 aa, Homo sapiens
FASNHYERDFFIPCQKTLFTIGEQFSVLGQCGKAFSSTPNVVSQQACTRDRSLDYSRLKSRFLYVRTVENLLRIPHALTITLKFTLMRNLSNVKNVGKLSATLIHVEDMKDLSFSRCP

SEQ ID NO: 1017947 - protein, 253 aa, Homo sapiens
GGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYH

SEQ ID NO: 1017948 - protein, 117 aa, Homo sapiens
MQHELSSLWQLEKRILEDPGGKPAARRPGPSPTPGNCAGSWTEGRPPPDRALREAFHFVAGQRDAAAGTEATWPMAGPGRHSPGSPFKKPRRAAAGSRYRPASLPGAQHTGCGSGHP

SEQ ID NO: 1017949 - protein, 152 aa, Homo sapiens
MLGVSAQSFRADDGLQYRNSRTSALAATTGSQSEEVGSRSGLALMCLQAEAAECLPVRTGVQEHTCHLGSVTLGHEGQGLGGREAMSPPILSSVLAPHPLACLWTDAGTASRTATLETIYSSERPQACNPGKIFSTCCLCGMYKGMNGILLL

SEQ ID NO: 1017950 - protein, 157 aa, Homo sapiens
MDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGNSGTCPDDRFQVNGFPCHHGKGHCLMGTCPTLRGQCTEL

SEQ ID NO: 1017951 - protein, 218 aa, Homo sapiens
MDNSGKEAEAMALLAEAERKVKNSQSFFSGLFGGINCLMRAIEIYTDMGQIHDCGQAPDLPVAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHDEQNVDSYTESVKEYDSISRLGPVAHQHCLLA

SEQ ID NO: 1017952 - protein, 284 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKNADPQEAINCLMRAIEIYTDMGQIHDCGQAPDLPVAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHDEQNVDSYTESVKEYDSISRLGPVAHQHCLLA

SEQ ID NO: 1017953 - protein, 176 aa, Homo sapiens
RAAWKAVFAARGNLRYFPAPNSSVMGVTDLTSFLFQSILPSYALPCMLPPGRQDLSSASLPGAVAALSPLRIMATAEVLNIGKKLYEGKTKEVYELLDSPGKVLLQSKDQITAGNAARKNHLEGKAAISNKITSCIFQLLQEAGIKTAFTRKCGETAFIGTAVVNMIPIDMGLQKE

SEQ ID NO: 1017954 - protein, 104 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIGTAVVNMIPIDMGLQKE

SEQ ID NO: 1017955 - protein, 100 aa, Homo sapiens
LPLHLYMSKLEKMQEACGSKSVYDGPEQEEYSTFVIDDPQETYKTLKQVIAGVGALEQEHAQYKRDKFKKTKYGSQEHPIGDKSFQNYIRQQSETSTHSI

SEQ ID NO: 1017956 - protein, 187 aa, Homo sapiens
MLREQIVPVAESVTVHFNLACGVTRAVTPTPYDFRDARMEMTGYECLNQIIFTGESVMRHWKWSFQDVIHLDGAMTDGCETTRLGEKWDLQGENGQMMSCTCLGNGKGEFKCDPHEATCYDDGKTYHVGEQWQKEYLGAICSCTCFGGQRGWRCDNCRRPGGEPSPDRHYWPVLQPVFSEIPSEKKH

SEQ ID NO: 1017957 - protein, 203 aa, Homo sapiens
MEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPILPTQPGPATWRECWVAGWGQTNAADKNSVKTDLMKVPMVIMDWEECSKMFPKLTKNMLCAGYKNESYDACKVTRGYLPHLIGPHPLGTASARVFSLCCK

SEQ ID NO: 1017958 - protein, 280 aa, Homo sapiens
MEAEVGEFPWQVSIQARSEPFCGGSILNKWWILTAAHCLYSEELFPEELSVVLGTNDLTSPSMEIKEVASIILHKDFKRANMDNDIALLLLASPIKLDDLKVPILPTQPGPATWRECWVAGWGQTNAADKNSVKTDLMKVPMVIMDWEECSKMFPKLTKNMLCAGYKNESYDACKGDSGGPLVCTPEPGEKWYQVGIISWGKSCGEKNTPGIYTSLVNYNLWIEKVTQLEGRPFNAEKRRTSVKQKPMGSPVSGVPEPGSPRSWLLLCPLSHVLFRAILY

SEQ ID NO: 1017959 - protein, 119 aa, Homo sapiens
NLFNSFKIKLAAALARCRIKHDALSIYHILPETVRKQELRASTLPLYAWINTCKISPEEVYNNLKRRGYNKVKSVLHIDDKVFAVDQHCYDVLIFPSHLKNDLINIDLFKDYKLIFQVN

SEQ ID NO: 1017960 - protein, 54 aa, Homo sapiens
NFSSKAGKWTWLAGRLDHIAVGPPRHQAVLHLARGREITRDHRPTAECRSNDQS

SEQ ID NO: 1017961 - protein, 178 aa, Homo sapiens
FQLNFTTMFDTDYVASINKSGYRYHPGEAKNLLAHSQYAFLIQMWGAGNIYNRRYFFNSVESLLSRPVVKDFCVMLVDINQFKRINAQWGHRVGDKVLVSIVDIIQQSIRPDDILARLEGEVFGLLFTELNSAQAKIIAERMRKNVELLTGFSNRYDVPEQMTISIGTVFSTGDTRNI

SEQ ID NO: 1017962 - protein, 135 aa, Homo sapiens
MGKRSASERGGGESERCASGSEACWSRDWDAPRLCGREGVNALRCYLSGDMHMQQFASFGQRSINGAISLMDPTCDHSSSIVILDKLAQGLTEIHPDNAILTSNPGSGDPSDDRPSQACSQCWMPSGSPLMFVPC

SEQ ID NO: 1017963 - protein, 135 aa, Homo sapiens
SGPASSGASIIYLLRRQIRYGNSVTKLFDMISYPLSPVSRNRLAQVKRKILVLDLDENLFISHHDGVLRTHSRPGYVLLIFILKVVNKQSILSGCLYIRGPMWISVLECGEPVVLDAGWLFTSNAVEIYGSAVAL

SEQ ID NO: 1017964 - protein, 94 aa, Homo sapiens
SGTIFTTSSSPNEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 1017965 - protein, 94 aa, Homo sapiens; identical to SEQ ID NO: 1017964

SEQ ID NO: 1017966 - protein, 94 aa, Homo sapiens; identical to SEQ ID NO: 1017964

SEQ ID NO: 1017967 - protein, 94 aa, Homo sapiens; identical to SEQ ID NO: 1017964

SEQ ID NO: 1017968 - protein, 447 aa, Homo sapiens
VVTKDQPLSMIFSYCSHGDLHEFLVMRSPHSDVGSTDDDRTVKSALEPPDFVHLVAQIAAGMEYLSSHHVVHKDLATRNVLVYDKLNVKISDLGLFREVYAADYYKLLGNSLLPIRWMAPEAIMYGKFSIDSDIWSYGVVLWEVFSYGLQPYCRYSNQDVVEMIRNRQVLPCPDDCPAWVYVLMIECWNEFPSRRPRFKDIHSRLRAWGNLSNYNSSAQTSGASNTTQTSSLSTSPVSNVSNARYVGPKQKAPPFPQPQFIPMKGQIRPMVPPPQLYVPVNGYQPVPAYGAYLPNFYPVQIPMQMAPQQVPPQMVPKPSSHHSGSGSTSTGYVTTAPSNTSMADRAALLSEGADDTQNAPEDGAQSTVQEAEEEEEGSVPETELLGDCDTLQVDEAQVQLEAEWHQGPGFGDRSPAETPQGPQSPLRRHHTQQSQEPAGQWACLQTG

SEQ ID NO: 1017969 - protein, 102 aa, Homo sapiens
RAPKVSRRAPPRARPCPREEPKEEGPKKLRRPQLLPPRRPKVTGPQLTQNPGSSEAAPSSKETPAATEAPSSTPKAQPAASAEEPKPVEAPAANSDQTVVKE

SEQ ID NO: 1017970 - protein, 227 aa, Homo sapiens
MELHYLAKKSNQADLCDARDWSSRGLPGDQADTAATRAALCCQKQCASTPRATEMEGSKLSSSPASPSSSLQNSTLQPDAFPPGLLHSGNNQITAERKVCNCCSQELETSFTYVDKNINLEQRNRSSPSAKGHNHPGELGWENPNEWSQEAAISLISEEDACIRFRSHVFTEVYRLWFNQAIWYLSPGILLVIISYIVPTESEGEPNTVAARRLGRLRNATAHRGTL

SEQ ID NO: 1017971 - protein, 136 aa, Homo sapiens
EEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 1017972 - protein, 300 aa, Homo sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017973 - protein, 300 aa, Homo sapiens; identical to SEQ ID NO: 1017972

SEQ ID NO: 1017974 - protein, 264 aa, Homo sapiens
MKFLLDILLLLPLLIVCSLESFVKLFIPKRRKSVTGEIVLITGAGHGIGRLTAYEFAKLKSKLVLWDINKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017975 - protein, 336 aa, Homo sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVPCDLAPFSWAGAQWRDLGLNGTSCLRASKGISCLSLPSSVGFQTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017976 - protein, 155 aa, Homo sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVDYKGISSCNDEE

SEQ ID NO: 1017977 - protein, 256 aa, Homo sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017978 - protein, 282 aa, Homo sapiens
MKFLLDILLLLPLLIVCSLESFVKLFIPKRRKSVTGEIVLITGAGHGIGRLTAYEFAKLAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017979 - protein, 259 aa, Homo sapiens
LLRGMLRPENGMNPGGRACSELRSRHCTAAWATEPESVSKKKIAIVYKLTLIPLNEFTFLILFFEVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017980 - protein, 168 aa, Homo sapiens
EIKKGVGDIRVIVCDFIKTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 1017981 - protein, 300 aa, Homo sapiens; identical to SEQ ID NO: 1017972

SEQ ID NO: 1017982 - protein, 300 aa, Homo sapiens; identical to SEQ ID NO: 1017972

SEQ ID NO: 1017983 - protein, 115 aa, Homo sapiens
LDVNQTLSAIPAPPEPRLADHSRLGAGGQPGQHSETPSPPKKYENQSGVAARAALAGTQQAEAGESGREVAVSRDGSSTVQLRLMYERGDGGGAEEEEGEGSPGFSSVVMKMSSN

SEQ ID NO: 1017984 - protein, 138 aa, Homo sapiens
MGQIEWAMWAHEQALASGLILITGGIVATAGRFTQWYFGAYSIVAGVFVCCVCTPGEEEEGLQHGRWGQKYMTAVVKLFGPFTRNYYVRAVLHLLLSVPAVPAGHHPWDRLPGHCERHLPTGGCAWRAVDAHSSSKPR

SEQ ID NO: 1017985 - protein, 162 aa, Homo sapiens
VSKGAHFRCPFFRQPYGPNPRVKGAVPKPERGRGGPRPPSDLQCAPGSRSDMGHNLKDLAGTLCAGPRGMGTGLKLLLGAGAVAYGVRESVFTVEGGHRAIFFNRIGGVQQDTILAEGLHFRIPWFQYPIIYDIRARPRKISSPTGPKDLQMVNISLRVLSR

SEQ ID NO: 1017986 - protein, 137 aa, Homo sapiens
WITVVADLSSLLKDGNLYFLGALRLTILAVKLNRQRLIVCLEESLYIHNIRDMKGAALRSGRRLQTLQACVALSINNDNCYLAYPGSATIGEVQVFDTINLRARKDEFQLTTDLYDGLAFDASGNLNLATASHNGDR

SEQ ID NO: 1017987 - protein, 211 aa, Homo sapiens
MNLASQSGEAGAGQLLFANFNQDNTSLAVGSKSGYKFFSLSSVDKLEQIYECTDTEDVCIVERLFSSSLVAIVSLKAPRKLKVATLRREPEICNYSYSNTILAVKLNRQRLIVCLEESLYIHNIRDMKGAALRSGRRLQTLQACVALSINNDNCYLAYPGSATIGEVQVFDTINLRACKDEFQLTTDPYDGLAFDASGNLNLAPASDNGDR

SEQ ID NO: 1017988 - protein, 230 aa, Homo sapiens
MNLASQSGEAGAGQLLFANFNQDNTEVNGGINEQLVLAVALLVWSLAVGSKSGYKFFSLSSVDKLEQIYECTDTEDVCIVERLFSSSLVAIVSLKAPRKLKVATLRREPEICNYSYSNTILAVKLNRQRLIVCLEESLYIHNIRDMKGAALRSGRRLQTLQACVALSINNDNCYLAYPGSATIGEVQVFDTINLRSRKDEFQLTTDPYDGLAFDASGNLNLAPASDNGDR

SEQ ID NO: 1017989 - protein, 211 aa, Homo sapiens; identical to SEQ ID NO: 1017987

SEQ ID NO: 1017990 - protein, 191 aa, Homo sapiens
MNLASQSGEAGAGQLLFANFNQDNTWNRSMNAPIRKMCALVERLFSSSLVAIVSLKAPRKLKVATLRREPEICNYSYSNTILAVKLNRQRLIVCLEESLYIHNIRDMKGAALRSGRRLQTLQACVALSINNDNCYLAYPGSATIGEVQVFDTINLRACKDEFQLTTDPYDGLAFDASGNLNLAPASDNGDR

SEQ ID NO: 1017991 - protein, 99 aa, Homo sapiens
KPLGTCEAAKARVMDASAFEIFSKFPPTLYQDDTLTLAGCRPCAQKSTAAAGTPSPEVQPEIQSWSLSWSRPQSLSRSRSRPQSLSRTQSQPPIKHPPP

SEQ ID NO: 1017992 - protein, 128 aa, Homo sapiens
RRLPAVDRDYYLDRPLSFDSSAVKLEFQNIERDITRRLGQFSPVGQIMRRMCREYRMVVRMLEARGTEDFGLISQELYGAASDAFHAGDPTLADLGLMLSDYLNNIDGRGDLKDEAKTLTAKDAVALL

SEQ ID NO: 1017993 - protein, 177 aa, Homo sapiens
FAAASTETAQGNITHADLFTGEVRLRRQGLIHRLQYVDASLATSVDGVPVLLFGRGAKYAPEHSPERVGEGRGGPVHPLFGVGAGLQVARVPVRIRRILAARYAHDGVGLPEHKVAIFNHRHAAIGVQRAVLRRVDHTKSPARINCLIVQAELLGAPQLLFLTFDEFLRPQIFSMGR

SEQ ID NO: 1017994 - protein, 105 aa, Homo sapiens
GDSVKFEGGEDASVAVEWSGDGSGLQRSGLGKTRDAAAEDSELGRKQGTEPRPAGGGGGAANYLNQPSAAPAPRGSASSMDPSSSTPPPGLLVPSPQHPPLLAPP

SEQ ID NO: 1017995 - protein, 163 aa, Homo sapiens
FAAASTYKAIEIIKPGCRLGHIGEIIQKHAEKNGFSVVREFCGHGIGKVFHEEPQILHYGRAGTGMELKAGMTFTIEPMINQGKADTKVLGDGWTAITKDRKLSAQWEHTLLVTGTGYEIFTLRSDETIPRVSALIACTCRSVQNAYQNPRKANRCRRWTPVE

SEQ ID NO: 1017996 - protein, 320 aa, Homo sapiens
PSKPLHVIKGHSKSIQCLTVHKNGGKSYIYSGSHDGHINYWDSETGENDSFAGKGHTNQVSRMTVDESGQLISCSMDDTVRYTSPHAAGLQRTRSCETGRSAKVRSRSCPGGYAVVVCIGTGFCSPGLKESEERASDIDNPGYVAQNVVGSAPPAGDNGVGNLGGVDGNVRLYSILGTTAERLSGKLLEAKGPRGTPERVGVLNLPPTERAPSSSVCDSSMVGHSGSSRLAGTAYSGEPVFVYGHHAKIVCLAWSQDNEHFASGGMDMMVYVLDPVVTRKPESRSKMHTGCTMSDSLAWLDEHTLVTTSHDASVKEWTIT

SEQ ID NO: 1017997 - protein, 217 aa, Homo sapiens
METLGEAGPGGPVSPESVRHSRTDGGGPELQPVPPKGTCKTGLKLGCGNKTDNQEHWIPCEGELVKDDGAGPTGIRRKTLEKIKSDTPKAGSANSTGYPTIAKSTVDKPINEELKTAVKPLKQSLKNKRLRGKGRKMAQKAEQEEEGNEQKKKQREEDKTRRGHDKRRLTPTAAARKQAEGEDTHAAKRQRENKKRGQRKRQRDRRNRHQCHARQAQ

SEQ ID NO: 1017998 - protein, 120 aa, Homo sapiens
TVEPGKTVTFTLGDWYLNDKKLAAGDVKDIVWILDAKDVTAQFKGNKLEVNAPAAEGTMTLEIKGKLASDPTKELSQKKSVTVKKAGATPEPEKKSSGGGCDAGFSALALEKQKNYVKIK

SEQ ID NO: 1017999 - protein, 213 aa, Homo sapiens
QARVPSSADPGPAAQAAKSGDRLRQQPMSLILWICPGAKGSRIRRGVQEEQTLRPGSLCISVTPDAIPREASAIPRPVPELQHANLRVSGTSSLRGRVGEGASDSPGVFRYVTPARQPPGPERQRRSQASSGKPLRWPRGAHASTRSLFGRRSGAGYTARRALPLRRGGPRACDFPSVVLGQPGPAQENPRAQRRLHLRPPGAGRPPQVQARA

SEQ ID NO: 1018000 - protein, 104 aa, Homo sapiens
AVVRASTLPLSVFMVGVGGPNFEAMDHLAVDGGPLHTRSGQAAARDIVQFVPYRRFQNAPREALAQTVLAEVPTQLVSYFRAQGWAPLKPLPPSAKDPAQAPQA

SEQ ID NO: 1018001 - protein, 41 aa, Homo sapiens
MGRCAYFPFAFHRDCTFPEDSLAMLSVQPAELSAQISAVTE

SEQ ID NO: 1018002 - protein, 67 aa, Homo sapiens
GRRMCLESWKLDYPTFSYKWTLRACLEVLAGERTYSYTLDRRPVLLYRGWSSSSTERARSGGTHMER

SEQ ID NO: 1018003 - protein, 186 aa, Homo sapiens
NGATFFGRPKSGFIPTPAASTMPPKFDPNEVKVVYLRCTEGQVGATSALAPKIGPLGLSPKKVGDDIAKATGDWKGLRITVKLTIQNRQAQIEVVPSASALIIKALKEPPRDRKKQKNIKHSGNITFDEIVNIARQMRHRSLARELSGTIKEILGTAQSVGCNVDGRHPHDIIDDINSGAVECPAS

SEQ ID NO: 1018004 - protein, 176 aa, Homo sapiens
FAAYPCASYRDFESNKCFPCPDQGCPQMGHYADSFANNTSVEPQKFFLNTGEAKNFARWRYRVSLTFSGRTVTGQVKVSLFGSNGNTRQCDIFRGIIKPGVQHSNEFDAKLDVGTIEKVKFLWNNHVVNPSFPKVGAAKITVQKGEERTEHNFCSEETVREDILLTLLPCKTSDTM

SEQ ID NO: 1018005 - protein, 111 aa, Homo sapiens
IRGRVDISGFWLCAALGFGIIALNLFLAKPLLKLKIFTVTQVLEKRYNPMARQASAVIMLAYALMIGVTSILAIGTVLQVLFNLPFWLSVLLGGGVVVVYSVDAAANLVVV

SEQ ID NO: 1018006 - protein, 139 aa, Homo sapiens
IRGRVDQQVENRQFRGQALAVVVDKVAHHLDPGGADCAAQYTAQHVEVAVDFTAGNQVHARLDHRLAAALDRQAGFDGVEDFVVGQGQFVDVQAVKEVDVDRVHGLLTDGVRRSTLEKLLCAEGACYGALNTTCCTSTF

SEQ ID NO: 1018007 - protein, 384 aa, Homo sapiens
VPLRPGDWAGVSTADRGERRPLGPAFCDLPSAPRRRPGGAKRTRGARLPPGTLAPWIIKQFVVDIESRLRMEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 1018008 - protein, 135 aa, Homo sapiens
GQSAEQLDSEKVAHLCSVKGIGLVTAASLMSYLPELGEVGRHEIAALAGVAPYNDDSGKHKGKRHISGGRFAVRRSLYMASWIVIRYQPEFNARYKALRDKGKCAKVALIACMRVLLIRLNAMIRDGSEWKEHVA

SEQ ID NO: 1018009 - protein, 182 aa, Homo sapiens
SPIFSFLLPNPPLSLNACAFQFFFYPYGMRPGNHDEFLLVCKLPLHRLRLLGRGWLLAGTLRRALLRTQNGGGHSRVSRLTSYCVQDRLGGGAGLPQGCVALIAAGWVIRLGAPGVPPGGGRALQPQGWRGGGGLGQRAGVRVRTPRGGRGLGGRRRPVVREPAGAAAPQGRVPAGPGQAAA

SEQ ID NO: 1018010 - protein, 98 aa, Homo sapiens
LLHTPAHVLPSAAFLCSMFVNSLLLSKETKSAKEIPEDVDMEEEKESEDSDEENDFTEKVQDTSNTGLGEDIIHQLSKSEEKELRKFGKIDYSWIAAL

SEQ ID NO: 1018011 - protein, 158 aa, Homo sapiens
LLHTPAHVLPSAAFLCSMFVNSLLLSKETKSAKEIPEDVDMEEEKESEDSDEENDFTEKVQDTSNTGLGEDHYTSSVTIMYHNTSADVGLYAALVYVPFKPGDSQDQCPFVLLTDMLIFNGFHVYVRVVVRVGERVFARVAFVVGLTHASGYKSRAAA

SEQ ID NO: 1018012 - protein, 73 aa, Homo sapiens
MPHSPVLGTHESSPDHRLPRYAPTSSLPHSATCCRFRDTIHCATWIDLRIAHRNGGARGTSLAENSHELVEVR

SEQ ID NO: 1018013 - protein, 294 aa, Homo sapiens
KTGDLNETICTCSHLTSFGVLLDLPSTSVLPAQMMALTFITYIVCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGKLYSIKYKLNDPS

SEQ ID NO: 1018014 - protein, 99 aa, Homo sapiens
MFPTTSQTTGWCTSLLALGRSHSDVTSYNPGKLEEQPCNQACSKKGFLFTNLELLYSFTLVPLSAVSRKYYFCHIRILFCKMRRAKYFKFSPSVSLSSF

SEQ ID NO: 1018015 - protein, 62 aa, Homo sapiens
IRGRVDPHPQLGVGILLELVLQAGEETAAVLDLRAFSEGFTAQGCELAQQFTLFFGHMSTRA

SEQ ID NO: 1018016 - protein, 280 aa, Homo sapiens
MDMSLELDIIKLNRSQRGGWGGCRGLRAVCRLPVAGRVWWVLQAAAQVNRGGGPIRNRPGIALRAAVEGGRNRPAPYSRPKQLPDKWQHDLFDSGFGGGAGVETGGKLCVVSNLDIGVSDADIQELFAEFGTLKKAAVHYDRSGRSLGAQNEFTLQQQADALNGHEAGTTASLLDGRPMNFSFVTSQIDAQRRACTERKQSVAGLETVALEGKGRVGGVHPGEGTPRMAPVEEARRLQEEIQQASKLTAEELDAHVDAYNAENDTVKKNSNPASDMTRSI

SEQ ID NO: 1018017 - protein, 221 aa, Homo sapiens
RQITLDVPHNLFPFLEKKKNLLIEVHDYIRAYLGDTSEAKEFPKQFLERAKQKANQQRQQQHLPQQQQQQPPQQPPQQPQQQDSVWGMNHSTLHSVFQTNQSNNQQSNFEAVQSGKKKKKQKMVRADPSLLGFSVNASSERLNMGEIETLDDYWAPASGLAIPLLSADYGVSTFGHNTYITIYSLSLCNKSQNRSSQAFSSGPLCPRFFNPFLLVNISDYR

SEQ ID NO: 1018018 - protein, 263 aa, Homo sapiens
MAFLWLVSCFALVGATFGCGVPAIQPVLTGLSRIVNGEDESLAPGPWQVSLQDRTGFHFCGGSLISENWVVTAAHCGVKTTDVVVAGEFDQGSDEENVQVLKIAQVFKNPKFNSFTVRNDITLLKLATPAQFSETVSAVCLPTVDDDFPAGTLCATTGWGKTKYNALKTPDKLQQAALPIVSEAKCKESWGSKITDVMICAAPSGVSSCMGDSGGPLVCQKDGVWTLAGIVSWGSGFCSTSTPAVYALLTALMPWVQEILEAN

SEQ ID NO: 1018019 - protein, 142 aa, Homo sapiens
ETWEEHGAPVLGEHLLCADALRRCTHLILTDAAGRQAASLPFCRGQGTCAVSPSSPCLEVCLADQPSSSLLRKPLGNPSAQPTQGQLLRLPFPMATPVTVSASQQGSPPTHVHPNPSMRVPPPSPTDRHNGVNLGAIPCFHP

SEQ ID NO: 1018020 - protein, 130 aa, Homo sapiens
GIPEHCTGSGRDFSLRGLSCVALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 1018021 - protein, 130 aa, Homo sapiens; identical to SEQ ID NO: 1018020

SEQ ID NO: 1018022 - protein, 130 aa, Homo sapiens; identical to SEQ ID NO: 1018020

SEQ ID NO: 1018023 - protein, 130 aa, Homo sapiens; identical to SEQ ID NO: 1018020

SEQ ID NO: 1018024 - protein, 130 aa, Homo sapiens; identical to SEQ ID NO: 1018020

SEQ ID NO: 1018025 - protein, 130 aa, Homo sapiens; identical to SEQ ID NO: 1018020

SEQ ID NO: 1018026 - protein, 68 aa, Homo sapiens
GVPLLCMNWLPLSYPAFCLILEHLVSQMPLVIASCKEQKSAHIGPNKGIEISWKYDAGLNENWSERGT

SEQ ID NO: 1018027 - protein, 103 aa, Homo sapiens
PDRPLVLTVEHKEKELIVKQGSKGTPQSLGLNLVKIQCHNEAVYQYHVTFSPNVECKSMRFGMLKDHQAVTGNVTAFDGSILYLPVKLQQVLELKSQRKTRQC

SEQ ID NO: 1018028 - protein, 338 aa, Homo sapiens
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 1018029 - protein, 103 aa, Homo sapiens
MLQKPKSVKLRALRSPRKFGVAGRSCQEVLRKGCLRFQLPERGSRLCLYEDGTELTEDYFPSVPDNAELVLLTLGQAWQGWFCHVSQDSLTLLGSSCPPALVS

SEQ ID NO: 1018030 - protein, 99 aa, Homo sapiens
CIRRYRHNTQKETKDEKKKNLEIEKKRTIIPTLVEAIKEQDGREVDWEYFYGLLFTSENLKLVHIVCHKKTTHKLNCDPSRIYKPQTRLKRKQPVRKRQ

SEQ ID NO: 1018031 - protein, 110 aa, Homo sapiens
MLQKPKSVKLRALRSPRKFGVAGRSCQEVLRKGCLRFQLPERGSRLCLYEDGTELTEDYFPSVPDNAELVLLTLGQAWQGCGRCERHQALPQCISRATGGAHPGRPAAAV

SEQ ID NO: 1018032 - protein, 115 aa, Homo sapiens
MLQKPKSVKLRALRSPRKFGVAGRSCQEVLRKGCLRFQLPERGSRLCLYEDGTELTEDYFPSVPDNAELVLLTLGQAWQGCEWQGLWRCERHQALPQCISRATGGAHPGRPAAAV

SEQ ID NO: 1018033 - protein, 234 aa, Homo sapiens
MKQYDPHILPCLAPGLEQDTDPEAPGLPCGLGGLLVFLAGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIIEKKRTIIPTLVEAIKEQDGREVDWEYFYGLLFTSENLKLVHIVCHKKTTHKLNCDPSRIYKPQTRLKRKQPVRKRQ

SEQ ID NO: 1018034 - protein, 316 aa, Homo sapiens
PLLWPSGLCSFRGHGTWAHQVASRLCFPEPSEEGNVVSVGRRLRTRPRRASLFPGLLGNVDFRDRHPACASLQSSPGADPCGQGEDGSEQLGSRCHRLWDPEGLRTSAMLQKPKSVKLRALRSPRKFGVAGRSCQEVLRKGCLRFQLPERGSRLCLYEDGTELTEDYFPSVPDNAELVLLTLGQAWQGCEWQGLWDVSDIRRFLSAFHEPQVGLIQAAQQLLCDEQAPQRQRLLADLLHNVSQNIAAETRAEDPPWFEGLECRWRESWVQRNLCLSLTLWLPRLKGISLAQLRNGWDYRVEIPNPNSLGYLENRET

SEQ ID NO: 1018035 - protein, 80 aa, Homo sapiens
MLQKPKSVKLRALRSPRKFGVAGRSCQEVLRKGCLRFQLPERGSRLCLYEDGTELTEDYFPSVPDNAELVLLTLGQAWQG

SEQ ID NO: 1018036 - protein, 116 aa, Homo sapiens
MLQKPKSVKLRALRSPRKFGVAGRSCQEVLRKGCLRFQLPERGSRLCLYEDGTELTEDYFPSVPDNAELVLLTLGQAWQGSVGVRARTKTRDTSSLSPGDCQALGNGGRCGQRLFL

SEQ ID NO: 1018037 - protein, 270 aa, Homo sapiens
MLQKPKSVKLRALRSPRKFGVAGRSCQEVLRKGCLRFQLPERGSRLCLYEDGTELTEDYFPSVPDNAELVLLTLGQAWQGYVSDIRRFLSAFHEPQVGLIQAAQQLLCDEQAPQRQRLLADLLHNVSQNIAAETRAEDPPWFEGLESRFQSKSGYLRYSCESRIRSYLREVSSYPSTVGAEAQEEFLRVLGSMCQRLRSMQYNGSYFDRGAKGGSRLCTPEGWFSCQGPFDMDSCLSRHSINPYSNRESRILFSTWNLDHIDGVLLCGPG

SEQ ID NO: 1018038 - protein, 223 aa, Homo sapiens
RCSCVVSFHSCSKGAGNMAQQACPRAMAKNGLVICILVITLLLDQTTSHTSRLKARKHSKRRVRDKDGDLKTQIEKLWTEVNALKEIQALQTVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 1018039 - protein, 136 aa, Homo sapiens
MRHKEVCLRGTKVHKKCYLASEGLKHFHEANEDCISKGGILVIPRNSDEINALQDYGKRSLPGVNDFWLGINDMVTEGKFVDVNGIAISFLNWDRAQPNGGKRENCVLFSQSAQGKWSDEACRSSKRYICEFTIPQ

SEQ ID NO: 1018040 - protein, 122 aa, Homo sapiens [sequence omitted]

SEQ ID NO: 1018041 - protein, 101 aa, Homo sapiens
KKEIEGEGGNSAASAEASTSLVIWLDPPTRRPPQRFLFPEKSSSSQVLRTRQSRSISGTNGQLLGAVPSPTGLLRPSANGHFLELLRVPLTSCSQLGNSNF

SEQ ID NO: 1018042 - protein, 101 aa, Homo sapiens; identical to SEQ ID NO: 1018041

SEQ ID NO: 1018043 - protein, 101 aa, Homo sapiens; identical to SEQ ID NO: 1018041

SEQ ID NO: 1018044 - protein, 128 aa, Homo sapiens
HEAGHCSALLLLLLGLAGPRGATAGVRTVITAETCRQSDSELQLQPACVSHCLWWEVLSQDPCKGGSLTFFLGFPGATWPAAVGEVLVGNFLQPPPEAPEKALVVREAPPLGPQAGASPGPGCHTSVS

SEQ ID NO: 1018045 - protein, 139 aa, Homo sapiens
MKPATALLCSCSCWAWLDPGEPRLGCGPSSLQKRAGRAIQNYNYNQHAYPTAYGGKYSVKTPAKGGVSPSSSASRVQPGLLQWVKFWYGGKVGHHKAEQGNFLQPPPEAPEKALVVREAPPLGPQAGASPGPGCHTSVS

SEQ ID NO: 1018046 - protein, 179 aa, Homo sapiens
KQYSPLPKKAEGDLGPSWFCGFSNLEPQLEKRASLHQRDVLLTELSNCTVRLYGNPNNLRLTKAQQLQAPLRSGVNLVFLENSINCFLEVAAKQLRIHSKKNTRIFLQVTSRAIVEDCSGIQFAPYTWSYPEIDKDFESSGLDRSKNNWNDVDDFLAGARDMALPTLEYLPEERNIQWD

SEQ ID NO: 1018047 - protein, 153 aa, Homo sapiens
FAAASTEEGGIGFVVADNPKIQQEVLVTPGRNADARVGQFVKVKITHWPTPRFQPQGDVIEVVGNYMAPGMEIDVALRTYDIPHVWPEAVLKEAAKLKPEVEDKDKEKRVDLRHLPFVTIDGEDARDFDDAVYCEAKPGKLRLFSGVDAAAKL

SEQ ID NO: 1018048 - protein, 103 aa, Homo sapiens
PGWGHHYRTPLPWPAVGLPKRGGLAIPDAAEKQMCGKGVELSSASLLQAPEHSCPGCQCGAFAFQRLGPLGLNSNLTAEGQVPYSPGVCLLIPAVSSGPDRKV

SEQ ID NO: 1018049 - protein, 435 aa, Homo sapiens
RGPRGREAKRLGGPASERGENKAAELARRAQCRDTLQLPPPPPSLALCSLILPPGPPPCRSLRWERTKSTKKVQVVPEAASQFLSPVGAEFVRVSLSEKGPPTVYKDVEVGCTAVLHGTAVLDYLTADILELAGNAARDNKKGRVTPRHILLAVANDEELNQLLKGVTIASGGVLPNIHPELLAREAGDPKEKLEAIITPPPAKKAKSPSQKKPVSKKAGGKKGARKSKKKQGEVSKAASADSTTEGTPADGFTVLSTKSLLGRTELIPVNSISGFEVRHNQSTNADIDLRRLGNLEKTRWQGVCGSCLELRKKNGPLEVAELLSAQAMAAAKFVIHCNSPVWGADKCEELLEKTVKNCLALADDKKLKYIAFPSIGSGRNGFPKQTAAQLILKAISSYFRVYQCPSTIKTVYSVLFDSEKYRLYVQEMAKQDAN

SEQ ID NO: 1018050 - protein, 438 aa, Homo sapiens
RGPRGREAKRLGGPASERGENKAAELARRAQCRDTLQLPPPPPSLALCSLILPPGPPPCRSRGGKKKSTKKVQVCQKQESFLSPVGAEFVRVSLSEKGPPTVYKDVEVGCTAVLHGTAVLDYLTADILELAGNAARDNKKGRVTPRHILLAVANDEELNQLLKGVTIASGGVLPNIHPELLAREAGDPKEKLEAIITPPPAKKAKSPSQKKPVSKKAGGKKGARKSKKKQGEVSKAASADSTTEGTPADGFTVLSTKSLFPGPEVAQLYRLDIASIDSDAVVHPKNTDFYIGGEVGNTLEKTRWQGVCGSCLELRKKNGPLEVAGAAVSQAMAAAKFVIHCNSPVWGADKCEELLEKTVKNCLALADDKKLKYIAFPSIGSGRNGFPKQTAAQLILKAISQLLRVYQCPSTIKTVYSVLFDSEKYRLYVQEMAKQDAN

SEQ ID NO: 1018051 - protein, 373 aa, Homo sapiens
MANTTGEPEEVSGALSPPSASAYVKLVLLGLIMCVSLAGNAILSLLVLKERALHKAPYYFLLDLCLADGIRSAVCFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 1018052 - protein, 373 aa, Homo sapiens; identical to SEQ ID NO: 1018051

SEQ ID NO: 1018053 - protein, 85 aa, Homo sapiens
WSGPIQERQLTGKIQNGLLKAGPGQPQACFLFIARCKLTLGVATRWRQTQPSLAWASVGATNWQAVQVPGIHFISFKITRPRIVD

SEQ ID NO: 1018054 - protein, 286 aa, Homo sapiens
MTLPIPDNVARQVSLCRSRDRIFVVGGKLLWLCLLGVAVLLPLLAIFWRGFSSEAGQGGGLVAARELVTSDNFHWLLGNSLKVSGSVAAIVVPLAYLFAYALQRTLIPGKAIWRGMSLLPLMAPSMLPGIALVYLFGNQGMLRGLLSDNIYGFWGIVLGEVIYTFPHALMILLSALSLADARLFDAASSMGASPARAFRSITWPATRQAVFAAFCLVFTLTITDFGVPVVVGGDYQVLALEAYKAVVGQQQFGRGALIGMVLLLPALFSFGVDAWLRRRHGDSMSG

SEQ ID NO: 1018055 - protein, 242 aa, Homo sapiens
ENNRPPPDLCEFFCKHCRERPRSMVVIEVFTPVVQRILKHNMDFGKCPRLRLFTQEYIPALNELNAGMEVVKKFIQSMHGGTGHCPHPRVLPNLVAVCLAAIYSCYEEFINSRDNSPSLKEIRNGCQQRRPEAHFTSALLHPSPDLVSQEATLSEARLKSVVVASSEIHVEVERTSTAKPALTASAGNDSEPNLIDCLMVSPACSTMSIELGPQADRTLGCYVEILKLLSDYDDWRPSLGQF

SEQ ID NO: 1018056 - protein, 132 aa, Homo sapiens
FTCLVILFACEAAAIWGFVNKDQIAKDVKQFYDQALQQALDDDANKAVKTHETLNCCGSLTLTTVLKNNLCPSGSNIFSNLFKEDCPQKNDDLISGKLYLIGIAAIVVLVNMIFEKILSMVLCCGIRNSSLY

SEQ ID NO: 1018057 - protein, 92 aa, Homo sapiens
MARMDSTTQARKTSASLLTYLTPTKTTRAMSTSVHVPYTRMLCSMAAALPPAAYASKMAAPGEMYVRKISMVPEIYMAPANVGPIRNNFRGS

SEQ ID NO: 1018058 - protein, 92 aa, Homo sapiens; identical to SEQ ID NO: 1018057

SEQ ID NO: 1018059 - protein, 73 aa, Homo sapiens
STLRTNVLSFSGISRGMVVRTSMMADSGMLTLGLEALGGTKNSRRKRSYGHSPSAGAGGTSATEPTPWSRAAA

SEQ ID NO: 1018060 - protein, 232 aa, Homo sapiens
GAPHPPSRMHNSPTQNLPVPHCPPHNAHSPPRTSSSPASVNDSRGPRTTEPSTKSMMEVERKLAHRKTSKFPENPRESKQLAWERLVGEIAFQLDLQILSSIFPERVRLYGFTVSNIPEKIIQASLNPSDHKLDEKLCQRLTQRYVSVMNRLQSLGYNGRVHPALTEQLVNAYGILRERPELAASEGGPYTVDFLQRVVVETVHPGMLADALLLLSCLSQLAHDDGKPMFIW

SEQ ID NO: 1018061 - protein, 185 aa, Homo sapiens
GAPHPPSRMHNSPTQNLPVPHCPPHNAHSPPRTSSSPASVNDSRGPRTTEPSTKSMMEVERKLAHRKTSKFPENPQASLNPSDHKLDEKLCQRLTQRYVSVMNRLQSLGYNGRVHPALTEQLVNAYGILRERPELAASEGGPYTVDFLQRVVVETVHPGMLADALLLLSCLSQLAHDDGKPMFIW

SEQ ID NO: 1018062 - protein, 436 aa, Homo sapiens
LHFFNQSTPQPAHYTTAITFSSHYGYHGDFYIDIYRYPYLTTNNHHSLICGHHWFITYDDRPHLSVHSLQHVCKANKCHSFISHCPEYRNLIFVSMMSATTPSGGSTFTSTENTPTRSLLTSFPVTHSFSSSMSASSVGTTHTQSISSPPAITSTLHTTAESTPSPTTTMSFTTFTKMETPSSTVATTGTGQTTFTSSTATSPKTTTLTPTSDISTGSFKTAVSSTPPITSSITSTYTVTSMTTTTPLGPTATNTLPSFTSSVSSSTPVPSTEAITSGTTNTTPLSTLVTTFSNSDTSSTPTSETTYPTSLTSALTDSTTRTTYSTNMTGTLSTVTSLRPTSSSLLTTVTATVPTTNLVTTTTKITSQQYILDFTSSMATTETLLTQYSQIHFFNHHYRDPLTQYSQIHFFNHQYQDHLTQLSQLHFFDHHHRLDR

SEQ ID NO: 1018063 - protein, 264 aa, Homo sapiens
AFKSSIYRILIATDVASRGLDILRYRCHQPQHPRLPKIYIHRVGRTARAGRQGQAITLVTQYDIHLVHAIEEQSKKKRGGVLRGRGARCYMILTQVNVVRRECEIKLEAAHFDEKKEINKRKQLHPGSGIGPCAWQAKRKADAGPKINAEEAGRLQRMRGGWMTAECDSKAWQGLATTGSSTPTDTRLCGAIVRPSPLPGPGLEPHTAICPVLDLSMELRVGGTFLGGSSPSRGPTQCPTAKPVGARVVRALLLCPETTGWSLP

SEQ ID NO: 1018064 - protein, 104 aa, Homo sapiens
FAAASTAKPRSTEPQTGFSFPEVLNRWPQYSSDNFMPGMRKVRVYSVHEFQESTPSAEGLAGTEPVTTYKLAIGDRVNKIDHNSFQLVQSGVTLTREPETSTAS

SEQ ID NO: 1018065 - protein, 125 aa, Homo sapiens
ERPRPQLVLDMRGVGAVARSGPGLNAPRKGHLWGHSKKAAVCKPGGEPSPETSQKSANTLISGFQLQSNEKTNFFVSWFPFVIGTLMKPFSVALEMAENEGREIKCYNSEHGAHLPGSPELDSER

SEQ ID NO: 1018066 - protein, 170 aa, Homo sapiens
MSSPDAGYASDDQSQTQSALPAVMAGLGPCPWAESLSPIGDMKVKGEAPANSGAPAGAAGRAKGESRIRRPMNAFMVWAKDERNAVAQQNPDLHNAELSKMLGKSWKALTLGGESGPFVEEAERLRVQHFWGTNPNYKVPGLGGRKARLKRVEAGWKGLDFLGTGLVEPE

SEQ ID NO: 1018067 - protein, 162 aa, Homo sapiens
MQLWIPKDKSKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEKRGYRKKLEVTRHLPRWVGKKAL

SEQ ID NO: 1018068 - protein, 154 aa, Homo sapiens
MRKDTDDIESPKRSIRDSGYIDCWDSERSDSLSPPRHGRDDSFDSLDSFGSRSRQTPSPDVVLRGSSDGRGSDSESDLPHRKLPDVKKDDMSARRTSHGEPKSAVPFNQYLPNKSNQTAYVPAPLRKKKAEKRGYRKKLEVTRHLPRWVGKKAL

SEQ ID NO: 1018069 - protein, 154 aa, Homo sapiens; identical to SEQ ID NO: 1018068

SEQ ID NO: 1018070 - protein, 65 aa, Homo sapiens
MSARRTSHGEPKSAVPFNQYLPNKSNQTAYVPAPLRKKKAEKRGIPQEAWKYPPPPPLGGEEGPS

SEQ ID NO: 1018071 - protein, 261 aa, Homo sapiens
ENKCEGQSPRNNNVIPFKTRGEEQILPLHFNSSQCHENDNLVNVDVSVNLLEDLPTLKEKKKASNWQKFGDKDFRTGLENGILLCELLNAIKPGLVKKINRLPTPIAGLDNIILFLRGCKELGLKESQLFDPSDLQDTSNRVTVKSLDYSRKLKNVLVTIYWLGKAANSCTSYSGTTLNLKELKDVAQMRKDTDDIESPKRSIRDSGYIDCWDSERSDSLSPPRHGRDDSFDSLDSFGSRSRQTPSPDVVLRGSSDGRLET

SEQ ID NO: 1018072 - protein, 146 aa, Homo sapiens
ERPSVLAELWMMSSPCAPGRASDKALSFVLKENDSGEVNWDAFSMPELHNFLRILQLEEEEHLRQILQKCSYCRQKIQEALHACPLGRPLVPPRWKGKTSKASANVHACVKCDKGQVGPVGIEVFMDGPPVLGGMNPENSEVSLLP

SEQ ID NO: 1018073 - protein, 193 aa, Homo sapiens
MSHQLGGPGHSPPTMPDQLSLIPALPLRTAGPSQLSGSRFPVAKSHTPGEQPLPATPASLSGGQPLRVSGCPHPCVPTDSKGCGESAAGDRCPPLLEAGRPATHGAPRNPEAACSRSQKSAPRGTAASGRGTCRWPRSRRRPRSPAGGSRWAAARTRRSQAGGAAAGSGGSGPRGRRRAACCRCRRSRGRRRS

SEQ ID NO: 1018074 - protein, 102 aa, Homo sapiens
RRTDISDKDPKSTGERLGSHSPGSEAWGTILSLQPCIFQPSSFTLLLALEDSREPGQALGDSSANAEDRTSEVPSLGTHTLATVTGNGERTLRSVTLTNTSM

SEQ ID NO: 1018075 - protein, 124 aa, Homo sapiens
WLLTQHNICRCDRKLCSYPEGVNGFSVTQFSDSTSLEESHTALGDRSYSESSSTSSSESLNSSAPRGERSTLEDSREPGQALGDSSANAEDRTSEVPSLGTHTLATVTGNGERTLRSVTLTNTS

SEQ ID NO: 1018076 - protein, 164 aa, Homo sapiens
MKTTIRWTKTHDATHAATRRDHESYLQGVTQPIEARTYDSRHGHNRRKNIGQIRTAVAPRLPQVPPPDKTVQQSTLSTNLGQRTHHQGKEDSPSERDGQGRHRRETTYAQEDKTCPPHHRPPPSEKKPRADKKQIYTAYGPTDGEDRHSYQWQTGASDAVTPHQ

SEQ ID NO: 1018077 - protein, 66 aa, Homo sapiens
HIIIGSPVPQDQLQIIIAVTDMLHHCQFTHPSYCTTIPTPTWLSSGHSIYGNPSVIQFCQSVSFLG

SEQ ID NO: 1018078 - protein, 86 aa, Homo sapiens
FLRLGLTLSPMVLECSGVILAHCSPDLPHPPISASSSWTTGGCTMPSQSLYFLQKWGFAMLPRLALNSWAQVIHSPRFPKVLGLQA

SEQ ID NO: 1018079 - protein, 104 aa, Homo sapiens
MWCMPHPKKPGHILVLLDTKGLGDVEKGDNQNDSWIFALAVLLNSTSMYNSMGTINQQAMDQLHYVTELTHRVQPKSSPDENENEDSADFASFFPDFVLTLRDF

SEQ ID NO: 1018080 - protein, 216 aa, Homo sapiens
CVVFNQGELDAMEYHTMIRELILDGSLQLIQEGLKSGFLYPLFEKQDKGSKPITLPLDACSLSELCEMAKHLPSLNEMEHQTLQLVEEDTSVTEQDLFLRVVENNSSFTKVITLMGQKYLLPPKSSFLLSDISCMQPLLNYRKTFDVIVIDPPWQNKSVKRSNRYSYLSPLQIQQIPIPKLAAPNCLLVTWVTNRQKHLRFIKEELLSLLVCGGSC

SEQ ID NO: 1018081 - protein, 216 aa, Homo sapiens; identical to SEQ ID NO: 1018080

SEQ ID NO: 1018082 - protein, 190 aa, Homo sapiens
FAAASTLAFDMNLAFVVLFEKGHAPQQGAFARAGRADQAHHFGMPDLQVDPLEYTQGAEALADIVQAHHGLRVAGELFGGLHGVTLFRDNGWQGALLDSHCGCLLIKRPTRVSRTMPRREQNSTSSSIADTQHQQGFDESEGLRADTGHDHGQLRDGDDRQHRGFLAQDGHQVDQRRQDDHQHLRNLVAQ

SEQ ID NO: 1018083 - protein, 77 aa, Homo sapiens
LHLHESCVLSLKFASSGRWFVSPGKDNLLNAWRTPYGASIFQSKESSSVLSCDISRNNKYIVTGSGDKKATVYEVVY

SEQ ID NO: 1018084 - protein, 178 aa, Homo sapiens
EKRENPPASRKCAKTGVSPGYLLWVLYTALTSTMGTHPAQGFRFWPPCALVGPSGAGYSKSFLLRRDSGPIRCTLNTAQTSCPVAACHSQRNQDPRTRYGPRRAALALLMEFKKGRTYVAGGARRRGLLAVLSSLCQERSQFQDALLFDLHCLFIVFLNVTLHDGVEDVDGGLPVGAE

SEQ ID NO: 1018085 - protein, 163 aa, Homo sapiens
STLVLRLRGGIQIFVKTLTGKTTTLEVESSDTIESVKTKIQDKEGIPPDQQSLIFVEKQLEDGRTLSDYNIQKESTLHLVLRLRGGMQIFVKTLTGKTITLEVESSDTIESVKTKIQDKEGIPPDQQRLIFAGKQLEDGRTLSDYNIQKESTLHLVLRLRGGN

SEQ ID NO: 1018086 - protein, 101 aa, Homo sapiens
KRYVLPTHACLPHPHRIIKCSWYQTQFCVRFYAYFLNTNSEATPCASCPTQRCFNHLTFNSFAAKDHITSMPVGYENWPTSCMKMLQELGRYIRESIAKPD

SEQ ID NO: 1018087 - protein, 430 aa, Homo sapiens
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGLIECYLASNSIREAHGNG

SEQ ID NO: 1018088 - protein, 259 aa, Homo sapiens
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTIW

SEQ ID NO: 1018089 - protein, 144 aa, Homo sapiens
MDPGDAAILESSLRILYRLFESVLPPLPAALQSRMNVIDHVRDMAAAGLHSNVRLLSSLLLTMSNNNPELRRELPGAEEKAAAVWERGAQGTWEQAGRSGRRRQRRLRGLRGRPGAEQTSERKLGSLGAGVKSRGDVASGGLET

SEQ ID NO: 1018090 - protein, 438 aa, Homo sapiens
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKINMMLANLYKKAGQERPSVTSYKEVLRQCPLALDAILGLLSLSVKGAEVASMTMNVIQTVPNLDWLSVWIKAYAFVHTGDNSRAISTICSLEKKSLLRDNVDLLGSLADLYFRAGDNKNSVLKFEQAQMLDPYLIKGMDVYGYLLAREGRLEDVENLGCRLFNISDQHAEPWVVSGCHSFYSKRYSRALYLGAKAIQLNSNSVQALLLKGAALRNMGRVQEAIIHFREAIRLAPCRLDCYEGKKEVPLGQHFPSVRIIWGLAGRGGSP

SEQ ID NO: 1018091 - protein, 176 aa, Homo sapiens
MDPGDAAILESSLRILYRLFESVLPPLPAALQSRMNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGIPSRQRTPKACCPFL

SEQ ID NO: 1018092 - protein, 295 aa, Homo sapiens
MCQYIAKHYNMSKSKVVNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKNPLSQERDYIDQVGTKVIEQLGNTMSQNSCTKLQPTSKETMLENRAEVLRELTFPKFFPDSLF

SEQ ID NO: 1018093 - protein, 313 aa, Homo sapiens
NYCFGRKYISTRPCFPNKTCQKMLIILTSALQIAHRCICRILLGSRVLAAKASGNCTLNSEDFIFNIGSAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKNPLSQERDYIDQVGTKVIEQLGNTMSQNSCTKLQPTSKETMLENRAEVLRELTFPKFFPDSLF

SEQ ID NO: 1018094 - protein, 80 aa, Homo sapiens
MGKTQKVKVLTGTGNVNVIHPNYPAARRDFLQTFRRGCWVRDAGPRRLRGTPELRLCPELVRVGRAGRCGLPDLLTWVVE

SEQ ID NO: 1018095 - protein, 392 aa, Homo sapiens
MVEADRPGKLFIGGLNLETDEKALEAEFGKYGRIVEVLLMKDRETNKSRGFAFVTFESPADAKAAARDMNGKSLDGKAIKVAQATKPAFESSRRGPPPPRSRGRPRFLRGTRGGGGGPRRSPSRGGPDDDGGYAADFDLRPSRAPMPMKRGPPPRRVGPPPKRAAPSGPARSSGGGMRGRALAVRGRDGYSGPPRREPLPPRRDPYLGPRDEGYSSRDGYSSRDYREPRGFAPSPGEYTHRDYGHSSVRDDCPLRGYSDRDGYGGRDRDYGDHLSRGSHREPFESYGELRGAAPGRGTPPSYGGGGRYEEYRGYSPDAYSGGRDSYSSSYGRSDRYSRGRHRVGRPDRGLSLSMERGCPPQRDSYSRSGCRVPRGGGRLGGRLERGGGRSRY

SEQ ID NO: 1018096 - protein, 392 aa, Homo sapiens; identical to SEQ ID NO: 1018095

SEQ ID NO: 1018097 - protein, 153 aa, Homo sapiens
WNLLRYNNSYLQKELCFHNANFPASSYILATGSHGLGLVYSGFGYKLPYPVLCFLGTRIAAMARPFLKRRESIARKNLELCFPQHSAEEREKMIAENFRSLGMALVETGMAWFWPDSRVRKWFDVEGLDNLKRAQMQNRGVMVVGVHFMSLEL

SEQ ID NO: 1018098 - protein, 175 aa, Homo sapiens
MSPTISHKDSSRQRRPGNFSHSLDMKSGPLPPGGWDDSHLDSAGREGDREALLGDTGTGDFLKAPQSFRAELSSILLLLFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRHPT

SEQ ID NO: 1018099 - protein, 157 aa, Homo sapiens
MSPTISHKDSSRQRRPGNFSHSLDMKSGPLPPGGWDDSHLDSAGREGDREALLGDTGTGDFFLYVLQGIPLGLAGSIPLILQSKNVSYTDQAFFSFVFWPFSLKLLWAPLVDAVYVKNFGRRKSWLVPTQYILGLFMIYLSTQVDRLLGNTDDRHPT

SEQ ID NO: 1018100 - protein, 285 aa, Homo sapiens
MHSARLDSFLSQLRWELLCGRDTGSPSMPGPLQPTSQTGPDVQPSHQLRASGALEEDSVCCVEEEEEEEEEAVVTEDRDAALGGPREHALDWDSGFSEVSGSTWREEELPVSQRPAPSAQPLRRQCLSVSGLPMPSRAPVASVPPVHHPRPKSTPDACLEHWQGLEAEDWTAALLNRGRSRQPLVLGDNCFADLVHNWMELPETGSEGGDGGGHRARARPPQFLLGLSEQLRRRLARARRTAMAGKRLSCPPRPEPELPADVSRFAALMSCRSRQPIICNDVSYL

SEQ ID NO: 1018101 - protein, 139 aa, Homo sapiens
MGHFTEEDKATITLWGKVNVEDAGGELGRLLVVYPWTQFFLASASAIMGNPKVQANGKKAMTSLGDAINHLDDVKGTFPQLSELHCHKLHVDPENFKLLGNVLVTVLAIPFGKEFTPEVQASCQKMVTGVASALSSRYH

SEQ ID NO: 1018102 - protein, 146 aa, Homo sapiens
MAGELTPEEEAQYKKAFSAVDTDGNGTINAQELGAALKATGKNLSEAQLRKLISEVDSDGDGEISFQEFLTAARKARAGLEDLQVAFRAFDQDGDGHITVDELRRAMAGLGQPLPQEELDAMIREADVDQDGRVNYEEFARMLAQE

SEQ ID NO: 1018103 - protein, 146 aa, Homo sapiens; identical to SEQ ID NO: 1018102

SEQ ID NO: 1018104 - protein, 132 aa, Homo sapiens
EAIGHMKEGEEEKTKTYSALIWANKAIQKKDIDFLNDIKDFKNRPENTFARPSPKPLAVRARVIHFMETQYVDEHHFRLHLKTQAGTYIKEFVHGDFGRTKPNIGSLMNVTADILELDVESVDVDWPPALDD

SEQ ID NO: 1018105 - protein, 40 aa, Homo sapiens
MIISISDVYYDYSDSNYFLYYTETVCAFSLLPRHLGNPPP

SEQ ID NO: 1018106 - protein, 156 aa, Homo sapiens
MELMPLCRIASPLSSRVALCGPVCLQSVLFWSQDVFGHPLWFCACPRAPQGEERHRGRAPAGTTGGRQGRKQAPPGEGHSGGPSNAFWFWGERGRNRGPGQQGGKEREKGPVGEDKKKGGGGEAGGKRKGGGSRGGRAGGSHIDIPFFPGTLASSW

SEQ ID NO: 1018107 - protein, 111 aa, Homo sapiens
RNAIYQNRLALDYLLAAEGGVCEKSDLTNYCLHIDDQGQVVEDIVKDITKLAHAPVQVWHGLNLGAMFGNWFPAIGGFKTLIIRVIIVIGTCLLLPCLIPVFLQMIKNFVA

SEQ ID NO: 1018108 - protein, 110 aa, Homo sapiens
MKPFFDLTDFYHFWRVPVKNSDPEKPSDVTFCDSLDFSVRSVLDDILAGKDIKRRKKCNRAWILNFTGGFTMILPDVPDIIELEMNRNSGYHMGYFRDSPDEISCICWYK

SEQ ID NO: 1018109 - protein, 188 aa, Homo sapiens
FRWDLIRACATCSSSGQQRAQGRMREDVSAGEDCGPLPEGGPEPRSSGAKPGPREGKRSYSMEHLRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 1018110 - protein, 188 aa, Homo sapiens; identical to SEQ ID NO: 1018109

SEQ ID NO: 1018111 - protein, 103 aa, Homo sapiens
RVRRLEVSGRAWWLTKWSWRFGRPRRMDHPRPGVRDQPGRHGETPSLQKIQKLARQWWCVPVSPATVRSEAGESLGPGRWRLQRAEIELLHSSLGDRARLRLK

SEQ ID NO: 1018112 - protein, 101 aa, Homo sapiens
PGRPSSSLAVSCPSPLPYFLICAFFSRNRKVGSRWGATPFIPVFPPLITSPHPRRSSQAWGGPPGGCGADSTFVLRRPGLLIEQCAAVNIFDNLLPIKFCL

SEQ ID NO: 1018113 - protein, 107 aa, Homo sapiens
MVNDMRNPGLGGLQDSLELCYTTNLWQNSVGCVIRAECLSHAFSLSGPAHTSSRATIHGLAGMLSLHTDELSTTLLTWEPEAEQASSERSGVEADIPTSRSIFLVLL

SEQ ID NO: 1018114 - protein, 92 aa, Homo sapiens
KAAEMTGVGPTPAWRRVEPFTQNEPGGELGKEHVGSGMRGGMNGGSSSVCKNSSAGLTGHHHSSLAVGSGQSCCPGRRGPCSLVSHYLLLSF

SEQ ID NO: 1018115 - protein, 2056 aa, Homo sapiens
AEASSLGRQSPRVVSCLEHSLCPGEPGLQTTAVVSMGSGDHQFNLAEILSQNYSVRGECEEASRCPDKPKEELEKDFISQSNDMPFDELLALYGYEASDPISDRESEGGDVAPNLPDMTLDKEQIAKDLLSGEEEEETQSSADDLTPSVTSHEASDLFPNRSGSRFLADEDREPGSSASSDTEEDSLPANKCKKEIMVGPQFQADLSNLHLNRHCEKIYENEDQLLWDPSVLPEREVEEFLYRAVKRRWHEMAGPQLPEGEAVKDSEQALYELVKCNFNVEEALRRLRFNVKVIRDGLCAWSEEECRNFEHGFRVHGKNFHLIQANKVRTRSVGECVEYYYLWKKSERYDYFAQQTRLGRRKYVPSGTTDADQDLDGSDPDGPGRPRPEQDTLTGMRTDPLSVDGTAGGLDEPGVASDGLPSSEPGPCSFQQLDESPAVPLSHRPPALADPASYQPAVTAPEPDASPRLAVDFALPKELPLISSHVDLSGDPEETVAPAQVALSVTEFGLIGIGDVNPFLAAHPTCPAPGLHSEPLSHCNSDDLLTPGRGRRMRPRLDLALPLGPPLSVFLTPSPPPGPWGSTSFCFRTRQDWGGGGWAVSPCPCPHRMDPRPHPAPSAPGTATRVRAAACTWDPSGSRGQKRPRRWDAGQSRPPSPFQPAEAREGVTAPAGRRAGRPAPHQQPPPGRPQLPAWLCLSTPGRAAGCPSPGGRGQLLLSANPVGHRAIYLAVRPPPQPRLPTPSSPLQEKPHFTPPPASSPSIPAPDPERLGWGPSATPGVGLRRQVIYIPFAVLPRYQGREPPEEPALLATQGPDSSLFPQPCRSSFCGKLPSKMAWSPGPPPPWPSRLFLFLFDTLEWGPPWAAARPAPGVVRPLVLEPLSELDSTIPHPTKDHTVKDNCLEPPFAVLFIKLDLKPGVPCGGSGGGWGGRCPRHLTWGPACLLEGPGKVVSNTGEGVHRGHDVVGYVIVHVSKGIVATMTGCEEGPRLGRGGRGSLLEVIFKLKHEGEWASFAESLPRGLAGVTADAEDRGLGLQEKLRAQRAEVGRGGDSEVMRPSFVLGVEATLGLHCFFVLFCFFFLDRVSHCRQAGVQWCDLGSLQPPPPEFTRFSCLSLPSSWDYRRPPPGITGARHHAQLLFIFFVEMGFLLIAQDGLYLLTLCSPASASQSAGITGVRHRARLRSALLIAPCRDGAGWLGCILSTSVREMWACMVMGYGEGRPPAEEVTVAWPQGLLVKDQDHLHDGCGRVRGLAGEPVPGAVRTRASHWATWVFGDGRRGVFIGAPQPADVFFRCARSSVFQLALPPAGNLQSSLGFFPPTALKIFQYHWFLSSLMRMCFGVLRCLMRVCFGVLRSLMRMCFGVLRCLMRMCFGVLSLMRMCFGVLSLMRMCFGVLRCLMRMCFGVLSLMRMCFGVLRCLMRMCFGVLRCLMRVCFGVLRCLMRMCFGVLRSLMRMCFGVLSPMRMCFGVLRCLMRMCFGVLSLMRMCFGVLSLMRMCFGVLRCLMRMCFGVLSLMRMCFGVLRSLMRMCFGVLSLMRMCFGVLRCLMRMCFGVLSLMRMCFGVLSLMRMCFGVLRCLMRMCFGVLSLMRMCFGVLRSLMRMCFGVLSLMRMCFGVLRCLMRMCFGVLSLMRMCFGVLSLMRMCFGVLRCLMRMCFGVLRSLMRMCFGVLMRMCFGVLRCLMRMCFGVLSLMRMCFGVLSLMRMCFGVLSLMRMCFGVLRCLMRVCFGVLRSLMRMCFGVLSLMRMCFGVLRCLMRMCFGVLSLTRMCFGVLSLKRMCCGVLRCLMRMYFGVLRCLMRMCFGVLRSLMRMCFGVLSLMRMCFGVLRCLMRMCFGVLRSLMRMCFGVLRSLMRMCFGVLSLMRMCFGVLRSLMRMCFGVLSLMRMCFGVLRCLMRMCFGVLRCLMRVCFGVLSLMRMCCGVLRCLMRMCFSVLMRLCFSVLSLMSMCFGVMSLMRMCFGVLRCLMRMYFGVLRCLMRMCFGVLRSLMRMCFGVLRSLMRMCFGVLSLMRMCFGVLSLMRMCFGVLMRMCFGVLRCLMRMCFGVHVQYVAFEIGFFHIH

SEQ ID NO: 1018116 - protein, 73 aa, Homo sapiens
DSPGLVQFQGSRVLQLFVLKGKVPSSANAVFLGYGGAMLAHPWQVWLLSSAKTLIPCEAGQCFSSRAVGGVTA

SEQ ID NO: 1018117 - protein, 126 aa, Homo sapiens
PLSLEETTASDLRCGSSAWLRTDLSDWHALEWPLFVQEYLSRHSRSQSVVRELRSWQLPPDRCGPWGLPSLWLCLPGLAPACSPGTRCLCLWAFSFLMTEALLVFSPESSLLHSLSRKGRARCHWV

SEQ ID NO: 1018118 - protein, 102 aa, Homo sapiens
SRSIENRSDEEEAADLPTKPTVISKFGFAFSWMTKKASTISIKLGSNKPKETVPTLAPSTFSGAAAFNEDEDSEPEEISRSKDEDEEYWKGYTNISWTKLLQ

SEQ ID NO: 1018119 - protein, 94 aa, Homo sapiens
ESPDSSSAHLYRGIFPVCARTQSRRLGWGDPVNFAMNVGKARGFFKKGDVVIVLTGWHPGSGFTNTMRVGPVAGDGPQSPSSSPCPTPFPQPIH

SEQ ID NO: 1018120 - protein, 94 aa, Homo sapiens; identical to SEQ ID NO: 1018119

SEQ ID NO: 1018121 - protein, 132 aa, Homo sapiens
PGHVMKVPRENHCSPGSSYQQSPGEMQLNTNYESLQNPAEFYDNYYAQHSIHNFQPPNNSGDGMWHGEFAQQQPPVVQDSPNHGSGSDGSSTRTGHGPSVLLPGLLPAVQRALFVRLTQRYQEDEEQTSTNS

SEQ ID NO: 1018122 - protein, 80 aa, Homo sapiens
IDDKDEFLKPLEFDHHFPLSQIIPKAPGKIIPSRNTDTSVVVSWEESKDAKELVGYYIEASVAGSGKWEPCNNNPVKGSR

SEQ ID NO: 1018123 - protein, 223 aa, Homo sapiens
YVLEKKHRGSETHWPCLRRAGEPQSWDSSSVFPPQSPSSLNQGRCWLPLCEGSALWEMKRTSRSLLVDMCWARRHRVSQGKDFGLGFRMGPLGAIVVARGNECERTILPPDSPVPFLTHRAPGSGRKKPEKPAAISYEPLGRGADGEHRAGVLPLRTACSTPARPRRHLLAGAPLCLHRALAGAEPPPKRSHSRIFKAALSNPLSDRADLGQPLAVMVAGGGD

SEQ ID NO: 1018124 - protein, 82 aa, Homo sapiens
MTPRQDLVIGLTRTHGSHPPIGQNQTKSSRPQDQTQQSTRSTKEQGNRAASTKARRRGTRKEMPQHETADRERATLEQGTPQ

SEQ ID NO: 1018125 - protein, 208 aa, Homo sapiens
PLAYCTWLLTVGFPRQDTHQVLRPCTLTTVVQHHWTTPPQRNKDQLIRAAVKFLDTDTICYRVEEPETLVELQRNEWDPIIEWAEKRYGVEISSSTSIMGPSIPAKTREVLVSHLASYNTWALQGIEFVAAQLKSMVLTLGLIDLRLTVEQAVLLSRLEEEYQIQKWGNIEWAHDYELQELRARTAAGTLFIHLCSESTTVKHKLLKE

SEQ ID NO: 1018126 - protein, 106 aa, Homo sapiens
SWSNKWHSLTSSLVPSGLASVPAAASVARSYRVEEPETLVELQRNEWDPIIEWAEKRYGVEISSSTSIMGPSIPAKTREVLVSHLASYNTWALQGPVSGEAQSVLG

SEQ ID NO: 1018127 - protein, 73 aa, Homo sapiens
GGRWRRPREVEGSEEALRGFRTACGAGFLGFWGLGLSVTLRFPPRHSALVRLSGGQPDFNPGAPGLASSECRR

SEQ ID NO: 1018128 - protein, 208 aa, Homo sapiens; identical to SEQ ID NO: 1018125

SEQ ID NO: 1018129 - protein, 136 aa, Homo sapiens
PLAYCTWLLTVGFPRQDTHQVLRPCTLTTVVQHHWTTPPQRNKDQLIRAAVKFLDTDTICYRVEEPETLVELQRNEWDPIIEWAEKRYGVEISSSTSIMGPSIPAKTREVLVSHLASYNTWALQGPVSGEAQSVLG

SEQ ID NO: 1018130 - protein, 130 aa, Homo sapiens
RPPRMGKSNSKLKPEVVEELTRKTYFTEKEVQQWYKGFIKTALTPTPCVHPAFFRIHTQPAALDPGGPGSPLPCPAPIPRLKPPAPIASNLCLSGKRQHEMEKATALCINQGLGCLAGSLRSSRSLARVL

SEQ ID NO: 1018131 - protein, 170 aa, Homo sapiens
VDRIFAMMDKNADGKLTLQEFQEGSKADPSIVQALSLYDGLVYPRLELDAWEPLTSFCAMRHLSPDTNPVRPPSLLPHPHTALTPTPCVHPAFFRIHTQPAALDPGGPGSPLPCPAPIPRLKPPAPIASNLCLSGKRQHEMEKATALCINQGLGCLAGSLRSSRSLARVL

SEQ ID NO: 1018132 - protein, 105 aa, Homo sapiens
VDRIFAMMDKNADGKLTLQEFQEGSKADPSIVQALSLYDGLVYSQAGAGCLGTTHLLLCHEATSALTPTPCVHPAFFRIHTTHSRLPLTREAPALLSPVLHPSPA

SEQ ID NO: 1018133 - protein, 103 aa, Homo sapiens
FFLKKKIARELPLNRGILALKAKEFGTRAKLVLPKWITFDYGIVRKQETLRFIYCINIPSMCIRSRERWRLLGNSAHALYQPLLRWWLQEKLNCQLQTSFFFF

SEQ ID NO: 1018134 - protein, 265 aa, Homo sapiens
MKKIFLKLHILQEKNHKCFSVLWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILNTIGVLEEPLGNARLHGARSWQHCCTQTHPGSNRSSAGQHDGLTAGTCAFKVQPGNNFLDFPVELMIGGISSQAAREEEDRKPRDREQVEPPWNGDRA

SEQ ID NO: 1018135 - protein, 427 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILNTIGVLEEPLGNARLHGARSWQHCCTQTHPGSNRSSAGQHDGLTAGTCAFKVQPGNNFLDFPVELMIGGISSQAAREEEDRKPRDREQVEPPWNGDRA

SEQ ID NO: 1018136 - protein, 536 aa, Homo sapiens
MESLVLKVKAASFGGLKSSSFGLFTSKPMDSARPVVCIDRRLQGLTLSCSCRVLGSLCRRVQVGKCHLHGKKNAASLVVRMGSRRPRELAQRDLSGIAVESSPDVGAVTMFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILNTIGVLEEPLGNARLHGARSWQHCCTQTHPGSNRSSAGQHDGLTAGTCAFKVQPGNNFLDFPVELMIGGISSQAAREEEDRKPGTEKQVEPPWNGDRA

SEQ ID NO: 1018137 - protein, 536 aa, Homo sapiens; identical to SEQ ID NO: 1018136

SEQ ID NO: 1018138 - protein, 427 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILNTIGVLEEPLGNARLHGARSWQHCCTQTHPGSNRSSAGQHDGLTAGTCAFKVQPGNNFLDFPVELMIGGISSQAAREEEDRKPRDREQGEPPWNGDRA

SEQ ID NO: 1018139 - protein, 427 aa, Homo sapiens; identical to SEQ ID NO: 1018135

SEQ ID NO: 1018140 - protein, 447 aa, Homo sapiens
MDFQDLGLVLLRVDLQLAVTMFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILNTIGVLEEPLGNARLHGARSWQHCCTQTHPGSNRSSAGQHDGLTAGTCAFKVQPGNNFLDFPVELMIGGISSQAAREEEDRKPRDREQVEPPWNGDRA

SEQ ID NO: 1018141 - protein, 427 aa, Homo sapiens; identical to SEQ ID NO: 1018135

SEQ ID NO: 1018142 - protein, 106 aa, Homo sapiens
MCVLSGSGVCQAKSLYSRKRVQCCTKGEKVPVVYLDLSSDTERPLFLFQWLNEEKVIQRLVELIHPSQDEDVSVLLTELRASVQACAARSPTAAGQGAREGKSSLS

SEQ ID NO: 1018143 - protein, 95 aa, Homo sapiens
MFWKFDLNTTSHVDKLLDKEHVTLQELMDEDDILQECKAQNQKLLDFLCRQQCMEELVSLITQDPPLDMEEKVRFNVCTTAGDVHTQQSQQPQQF

SEQ ID NO: 1018144 - protein, 536 aa, Homo sapiens
MESLVLKVKAASFGGLKSSSSGLFTSKPMDSARPVVCIDRRLQGLTLSCSCRVLGSLCRRVQVGKCHLHGKKNAASLVVRMGSRRPRELAQRDLSGIAVESSPDVGAVTMFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNMFDGDRTESCLVSGTQVLLTLLETRRVGTEGLVDSFSQGLERSYAVSSSVLHGIEPRLKDFHQLLLNPPKKKAILNTIGVLEEPLGNARLHGARSWQHCCTQTHPGSNRSSAGQHDGLTAGLVPLRYSLGITFGTSKVELMIGGISSQAAREEEDRKPRDREQVEPPWNGDRA

SEQ ID NO: 1018145 - protein, 536 aa, Homo sapiens; identical to SEQ ID NO: 1018144

SEQ ID NO: 1018146 - protein, 110 aa, Homo sapiens
ASGPPPFWSDRSAARGPESVSSRRPAVPVSVGAAPSAGPMCVRPARGRPGFASTSALASARASTRASEELPRRPARRAGKEIINLPLNEKNFLKAAYTPRKKPQMFFCFA

SEQ ID NO: 1018147 - protein, 427 aa, Homo sapiens; identical to SEQ ID NO: 1018135

SEQ ID NO: 1018148 - protein, 427 aa, Homo sapiens; identical to SEQ ID NO: 1018135

SEQ ID NO: 1018149 - protein, 198 aa, Homo sapiens
RPPTSWRGRKMATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNGRREARALHHGYINGLFPNHPVPVSKAGFHSNTCPQLRIQAGPGGPHLRKGLKGPGRPRK

SEQ ID NO: 1018150 - protein, 261 aa, Homo sapiens
RPPTSWRGRKMATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNEIESHIIKQEDILNGKENEIKELQQVISQQKQIFSPPPAGSVAGITCLTSGSRSSRKATWPRCWTRSIRKPQGHVRPAATSIPGKNKMAAAFLFSGCNPQPLPSLLWESPASSPCYFPPSWIV

SEQ ID NO: 1018151 - protein, 154 aa, Homo sapiens
MEVSICILGKNVIAHIMHGMFGHLLLTPVIPAFWELRWVHHLRSEIENSLAHMVKPHLYCKISIISWAWCAGACNPSVSREAEAGELLELKEGGGFNDPDQAPHSSLATDQTQFPKPKKKKRKQEEGTGSTGKCNFLMRESFSKEATSVKTCRS

SEQ ID NO: 1018152 - protein, 215 aa, Homo sapiens
RPPTSWRGRKMATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNEIESHIIKQEDILNGKENEIKELQQVISQQKQIFRNHMSDFRIQKQQESYMAQVLDQKHKKASGTRQARSHQHPREK

SEQ ID NO: 1018153 - protein, 198 aa, Homo sapiens; identical to SEQ ID NO: 1018149

SEQ ID NO: 1018154 - protein, 162 aa, Homo sapiens
RPPTSWRGRKMATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNAFGQACPLLSKDLLLPSCGSSGPE

SEQ ID NO: 1018155 - protein, 173 aa, Homo sapiens
RPPTSWRGRKMATPLGWSKAGSGSVCLALDQLRDVIESQEELIHQLRNVMVLQDENFVSKEEFQAVEKKLVEEKAAHAKTKVLLAKEEEKLQFALGEVEVLSKQLEKEKLAFEKALSSVKSKVLQESSKKDQLITKCNEIESHIIKQEDILNGKENEIKELQQVISQQKQIFR

SEQ ID NO: 1018156 - protein, 92 aa, Homo sapiens
MNKILQVVQAKLSSPNKQRIKTKWPGQVIGWEVSAMHGLVSRGNFCAPTSQATQPWEEAGPGKALGTLVSVRKENCPGSSCNQCHNKSRVRP

SEQ ID NO: 1018157 - protein, 158 aa, Homo sapiens [sequence omitted]

SEQ ID NO: 1018158 - protein, 158 aa, Homo sapiens [sequence omitted]

SEQ ID NO: 1018159 - protein, 87 aa, Homo sapiens
ASPLDGEMVIITTNDAVSRYLMVMEDCLHPKLQSTKRFINVVQLPGTMKRRVYEEAQGLRRRIVVKNLEKGKLQTSWETCAKDFADY

SEQ ID NO: 1018160 - protein, 80 aa, Homo sapiens
ASPLDGEMVIITTNDAVSRYLMVMEDCLHPKLQSTKRFINVVQLPGTMKRRVYDRIVVKNLEKGKLQTSWETCAKDFADY

SEQ ID NO: 1018161 - protein, 93 aa, Homo sapiens
ARLNHAEFEDQDDEARVQYEGFQTWDMRLKKHRWYKKILKSRDPIIFSVGWRRFQTIPLCYIEDHNGRQRLLKPYHSTGNWFLGNTVCQWHNA

SEQ ID NO: 1018162 - protein, 116 aa, Homo sapiens
KNYSVSAGDPPVTVMSLVETVPNTPQISPAMAKKINDDIKYQLMKEVRRFGQNYERIFILLEEVQGSMKVKRQFVEFTIKEAARFKKVVLIQQLEKALKEIDSHCHLRKVKHMRKR

SEQ ID NO: 1018163 - protein, 66 aa, Homo sapiens
FPQAFKTAPLLRTHLVTLAGSRHGISRVRLRLLKSPPRSKHRYEGAGLLSKLKKPTQRRERRRIYD

SEQ ID NO: 1018164 - protein, 222 aa, Homo sapiens
AARTDWDPRSQAALSLRHLPRVRTTYGFCALLESPHTRRKESLLLGGPPAHRPRAHSCGGGGGPDAPLTLCGPRGPGPATPAAPGGPRLPQDALAAGPRRCRLLRVPDGLLSRALRAGRSRRLARVRSVSSGNEDEERRAGSESPARAPSSSPLSSRAPLPERLEAKGTVALGRAGDALRLAAEYCPGTRRLRLRLLRAESLVGGAPGPRAVRCRLSLVLRP

SEQ ID NO: 1018165 - protein, 105 aa, Homo sapiens
RRSHPMGCVRCVARVIKADERRAGSESPARAPSSSPLSSRAPLPERLEAKGTVALGRAGDALRLAAEYCPGTRRLRLRLLRAESLVGGAPGPRAVRCRLSLVLRP

SEQ ID NO: 1018166 - protein, 68 aa, Homo sapiens
RHEGDRRGPRGWPGPDLAGRAGDALRLAAEYCPGTRRLRLRLLRAESLVGGAPGPRAVRCRLSLVLRP

SEQ ID NO: 1018167 - protein, 150 aa, Homo sapiens
QTEQDDSVHHGALRHGPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQ

SEQ ID NO: 1018168 - protein, 147 aa, Homo sapiens
QTEQDDSVHHGALRHGPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGMQTSHALFMATTS

SEQ ID NO: 1018169 - protein, 75 aa, Homo sapiens
KPWVDMFQNKGMVLLSTFESLMTPGSGRSQEEMSGLKLNPCGRGSSPHVGFPRRSGSELFFQSVMWYKGRRHLKG

SEQ ID NO: 1018170 - protein, 68 aa, Homo sapiens
LLPKTTLSAIYIQTKPHGIDWLCFQCFLGAGFLAIVPRHSCGRPQFVMLDGGGSLSFTLSGGPGWTRG

SEQ ID NO: 1018171 - protein, 259 aa, Homo sapiens
IFRVPACRVSVRFGRKCVGYFGAVTWAGGLREAPGQSQPRAVPPQEPPSTASPGHCDAPSKRLPDAGTSGLRRLPSLLPLQQLRPSSLNLTQYVEASLCRRPAGLLEAQWARPGRAGTEPPRLGQWAWAGAVAEDLARPLQTPGDSHTAAAMATNKERLFAAGALGPGSGYPGAGFPFAFPGALRGGLPPFEMLSPSFRGLGQPDLPKEHGLSDRWRHRATRLTRAWCPSSSSTPYDILGVYKGHDYRVAHATGPRGLP

SEQ ID NO: 1018172 - protein, 116 aa, Homo sapiens
GSGQLSIVSFSSAGAAMAAVKTLNPKAEVARAQAALAVNISAGGGLQDVLRTNLGPKGTMKMLVSGAGDIKLTKDGNVLLHEMQIQHPTASLIAKVATAQDIFNFLIIELYVFYIF

SEQ ID NO: 1018173 - protein, 83 aa, Homo sapiens
WLRRYGWLTTFEEGYVLSLALDSSVSIWSERQNTRPWGQSPGLDLAGRNQLCGLRRFLYHVGSGLMVYKMVRVAVGEYLVQPC

SEQ ID NO: 1018174 - protein, 762 aa, Homo sapiens
MLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVDLRICEDGGEETVYTLPNQ

SEQ ID NO: 1018175 - protein, 818 aa, Homo sapiens
MLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSHPQLTPSQSQPPVMPSQSHPQLTPSQSQPPVTPSQRQPQLMPSQSQPPVTPS

SEQ ID NO: 1018176 - protein, 820 aa, Homo sapiens
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIYFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPHVTPYQSHPQVMPSQSQPPVTPSQSQPRVMPSQSQPPVMPSQSHPQLTPSQSQPPVTPSQRQPQLMPSQSQPPVTPS

SEQ ID NO: 1018177 - protein, 312 aa, Homo sapiens
LTTEFGQSININRLLGENDGETMSFEFYSVVLLLLCVKGLPECFANVQFEYEDPIVRGGKQLLHSPFFKVLVALACDLELDTLPCCAETHKWALVLEVTCMASRVAVALDKMNTVAPVCFLTECWLTKIPELIGMTADNMDVLHESHDIFTNESKTNNLLQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIE

SEQ ID NO: 1018178 - protein, 280 aa, Homo sapiens
LTTEFGQSININRLLGENDGETMSFEFYSVVLLLLCVKGLPECFANVQFEYEDPIVRGGKQLLHSPFFKVLVALACDLELDTLPCCAETHKWALVLEVTCMASRVAVALDKMNTVAPVCFLMRWLRKFCDLIGMTADNMDVLHESHDIFKREQDEQLVARWMNRRPDDWTLSAGGSGTIYGWGHNHRGQLGGIEGAKVKVPTPCEALATLRPVQLIGGEQTLFAVTADGKVRALFLCHKVIEPEAVVAKGAVWFLARARICTKTFLRINDTVVCRKQLEF

SEQ ID NO: 1018179 - protein, 358 aa, Homo sapiens
MPSVSPAGPSAGAVPNATAVTTVRTNASGLEVPLFHLFARLDEELHGTFPGLCVALMAVHGAIFLAGLVLNGLALYVFCCRTRAKTPSVIYTINLVVTDLLVGLSLPTRFAVYYGARGCLRCAFPHVLGYFLNMHCSILFLTCICVDRYLAIVRPEAPAACRQPACARAVCAFVWLAAGAVTLSVLGVTGSRPCCRVFALTVLEFLLPLLVISVFTGRIMCALSRPGLLHQGRQRRVRAMQLLLTVLIIFLVCFTPFHARQVAVALWPDMPHHTSLVVYHVAVTLSSLNSCMDPIVYCFVTSGFQATVRGLFGQHGEREPSSGDVVSMHRSSKGSGRHHILSAGPHALTQALANGPEA

SEQ ID NO: 1018180 - protein, 140 aa, Homo sapiens
MQPWPQPRGPHRPPCGAGAHQCQLLLCPRHRGNWCLAGQGEWRFLGVCWGSSGGPALFQDSCCLRPLSETCPRQVDNRLVENFGVQEDLMDLHPVYVESQLMDADLEVSLVPPLEDQSLVAIPMEASSEEPPPPPPLPPE

SEQ ID NO: 1018181 - protein, 117 aa, Homo sapiens
LVLQEGLYPLGGLSPGEEWRFLGVCWGSSGGPALFQDSCCLRPLSETCPRQVDNRLVENFGVQEDLMDLHPVYVESQLMDADLEVSLVPPLEDQSLVAIPMEASSEEPPPPPPLPPE

SEQ ID NO: 1018182 - protein, 114 aa, Homo sapiens
CECSLGLSREALIALLVVLAGISASCFCALVIVAIGVLRAKGETCPRQVDNRLVENFGVQEDLMDLHPVYVESQLMDADLEVSLVPPLEDQSLVAIPMEASSEEPPPPPPLPPE

SEQ ID NO: 1018183 - protein, 194 aa, Homo sapiens
NAELKYTIVSGNNKGYFRMIQYQVTLLWKKNQHLLMWDASLVVNISDLGYPKSCTAVLVFLYVNDTAGNASYIYDLIRRTMETPLDRNIGDSSQPYQNEDYLTIMIAIIAGAMVVMCCDLRHRSGALSPCIKVQSSSEEQARCRMDVPKPGEQAKQEKTTKNEKEVSQKLSLNLLLSKSPNPDDAVHEPIKCDK

SEQ ID NO: 1018184 - protein, 69 aa, Homo sapiens
DPSWGQTWLLGVHAHCPLGQCHQDLSVAMRAQRGEAICLRSPSSGDEILMQDSQATLHLARSLGQLPLG

SEQ ID NO: 1018185 - protein, 69 aa, Homo sapiens; identical to SEQ ID NO: 1018184

SEQ ID NO: 1018186 - protein, 113 aa, Homo sapiens
MLKTASGPSALINNPGHGLTDSFHPEIEIMEEPFKFRPAQAPRNPNVTDLTAANVTNTAVIKSRELNPPPKELAPGKNGIELNSWNPQKFRGEHISKNALSLSKRQFKVSKDF

SEQ ID NO: 1018187 - protein, 119 aa, Homo sapiens
PRLARQPVGTSNDQVPIAEGPAPPAGASLPVTGSCEALVIGQGSIFLSGDSVACLGAKASRWPLETPSSTAPPPRQQIQTFELKGFLFKGRGSLCSPVGVAQGWGPILNNGLVPVGKHT

SEQ ID NO: 1018188 - protein, 347 aa, Homo sapiens
NLASRGRCNRRGQSTVNVYVKSLRDFSTESMSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVGSFLRIYSLHTKLQSMNSENQTMLSLEFHLHGGTSYGRGIRVLPESNSDVDQLKKDLESANLTANQHSDVICQSEPDDSFSK

SEQ ID NO: 1018189 - protein, 266 aa, Homo sapiens
NLASRGRCNRRGQSTVNVYVKSLRDFSTESMSLVPATNYIYTPLNQLKGGTIVNVYGVVKFFKPPYLSKGTDYCSVVTIVDQTNVKLTCLLFSGNYEALPIIYKNGDIVRFHRLKIQVYKKETQGITSSGFASLTFEGTLGAPIIPRTSSKYFNFTTEDHKMVEALRVWASTHMSPSWTLLKLCDVQPMQYFDLTCQLLGKAEVDGASFLLKVWDGTRTPFPSWRVLIQDLVLEGDLSHIHRLQNLTIDILVYDNHVHVARSLKVM

SEQ ID NO: 1018190 - protein, 172 aa, Homo sapiens
MEVQKNNPKEKLTFLLCIWPILEQLMDFPGVKQSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPANRHSTSSIYYISESK

SEQ ID NO: 1018191 - protein, 408 aa, Homo sapiens
MEVQKNNPKEKLTFLLCIWPILEQLMDFPGVKQSKYMPRASVCNVLLTCCKDNVCRLWVETFLPNDCLLYGGDCSHWTESINLTNNFKRNASSKERVQNALEVNLRHFRRGRRRSLALVAHTGYLPHQQDPHHVHRNTPLHANALCHFHIAASINPATDIPLLPSITSLSLNENEEKTGPFVVHWLNNKELHFTLSMEVFLQQLRKSFEQPSSEASVEDSNQADVKSDEETDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAE

SEQ ID NO: 1018192 - protein, 118 aa, Homo sapiens
NTPPPLTGMLMRTNGEQEADSEIQYEEEEEGGEEEEEEEEGDGEEEDGDEDEEAESATGKRAAEDDEDDDVDTKKQGRLHPLPPTSFFSFKSLVVISELVSSCRIRQKRAPTLEVTPH

SEQ ID NO: 1018193 - protein, 176 aa, Homo sapiens
NTPPPLTGMLMRTNGEQEADSEIQYEEEEEGGEEEEEEEEGDGEEEDGDEDEEAESATGKRAAEDDEDDDVDTKKQKTDEDDYDFQKKKKKKKKKSGRSNSRPLDVDAQNFGVGLREDDRRGDVQIGDIVTVGEPASEQDMRFNVLVTKAAGTKKQFPEVLRLDIGPLPTMCFFLL

SEQ ID NO: 1018194 - protein, 69 aa, Homo sapiens
LDQKSCWDEELQTCVVDFLAFCLFYSQGWGITTKEVVFWPGVVAHACNPSTLGGRGGWITRSGDQDHPG

SEQ ID NO: 1018195 - protein, 42 aa, Homo sapiens
MTTERIRRGKTNKVLHIQGEGTHSRALNIGRHFPHGTSSSAP

SEQ ID NO: 1018196 - protein, 99 aa, Homo sapiens
PPVIFASLVQNVTKMEDVRCVCNIDCSQTNFNPLCASDGKSYDNACQIKEASCQKQEKIEVMSLGRCQDNTTTTTKSEDGHYARTDYAEKRKQEESVCY

SEQ ID NO: 1018197 - protein, 145 aa, Homo sapiens
PPVIFASLVQNVTKMEDVRCVCNIDCSQTNFNPLCASDGKSYDNACQIKEASCQKQEKIEVMSLGRCQDNVHTKIHFKEDFSLCAKMKSEENSLLGSYSISKMQCLFTMDSRVYCSICVDYRILRGSQQPSRSVSIQWDCIVTMP

SEQ ID NO: 1018198 - protein, 214 aa, Homo sapiens
PPVIFASLVQNVTKMEDVRCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 1018199 - protein, 160 aa, Homo sapiens
MVLVKLDLRKKAASIADSIILCWKLPGPVSAKKRLGTHPGNQPPNPPPPRRETLPLKFTSPDTNLPKLNRLQPLCPDPTLTAFPFTPIWAFWPKVLRLWGKRRAVMALRWVSYSPEDNRSLLCFTIYQELYPGCNTQALAFFPLLDYNPLSNSKVVVFFN

SEQ ID NO: 1018200 - protein, 379 aa, Homo sapiens
IYFFWGTLYLETIYFCHDHFGWYLGWGHCWLPLTLGLYLCPCCPPRPPWRPAAGPGGHIFRKTTKKDLFRRTGGCLWGRKPKVIECSYTSADGRHHSKLVSGFWGVARHFNYVGLMGNLAYYLACGGGHLLPFYIIYMAILLTHRLREHAANGRNWERYTAAVLLPPAAWNLLRARPREKPCGAVKSVFCQVHGGWHPSSNSRSLSFLICKLERAQQLAGVQYLITLCSLFVPSREFRVSSTAVLPVQTEFSLITCPWGRRMTQSPLLVLWRQFTCIGAQATLDSAHTGEQEVFPRPVIRLHLLSAKIIKWEWGVRVSMYCLSGLDPPPLAALQSWVGPVRVSPWVACTVLSWDTGEKGASMSFPSCSCAQLQECSAGV

SEQ ID NO: 1018201 - protein, 507 aa, Homo sapiens
SGLGARRRSALCFAVLNLSSGRVFARSDLPDPAKHLLFWSLKYVIMAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGVLALSWYPPDVNDENGEPTDNLVPTILDKAHKYNLKVTFHIEPYSNRDDQNMYKNVKYIIDKYGNHPAFYRYKTKTGNALPMFYVYDSYITKPEKWANLLTTSGSRSIRNSPYDGLFIALLVEEKHKYDILQSGFDGIYTYFATNGFTYGSSHQNWASLKLICDKYNLIFIPSVGPGYIDTSIRPWNTQNTRNRINGKYYEIGLSAALQTRPSLISITSFNEWHEGTQIEKAVPKRTSNTVYLDYRPHKPGLYLELTRKWSEKYSKERATYALDRQLPVS

SEQ ID NO: 1018202 - protein, 254 aa, Homo sapiens
SGLGARRRSALCFAVLNLSSGRVFARSDLPDPAKHLLFWSLKYVIMAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGNYCIYIYMCVFVSVYMHINDFLCNFTS

SEQ ID NO: 1018203 - protein, 138 aa, Homo sapiens
MASPGCLLCVLGLLLCGAASLELSRAHERHPQEAHTSGILMQNCRSKVMTNYGRYYIAASYVKYCGVCRCESCTRKAGSSEKDYEILYTSINGILYPGGSVDLRRSDYAKVAILYNLSIQRSDDGDYSPVWGTCLGYE

SEQ ID NO: 1018204 - protein, 120 aa, Homo sapiens
MVLSEHKCLKLLPRHRVTGPGRPRYYSAFLLPQRDSRGGQFNNLALWHSGSRSHGFFGAYTLYGLLVPLVPTLLYDSGGHPHPGPVAFGLPPPGVKGGAGAHMAHFLLAPNPWQQGKGFA

SEQ ID NO: 1018205 - protein, 150 aa, Homo sapiens
MWSSWGGGHRPRGVRGVPRKVVELGVLPGLLPPWVRMPEKQWVITMAASILDTYQAPGTILEPSPSPQLSGAAQRGAVAYQGCRVPQGRGAQRSGKDVAGGQGCACRKTPLTTGAAFTATFRQAGTNSQRAIIPRAASWHPRGHMPRAEE

SEQ ID NO: 1018206 - protein, 342 aa, Homo sapiens
ITAINLNARKMLGLSSPGRQCWVNPLLKWSARRFFTEQIDEKRQDVVANFNGLSVIATRDAIRSGDDLLGAIISFRSKDEISTLNAQLTQIKQYVESLRTLRHEHLNWMSTLNGLLQMKEYDRVLAMVQGESQAQQQLIDSLREAFADRQVAGLLFGKVQRARELGLKMIIVPGSQLSQLPPGLDSTEFAAIVGNLLDNAFEASLRSDEGNKIVELFLSDEGDDVVIEVADQGCGVPESLRDIFEQGVSTRADEPGEHGAWVVLDCQLRNALRWCITLEDMILGTLISIYFQSETYDSSINPFDCEDQTPLAEMHAERKARMIYERFKAVVNLVDNHFLAVK

SEQ ID NO: 1018207 - protein, 263 aa, Homo sapiens
ITAINLNARKMLGLSSPGRQCWVNPLLKWSARRFFTEQIDEKRQDVVANFNGLSVIATRDAIRSGDDLLGAIISFRSKDEISTLNAQLTQIKQYVESLRTLRHEHLNWMSTLNGLLQMKEYDRVLAMVQGESQAQQQLIDSLREAFADRQVAGLLFGKVQRARELGLKMIIVPGSQLSQLPPGLDSTEFAAIVGNLLDNAFEASLRSDEGNKIVELFLSDEGDDVVIEVADQGCGVPESLRDIGLYLIASYVTRCGGVLLSKI

SEQ ID NO: 1018208 - protein, 136 aa, Homo sapiens
DFLYCNFLLDGFTKEILREKSAGRMNPAMPAQSGLKAKERRVQEGPGRSLGGSASSKGCAVCSGLSWREQFACLGFLIEMKFKYPKNQSLESDQSAAFSTSRKLCRPHLCHRSGTFCHPPVKQSFPLPYSSSTGNC

SEQ ID NO: 1018209 - protein, 136 aa, Homo sapiens; identical to SEQ ID NO: 1018208

SEQ ID NO: 1018210 - protein, 274 aa, Homo sapiens
ESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 1018211 - protein, 290 aa, Homo sapiens
ESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESALLLGRYEPSAPKEALFPSNWPMPNRGPPPPWAQNDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 1018212 - protein, 93 aa, Homo sapiens
ESKAKLSSDVLTLLIKQYCRESGVRNLQKQVEKVLRKSAYKIVSGEAESVEVTPENLQDFVGKPVFTVDVEHYREIFDIAFPDEQAEALAVER

SEQ ID NO: 1018213 - protein, 221 aa, Homo sapiens
EAEAVAAIFSSLLECYRHHVPRMVSAGRGLGAVWSPTHVQVTVLQARGLRAKGPGGTSDAYAVIQVGKEKQMARYACGAPVLAAKEAHLRAAIAGVLRTPWPPATLRVTVLHRAAVSAFEQVPWNRAEGGPWRESWHRRTPGPAKGKNGRATQVGKSHTRDKQGAHSEADAPTLGGLDNSSLTDDNKLDCPGIVGTFQCTANSSRHIPLETADGSKNQGGS

SEQ ID NO: 1018214 - protein, 103 aa, Homo sapiens
EAEAVAAIFSSLLECYRHHVPRMVSAGRGLGAVWSPTHVQVTVLQARGLRAKGPGGTSDAYAVIQVGKEKYATSVSERSLGAPVWREEATYELPSLLVRTRGR

SEQ ID NO: 1018215 - protein, 62 aa, Homo sapiens
FAGSTSRSSTKLRSDLIATDNRSQSAQSLDRVGKKLREPLHILQATLGDTQADVDAAGNLVG

SEQ ID NO: 1018216 - protein, 96 aa, Homo sapiens
AAASTLRPVPQDPQAWLATQGNVDKLVKLSGAKASDIPLLLQGNVYPLAADQVTVLGKPTAQAITDTAAFLKEQGKVDAVLPDYVDAAANLGVVVE

SEQ ID NO: 1018217 - protein, 151 aa, Homo sapiens
TRLTAASILNADYTKSSFWETMVTDCLNQYEEKYLLLRVEQMSSLLILFFARSDRAYNIKEVGGSTKKTGFGGITGNKGALAITFDYGATSFCFVNTHLSAGASNIDERRNDYNNIYRNITFPRSKTIPHHDSLFWLGDLNYRITLTNDEV

SEQ ID NO: 1018218 - protein, 124 aa, Homo sapiens
FLWAMTPPPPPPPLPGPWALADPFREPLAPGLGSLVVLFGATAGALGRDLGSDETDLIAPRFGKWLSRGAARWGRCTNRVVRAEAASPEYSSASEAMRTERRERMEAGKRQVDKDAARQYHHSW

SEQ ID NO: 1018219 - protein, 173 aa, Homo sapiens
IRGRVDLEDRRLGAIIPILGAAFGLGDPDRLAVIANRMVDVRRQQLISRHLLFAPGNRAVHDETLVQAHQVADKRLLQQVVTDGDTWRGQAGVVHGVVDEGRVHHDVAVVGQEQVGAAVLELLDAGISHPVGRALDGVVDVKLDFCPVAGHGGDPGELTAQFMGDHWLEPPTR

SEQ ID NO: 1018220 - protein, 121 aa, Homo sapiens
PAPSEACASGSWARRHQAGTALLRGTRVCADADSPVVCSSHVAEMEPLHGGSFPSPWMAQQPLLSVTTCDLLPYSSAAHPRLQGHLTLSQGIPDPGSRPRLVHSGSIVHAQTISGLAGLLD

SEQ ID NO: 1018221 - protein, 156 aa, Homo sapiens
MYKDDDDVVVSFAKWSFWATAGERRRESGNATDCKPPVTGKPPCPAHFLCFPEFHHLTAILEGILMRTRNSDADRLTVFLEGILMRTKNFDAVATYGITENTQRMGHSRSHWNQKEDPIPKLRNFQSPLNGNCALEPSVLPLWDLKAERREMKENA

SEQ ID NO: 1018222 - protein, 49 aa, Homo sapiens
RSRYFLDFLTRPVLREAFGCCGPASTRAPWSCSARLPLQEKLTAHCPAA

SEQ ID NO: 1018223 - protein, 101 aa, Homo sapiens
FFEMECRSVTQAAVQWCYLGSLQPPPLGFKQFSCFSLTSTWDYKPEPPRVANFFVFLVETGFHHVGQAGLELLASGDPPAWASQSARITGMSHCARLYIFC

SEQ ID NO: 1018224 - protein, 118 aa, Homo sapiens
SRPRRRTPKRKAKKRRHRIRPRTPDCTGLCSYRFRAYQNPRSTPNCRSRACREKALKTAKSFASKLCSHRFRSVFEVISGLADRPPHIPHRHHRHLDFRVMVAAPQNHPGRRGREFSS

SEQ ID NO: 1018225 - protein, 319 aa, Homo sapiens
QAGELPREVRTAQARSSTLLQQGPPGPQDTVERPFYDLWASDNPLGRLAQDFFLEQTKKKGVKRPARLHTKPSQAPAVEVAPAGASYNPSFEDHQTLLSAAHEVELQRQKEAEKLERQLALPATEQAATQESTFQELCEGLLEESDGEGEPGQGRGAGGLGMPRSVPRPPAWPPQRRRRSSSGGGRRLCTGCGYSRPRCGPPGSGTRRLFRLRGIKAQVALRLAELARRQRRRQARREAEADKPRRLGRLKYQAPDIDVQLSSELTDSLRTLKPEGNILRDRFKSFQRRNMIEPRERAKFKRKYKVKLVEKRAFREIQL

SEQ ID NO: 1018226 - protein, 319 aa, Homo sapiens
QAGELPREVRTAQARSSTLLQQGPPGPQDTVERPFYDLWASDNPLGRLAQDFFLEQTKKKGVKRPARLHTKPSQAPAVEVAPAGASYNPSFEDHQTLLSAAHEVELQRQKEAEKLERQLALPATEQAATQESTFQELCEGLLEESDGEGEPGQGRGGPPLAPPRPPPPPPPPPAPPPPAPPPPPPPPPPPPPPLPLPPPSPPGSPPPRPASSPPPPLPPPRPPPPPPPPPPPPPPPPPRLLPQPRRLGRLKYQAPDIDVQLSSELTDSLRTLKPEGNILRDRFKSFQRRNMIEPRERAKFKRKYKVKLVEKRAFREIQL

SEQ ID NO: 1018227 - protein, 112 aa, Homo sapiens
MESCTVTQAGVQWPISAHCTLCLRGSDNSPASASRDAGTTGMRHHARLIFVFLVEMGFAMLARLVSEILTSGDPPASASQSAGITGMSQPLYLAPFACPFQHHMPVRSDLAS

SEQ ID NO: 1018228 - protein, 82 aa, Homo sapiens
ASDETKAAEEPSKVEEKKAEEAGASAAACEAPSAAGPCAPPEQEAAPAEEPAAAAASSACAAPSQEAQPECSPEAPPAEAAE

SEQ ID NO: 1018229 - protein, 82 aa, Homo sapiens; identical to SEQ ID NO: 1018228

SEQ ID NO: 1018230 - protein, 278 aa, Homo sapiens
DHCGSTMPSDPVLDYQLGEMWSHLNRLLFWSIFSSVTCRKAVLDCEAMKTNEFPSPCLDSKTKVVMKGQNVSMFCSHKNKSLQITYSLFRRKTHLGTQDGKGEPAIFNLSITEAHESGPYKCKAQVTSCSKYSRDFSFTIVDPVTSPVLNIMVIQTETDRHITLHCLSVNGSLPINYTFFENHVAISPAISKYDREPAEFNLTKKNPGEEEEYRCEAKNRLPNYATYSHPVTMPSTGGDSCPFCLKLLLPGLLLLLVVIILILAFWVLPKYKTEKFEK

SEQ ID NO: 1018231 - protein, 117 aa, Homo sapiens
GTRDIQTRILHQDLRHRHLVSEASREMLFVLGESPLPSLPPSPARTETVPAARHTSCQLLVKRTCLKTTLLPLVNHFRLWGPPGHEQHHPEAFKVFWIHHRTLQPQPARIPPGMKVL

SEQ ID NO: 1018232 - protein, 233 aa, Homo sapiens
GEAPGLPPGARRALGSRPPAGPAAFREEAVPAASRARSRAPSPAGARPLTRQGVRRVGCGTGGTWRQRGEPAVRAAAQPLGAPQTPRGAPAPWRPGSGSRSMDFPKTSPGVHDACHVWVARLETRDCGEAGSFPPGTFSLMIVWISRRSEACACLSRREWGTRCVCPSPRFAKSTARIVDFGASVGEVFKAGGRCSWKLGEEACSPAIFSSRGFKARHLRGGWGEESLIDLFY

SEQ ID NO: 1018233 - protein, 141 aa, Homo sapiens
GRGAGAAARCSARSREPPARWSRSLPGGSGAGSVQGALSGTLTCRRPAAYPAGRAQGRVRDRGDLEAEGRTGLSAPQHSRWERLRPRAGRRLHGDRARGAGLWTFRRRARESMMHVTSGSRGWRPGTAEKPDRFPLELSLS

SEQ ID NO: 1018234 - protein, 108 aa, Homo sapiens
DSRSHIAHTLTTHTPVFLSLQRTFREITLLQVSGLGPPVQSPCPGTDLSRQERNWPSWAPEHSPSWPSSRLRLSPQEFGDHPNIISLLDVIRAENDRDIYLVFEFMGE

SEQ ID NO: 1018235 - protein, 191 aa, Homo sapiens
DSTVRPAGVLAAMCTVVDPRIVRRYLLRRQLGQGAYGIVWKAVDRRTGEVVAIKKIFDAFRDKTDAQRTFREITAPQEFGDHPNIISLLDVIRAENDRDIYLVFEFMGAPPAPTPTACAPSLRPDLNAVIRNGGLLQDVHVRSIFYQLLRATRFLHSGHVVHRDQKPSNVLLDATAMKLCDFGLAVPGRPP

SEQ ID NO: 1018236 - protein, 131 aa, Homo sapiens
IRGRVDLGSNTDVYLARVNWFPDSSTLAVQRESRDQKTLVLLRADATSGSARELLSEHSDKWIDLNDNLAFVTRAHQLIWASSRSGFQHLYLYDWDGNLIRPLTQGDWMVTGDNDSHGIRGVDAGANLVIV

SEQ ID NO: 1018237 - protein, 81 aa, Homo sapiens
SYACQSSALSITDPPLLTWLPGAIKWPQGKCSQTLNEETGAQGKGGGFRLENACFKVPLGVMVVMVGMDRGYPWSQNQEMT

SEQ ID NO: 1018238 - protein, 114 aa, Homo sapiens
MKIGPLVWTFVRMTLCSKGHLGTQAGGGFQGTMGTDPQRQKGVGRGGPHRGGYGSVPTRHLPELGHMATPGQLATQGASRPGGGASGFGEALAGPTGPPDPPVSVGASIRGDVA

SEQ ID NO: 1018239 - protein, 126 aa, Homo sapiens
FAASTPSGPTAAQRVASELLEGITPALLDERFARATLYYSQREFEEQLLLRCLEPGQDFQALAHWGLEHFQWLSPWQRADLPKQALLELDQRLFKSLEEPLAGLLGRGDVEGFWREYSNLEQLGWL

SEQ ID NO: 1018240 - protein, 147 aa, Homo sapiens
DAFPNIEKVSNITSPVLIIHAREDEVIDFSHGLYERCPKAVEPLWVEGAGHNDIELYSQYLVRLRRFISQELPSPSAPSGGPNRPDLSNKAAPGPPPRPAPTQGLHVDPRAAQVEALPGAPAMKGLWTMYRQQTYALLSFWKQEENK

SEQ ID NO: 1018241 - protein, 69 aa, Homo sapiens
RVFTNVCSYTPGCVSKGSPASSPAWHPEWAPAGPAAIWVSFLSLPGAGIGLLLSSPEPLSQRTLDPKRT

SEQ ID NO: 1018242 - protein, 156 aa, Homo sapiens
MATPPAPGAGTAAPSAPRPPPPRPSWLRLDPAARGARLPFPGSPGTTRRAPRESAPLAPALRSDPGQPLAACNGPPGEPRADPGVSTRCAATMIPQGKLTGGRSCGSRPRMGRGERAELSFPAAAPRLKRGLGFWFFFCGNSSVEILLACHTTHPF

SEQ ID NO: 1018243 - protein, 120 aa, Homo sapiens
LDGAQDLGLAAGTVAVRDAAALFGRLDITDFGVEAHRLEVFVKGIGDAVHAAHRLEHGGGKLRDLSNTKAPHSLGLSRVCSSSGARVTPVMVASARHARVAGAYRTLVLQVAVEVAVHFE

SEQ ID NO: 1018244 - protein, 127 aa, Homo sapiens
MDVFKKGFSIAKEGVVGAVEKTKQGVTEAAEKTKEGVMYVGAKTKEGVVQSVTSVAEKTKEQANAVSEAVVSSVNTVATKTVEEVENIAVTSGVVHKEALKQPVPSQEDEAAKAEEQVAEETKSGGD

SEQ ID NO: 1018245 - protein, 54 aa, Homo sapiens
MTRLPEPTQWLDALMTQDVSLLALGVVAASILAYALSMLCWLAALRDLPLGRGR

SEQ ID NO: 1018246 - protein, 77 aa, Homo sapiens
MQLGNWKSEVGISGLTSTLENRDTREDGRRNAVAIHYLGKDGPWGLQLQRARQQMSPRNPGSNEVVTFGGYDGTFSR

SEQ ID NO: 1018247 - protein, 286 aa, Homo sapiens
RHEPAAPDAGCALPGAERPRARARATGPAGAVLIPSPVKSYRGWLVMGEPSREEYKIQSFDAETQQLLKRALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFGRPAGRQRQLPTSITTAKSPTRPPDQGFLTSTGLSSTHL

SEQ ID NO: 1018248 - protein, 305 aa, Homo sapiens
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLGPARQFEQGGGGGLFVCCSCTGLGSSWRNDGQRMDELFVLIRDGFLLPTGLSSLASCCCWRSLSSGGRLEDNASCPQVLLQRSLRLGLQIRASSPDWPFFYPPLKLAVESLPHPKTFPFQTLSVFPSRLSHLLVRCFPLMPWSCPEPLSPPQPTTARQRRATPKSHCTV

SEQ ID NO: 1018249 - protein, 93 aa, Homo sapiens
GLQPLLKFESRNQQVRNPEIPDPLRKMFSPEGERRAAGAEGGLGALRRRLQDPPAGPGRADAGCSRGAAPRSEVRAAGARPRRRSAVLLLLVF

SEQ ID NO: 1018250 - protein, 247 aa, Homo sapiens
ENCFLHRSGRGINEMVSNAQCLNVPVNGPMLRLKANDFAQKLGHNDFKCSNGWLDRFKSRYGLVFRAQPVEATGVPVDPSTVWYQNVLPYYLNDYHPKNVFNIKETGLLYRMLPTNTFAFKGETCSVGKLCKDRITLVVGTNMDGSEKLPLLVIGKKRTPHCFKGLKSLPVCYEANRMAWMTSDVFEQWMRKLDEEFQAQQRRVVIFVESFPAHPEVKNLKSIELAFFPSCLSSKCIAMKQGVIKSL

SEQ ID NO: 1018251 - protein, 209 aa, Homo sapiens
ENTKKRTFVAADREILSSANAGPELSVYRCGSDKVPPMIYGTNFIELPYHGESNRAMLDCTARRAELHSGLSAIYPTHQHQKTIDMLDELSMVPEGVVLGVDPCRQDAQLLGTEQDFARSPLKVLGHYWTCRISSKANFAKITRSENLHVSHILQKAKIEVSEDGTKASAATTAILIARSSPPWFISRQDLFCLASDIILQVLCYSWGR

SEQ ID NO: 1018252 - protein, 469 aa, Homo sapiens [sequence omitted]

SEQ ID NO: 1018253 - protein, 95 aa, Homo sapiens
DLIEKLDISRPKMQEVVANLQYDDGGMNREATADDLIKVVEELTRIHEPRAGAPFDPPQKLSPAPPLTILFLAMGLSLSQLPPEPQPYVEVGRAS

SEQ ID NO: 1018254 - protein, 328 aa, Homo sapiens
GTSGTRKDSYVGDEAQSKRGILTLKYPIEHGIVTNWDDMEKIWHQTPSTNDDCVWTPEEHPVLSDRVPPLNPRAKPPDMMTQSHVLTTFNQPPGTLVPVAYSQGCASPCAASGLYRLAIGDGNSGDGGSPTSCAHSTRGMPSPMPSCVWTWVGRDLTDLPHAMILDRALATVVQPIHGRAGISAALTLSAERLCCSRPGLRAKSMAARCFQASSLERSLTSCLTAPVISIRHLERVLGGPVRHSCQTSPPLGLVVLVASRSKLLFRLLSLHVCVVILEDRYANAVVSGGAHQFLGCGRVPLVFSVRARTEISASPRGATRGDGALAGP

SEQ ID NO: 1018255 - protein, 114 aa, Homo sapiens
MEIPTRVKVKGPPQASHSLLSFLPDQVCQPMASYAPHPHCFCLHVNETKGLSISWEDWGLLPNGPLCPIIGARHPIHTFAPLLQDSIFLFTQSLYSRIQSWVVVYLPGKLIIFV

SEQ ID NO: 1018256 - protein, 114 aa, Homo sapiens; identical to SEQ ID NO: 1018255

SEQ ID NO: 1018257 - protein, 297 aa, Homo sapiens
LEKVENSVIMCPGDPEQLAREDLEENEEILGKEENLGELDSLVRREWLEDMVLMAQKAVQVHLGPLEIQAHQCLQGMPGERGIAGTPGPKGDRGGIGEKGAEGQLEHDGARGLPGPLGPPGPAGPTGEKGEPGPRGLVGPPGSRGNPGSRGENGPTGAVGFAGPQGPRRTAWSKQVNLAEPGQKGDAGSPGPQGSSRIPGPHGPNACPGLKGGRGTQGSAWWLQGFPGFCGPTLDLEGPAGSSGTLRDRLMGTPDRRDLQVFVGAPGSHGVLEMRTSVSLVCRRLEGRDNMAPVSSP

SEQ ID NO: 1018258 - protein, 172 aa, Homo sapiens
CFISDVQIYLGDCREPIHHWKLTNEGEAPLPCLSCGHHYPDGQTDKMSLSSSEFMTKPPRTGKSPFCSMNLSIQISSTNDCGRRSYHQTVRGSLCEPPALPGDWTRIPAVPWLQVSTSRRRRGLHRKMQLNPGLGYLHVSEGHFPGASAMAPGPSQDFVITEKTTLGAATGP

SEQ ID NO: 1018259 - protein, 172 aa, Homo sapiens; identical to SEQ ID NO: 1018258

SEQ ID NO: 1018260 - protein, 96 aa, Homo sapiens
GKKYSFHLRSFMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 1018261 - protein, 107 aa, Homo sapiens
GKKYSFHLRSFMYVPGKLHDVEHVLIDVGTGYYVEKTAEDAKDFFKRKIDFLTKQMEKIQPALQEKHAMKQAVMEMMSQKIQQLTALGAPAGLCAGPLLWDDGCTRR

SEQ ID NO: 1018262 - protein, 76 aa, Homo sapiens
ICSHYSGGWTSKIKALADLVPPKTSREKVTTCKLRKEVCVLTWPFLYTCTPGIPSASYKDASAIELSSCSYDFIYL

SEQ ID NO: 1018263 - protein, 151 aa, Homo sapiens
PPGGGVYFGIVVGRLALCDAPLVVMSEAPFVMFSPPPMFPSRRGGCFSARQVRLRCSSLRRGVFFFTVGGWCFSHRALFSCAPGVVLVGSPCTEVQQHVGPRAAHTNGVFLKNFFRGADGAPRAQSCCFFVCFFFCCCAPLFIFFFFVFFF

SEQ ID NO: 1018264 - protein, 234 aa, Homo sapiens
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 1018265 - protein, 238 aa, Homo sapiens
PSKVNVHVLGVLLGQKEGTRSIKEEMSSSTLEEGVYGRALKLMSTSNTWCDLGINYYRQAQDLAETGSNMNDLKELLEKSLHGLKKAVRLDRNNHLYWTCVLRVVACYSGDGNLCALLSDCFIKSIQFENKLMLLHGPTWECYTSPNENIEPKLMRLSKWLNPLIHLISTVLDWHKLLFAEAVGKVMTPWSLFQATRTWNLHMHYWVGVKVMRSRVLPTFARLTSSENQKVVPFKSSQ

SEQ ID NO: 1018266 - protein, 125 aa, Homo sapiens
SGHPGVAGNAPLGLTSDHLPLLPSFHTEAPALLCLRGPQLASALLPLPFEVGTIHSTCRQVKRNGKFKARLRQNQDAECPMKRLTTLETPETSSSISKTQRLDDININDPTLKHNLPSVITQHPH

SEQ ID NO: 1018267 - protein, 87 aa, Homo sapiens
TKDIVNGLRSVQTFADKSKQEALKNDLVEDFEEKAAMLNLCFMLTRHAVHSLDSFLKKTRFHPTLVPSLPYRSHNSCIIDRTAHISP

SEQ ID NO: 1018268 - protein, 220 aa, Homo sapiens
DASEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVRYSVKTRLAAYFTPLWPSVFT

SEQ ID NO: 1018269 - protein, 294 aa, Homo sapiens
DASEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 1018270 - protein, 264 aa, Homo sapiens
DASEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQVVCVRR

SEQ ID NO: 1018271 - protein, 276 aa, Homo sapiens
DASEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITTGDADIDHDQALAQAIKEAKEQHPDMSVTKVVVHKETEITPEDGED

SEQ ID NO: 1018272 - protein, 294 aa, Homo sapiens; identical to SEQ ID NO: 1018269

SEQ ID NO: 1018273 - protein, 294 aa, Homo sapiens; identical to SEQ ID NO: 1018269

SEQ ID NO: 1018274 - protein, 260 aa, Homo sapiens
DASEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQEE

SEQ ID NO: 1018275 - protein, 260 aa, Homo sapiens; identical to SEQ ID NO: 1018274

SEQ ID NO: 1018276 - protein, 235 aa, Homo sapiens
DASEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITAGSGN

SEQ ID NO: 1018277 - protein, 276 aa, Homo sapiens; identical to SEQ ID NO: 1018271

SEQ ID NO: 1018278 - protein, 135 aa, Homo sapiens
SFSSPQLGTRPRSYAPAQSGSTLSKFKVGEGWPRRVSTNPPPAPAPVPSTPPGAGRGSASGGPERRLTLDGVDERPVLMADLAATAFASASKLAGSIISSPESDGSVSSRLERSEEPFVSAEPRRDLGDKGDASG

SEQ ID NO: 1018279 - protein, 348 aa, Homo sapiens
MNDSLRTDVFVRFQPESIACACIYLAARTLEIPLPNRPHWFLLFGATEEEIQEICLKILQLYARKKVDLTHLEGEVEKRKHAIEEQGPSPGPVAWGHTGAGWYLGVLPCQWSQCIDFVIALLGAIWDHCKLRLPDSGDSCASASQVAGIAGAHHHAQSLAVLPVESPKEGKGSKPSPLSVKNTKRRLEGAKKAKADSPVNGLPKGRESRSRSRSREQSYSRSPSRSASPKRRKSDSGSTSGGSKSQSRSRSRSDSPPRQAPRSAPYKGSEIRGSRKSKDCKYPQKPHKSRSRSSSRSRSRSRERADNPGKYKKKSHYYRDQRRERSRSYERTGRRYERDHPGHSRHRR

SEQ ID NO: 1018280 - protein, 286 aa, Homo sapiens
PHPHHQPWAQLHPSPQNTPQKVPVHQHSPSEPFLEKPVPDMTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKKPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSTRSVQSED

SEQ ID NO: 1018281 - protein, 159 aa, Homo sapiens
TPSSPALGTAPPITPEHPAESACASAFPVGALSRETSAGYDSDNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSPRSVQSED

SEQ ID NO: 1018282 - protein, 246 aa, Homo sapiens
MTQVSGPNAQLVKSDDYLPSIEQQPQQKKKKKKNNHIVAEDPSKGFGKDDFPGGVDNQELNRNSLDGSQEEKKKKKRSKAKKDPKEPKEPKEKKKPKEPKTPKAPKIPKEPKEKKAKTATPKPKSSKKSSNKKPDSEASALKKKVNKGKTEGSENSDLDKTPPPSPPPEEDEDPGVQKRRSSRQVKRKRYTEDLEFKISDEEADDADAAGRDSPSNTSQSEQQESVDAEGPVVEKIMSTRSVQSED

SEQ ID NO: 1018283 - protein, 146 aa, Homo sapiens
MSPAQHAPERARARWEPHTPRTWLGSASGSGRDLSVRLRRRRRFLFSKTGSDLDVYGRCVCQMLPTEVLALVGFSLPRVVIKSWGMSAQPPPGRAAPPLIGLLFFFFSQNFFLPASLRAPPHPARTHSVHCLNTSLMGLFSHNINE

SEQ ID NO: 1018284 - protein, 39 aa, Homo sapiens
PGRSSPAAVPWLPGRPTLAVDTFAVRAAPPHLPLEDAGA

SEQ ID NO: 1018285 - protein, 127 aa, Homo sapiens
RLWFTSAWDYAHCIVSRQYRLLVFQRHPEQRWREVADVLEELTTTWYFGARLIVLWLLSRVLENNFLLAIAGLAILAARRLVSLLAKDKKLHHLTSKHPYAADPVVAVITSSGHKLFHTISRLASFK

SEQ ID NO: 1018286 - protein, 149 aa, Homo sapiens
MPLFPLSFRGTDGLTAGLPIPSVSCRRVAGGRSDKAWSLPLCLCGVPAQQAWDLAAAPPPGHREAWGAGTLRLGGLWDTDPCKPVASYFSHPTSLPLPDDSHGWGFCLPKALCLSFLTKEQGANGDKGDQETAQPGAKPAAIAMEVHSC

SEQ ID NO: 1018287 - protein, 171 aa, Homo sapiens
ETALNAKAYKRSKRQSLAEARITEKLRSSRRSQRKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLLQQTDEYVANLTELVSEHKAAQVAKEKKKKKKKKKAKKK

SEQ ID NO: 1018288 - protein, 89 aa, Homo sapiens
LKLFLQRGNDLLEFKLLQGGYLVFSTFAVSYTASIMSSPFNPLNTYTAFSLTELMATMNLNSEIHRGEFVLTAAFTMKPWSYYSQDPWF

SEQ ID NO: 1018289 - protein, 214 aa, Homo sapiens
ALTCGDQPIQFRQQRIFAASPFKERALPAAQRRFFYGHRRSSTANRSVSHAASCLSRYSSASRCAFNGLLTTSPHGISQQFTNEGEAQCAYADVVVSVSHRMDSIFVDIEALSNQAATACCTFNALLPPAFLRLLYGAPGEQPRFTLRRNDLWLRNQVECPVADAVLVDPFFRLNDLRYLSGAAGDAVGDPVKLNERYAKLLGDFAASDRAAAS

SEQ ID NO: 1018290 - protein, 764 aa, Homo sapiens
MNVNQVAENLALSHQEELVDLPKNYPLSENEDEGDSDGERKHQKLLEAIISLDGKNRRKLAERSEASLKVSEFSVSSEGSGEKLGLADLLEPVKTSSSLATVKKQLNRVKSKKVVELPLNKEKIEQIHREVAFSKTSQVLSKWDPIILKNQQAEQLVFPLGKEQPAIAPIEHALSGWKARTPLEQEIFNLLHKNKQPVTDPLLTPMEKASLQAMSLEEAKMHRAELQRARALQSYYEAKARKEKKIKSKKYHKVVKKGKAKKALKEFEQLQKVNPTVALEEMEKIENARMMERMSLKHQNSGKWAKSKAIMAKYDLEARQAMQEQLAKNKELTQKLQVASESEEEEGGTEVEELLVPHVANEVQMNVDGPNPWMFRSCTSDTKEAATQEDPEQVPELAAHEVSASEAEERPVAEEEILLREFEERQSLRKRSELNQDAEPASSQETKDSSSQEVLSELRALSQKLKEKHQSRKQKASSEGTVPQVQREEPAPEEAEPLLLQRSERVQTLEELEELGKEDCFQNKELPRPVLEGQQSERTPNNRPDAPKEKKEKEQLINLQNFLTTQSPSVRSLAVPTIIEELEDEEERDQRQMIKEAFAGDDVIRDFLKEKREAVEASKPKDVDLTLPGWGEWGGVGLKPSAKKRRQFLIKAPEGPPRKDKNLPNVIISEKRNIHAAAHQVQVLPYPFTHHRQFERTIQTPIGSTWNTQRAFQKLTTPKVVTKPGHIIKPIKAEDVGYQSSSRSDLPVIQRNPKRITTRHTKTR

SEQ ID NO: 1018291 - protein, 766 aa, Homo sapiens
MNVNQVAENLALSHQEELVDLPKNYPLSENEDEGDSDGERKHQKLLEAIISLDGKNRRKLAERSEASLKVSEFSVSSEGSGEKLGLADLLEPVKTSSSLATVKKQLNRVKSKKVVELPLNKEKIEQIHREVAFSKTSQVLSKWDPIILKNQQAEQLVFPLGKEQPAIAPIEHALSGWKARTPLEQEIFNLLHKNKQPVTDPLLTPMEKASLQAMSLEEAKMHRAELQRARALQSYYEAKARKEKKIKSKKYHKVVKKGKAKKALKEFEQLQKVNPTVALEEMEKIENARMMERMSLKHQNSGKWAKSKAIMAKYDLEARQAMQEQLAKNKELTQKLQVASESEEEEGGTEVEELLVPHVANEVQMNVDGPNPWMFRSCTSDTKEAATQEDPEQVPELAAHEVSASEAEERPVAEEEILLREFEERQSLRKRSELNQDAEPASSQETKDSSSQEVLSELRALSQKLKEKHQSRKQKASSEGTVPQVQREEPAPEEAEPLLLQRSERVQTLEELEELGKEDCFQNKELPRPVLEGQQSERTPNNRPDAPKEKKEKEQLINLQNFLTTQSPSVRSLAVPTIIEELEDEEERDQRQMIKEAFAGDDVIRDFLKEKREAVEASKPKDVDLTLPGWGEWGGVGLKPSAKKRRQFLIKAPEGPPRKDKNLPNVIISEKRNIHAAAHQVQVLPYPFTHHRQFERTIQTPIGSTWNTQRAFQKLTTPKVVTKPGHIIKPIKAEDVGYQSSSRSDLPVIQRNPKRITTRHNKEEKL

SEQ ID NO: 1018292 - protein, 214 aa, Homo sapiens
LGDPPPSPRWQRPIPGSGARDGRIALGLRLPGPALPRFPRLFHCVSAPRRHPASPSDGREDGCTELAVTMLAQQAEEGSARLREMLSVGLGFLRTELGLDLGAGSRNGLPRAGVDPGWGTFGAASGAACLLGISAGSYRLGAAALRPGRPGKKGGSEARARKAGSEGGGPRPGRGPPNELGPLLKEISGARNKKKKNRKKLSEEGPNQMGGLLK

SEQ ID NO: 1018293 - protein, 147 aa, Homo sapiens
TYDGRGDSVVYGLRKSKKRRPDIQYPDATDEDISHMEEEFNAKAIPAQDLNALSDWSRGKDSYETQLDQSARNPHAHKQSREYKRKANDESNEHPEVIDSQELPKSREFHSHEYHSQEDMLVEDPKSKEEDKHLKFRNFTGIRKCIF

SEQ ID NO: 1018294 - protein, 162 aa, Homo sapiens
ETQTVDNANEKSEKPPENQKKLSDKDTVATKIQAWWRGTLVRRALLHAALSACIIQCWWRLILSKILKKRRQAALEAFSRKEWAAVTLQSQARMWRIRRRYCQVLNAVRIIQAYWRCRSCASRGFIKGQYRVTANQLHLQLEILLDSGPCIVTECIPFSIKE

SEQ ID NO: 1018295 - protein, 105 aa, Homo sapiens
VPVPPEWALPGPRPFPSAFYAPSLLFRLFRALCQKPGPLTWPSGSFCPPPFCGVLHALPALDSAREAGDEEDKENQGDETQGQQTTSTSVPPRTSSYRAQTPRKP

SEQ ID NO: 1018296 - protein, 105 aa, Homo sapiens; identical to SEQ ID NO: 1018295

SEQ ID NO: 1018297 - protein, 105 aa, Homo sapiens; identical to SEQ ID NO: 1018295

SEQ ID NO: 1018298 - protein, 240 aa, Homo sapiens
GGRGPGGPAPGGTNGLSLSGELRLGPGWAGGASGPGGAGRARPLPCSGEGEREQRRTEGISSLAPGTSSKPRPSFLLSCRHAPLTRTDPRQGRRRRLHPRNECFGVAVAVVVFVAAAAACKAAGAGLENISGLGPSLTTASSLPGQRRPAIRCDASTCHPRTRDYRGHGTGGVTAPAPGARPSCCSARLREPQGGEAGRTKRQAAEGCGPELRLRAGRSPRPTRTSVTSPPQTLSDKGGG

SEQ ID NO: 1018299 - protein, 288 aa, Homo sapiens
MCKGVHQRSFRVSKRYLSVEMKTGEFLLAGLVLGWMILVWNLTGCLCCHLHKKCHLFFAQRVDNPKDANWCWISYFQRPFLSSSFWTVFTLSSIWFLYHIAVTVRIFTLNWFCEPRFGHFTAVQLASSFISLLILDPRQGRRRRLHPRNECFGVAVAVVVFVAAAAACKAAGAGLENISGLGPSLTTASSLPGQRRPAIRCDASTCHPRTRDYRGHGTGGVTAPAPGARPSCCSARLREPQGGEAGRTKRQAAEGCGPELRLRAGRSPRPTRTSVTSPPQTLSDKGGG

SEQ ID NO: 1018300 - protein, 69 aa, Homo sapiens
ASWESRTHTEGTSEDPAGVQMSLTALLSQSEDESAQPLQKPAPSLPDPTTEKPPGAAGQCSAEGPSATA

SEQ ID NO: 1018301 - protein, 381 aa, Homo sapiens
GSGEPNPAGKKKKYLKAALYVGDLDPDVTEDMLYKKFRPAGPLRFTRICRDPVTRSPLGYGYVNFRFPADAEWALNTMNFDLINGKPFRLMWSQPDDRLRKSGVGNIFIKNLDKSIDNRALFYLFSAFGNILSCKVVCDDNGSKGYAYVHFDSLAAANRAIWHMNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 1018302 - protein, 328 aa, Homo sapiens
RGSGKLLITVPGFSRPACPPSLSLLLALGPSVGLSCGEKPQPIGLRWDRLPRICPSSLTPPRIWPDPPRVRADPLTARLPVNLSGPASSLRLLKSPRLTRLAAANRAIWHMNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 1018303 - protein, 173 aa, Homo sapiens
EEDDKEDDDDDEDDDDEEDEEEEEEEEEDDDDDTEDFADQENLPDPQDISCHQSPSKTDHLTEKAYSDTPRDFPDSFQAGSPGHLGVIRDFSIESLLRENLYPKANIPDRGPSLSPFAPDFFPHLWARGDFGAFAQLPEEPMGQWATGSGHQNRKIKEEEKESCPHPHHPQYT

SEQ ID NO: 1018304 - protein, 174 aa, Homo sapiens
MGARMTRAFRNFNVEKRAEQEISKRKPSMAPKHPSTRSLLQEHLSQYPEIEEEVSRKDNKLLSLLRDVYVNSKDPVPSLPVKAIEPQQQPKEFRLPIGDQFDKNIKDIPKGKITVVEALTLLNNHKLSPETWTAEKIAQEYHLELEDVNSLLKYFVTFEVKIVPPEDRKAIQSK

SEQ ID NO: 1018305 - protein, 102 aa, Homo sapiens
MGARMTRAFRNFNVEKRAEQEISKRKPSMAPKHPSTRSLLQEHLSRECGPFQASGDIEVSPRGLRWWQRQGIPEPKAARALFRGLHRMRSESRPNEVPRVSR

SEQ ID NO: 1018306 - protein, 131 aa, Homo sapiens
PAHVMAPEENAGTKLLLQSFERRFLAARTLRSFPWQVGGGASGEACGACGSPGQTGWVSLLKPPALLPREFLGSPRSGPRDPVPVPGAWPESLSPLLPRELAAEAGGVSTVLGGRRALVCGVQFTIIFMTF

SEQ ID NO: 1018307 - protein, 210 aa, Homo sapiens
GGQKKKVHLIHPFIKSINIIKKYFEEYALVNQDIENEWDKILALVPTIHDELQQKSHNSLQRGWKVARYQYNINNDKYGPWLEWEIMLQDCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 1018308 - protein, 255 aa, Homo sapiens
PPRPRVGPHSRLGVARRVEVLIVEPWLPGGRSRTVVDGGVAVAPDSARRGRSCFAIRVGLPRQWRHESWAPYAACPAWERGGCCKGPIGGFGLPAHSAAASGLASAEKILFYPALHLCSTASRLRAGVSTVVPAPKEVAEVPYRVDLQGSGMEPLFPAPFWEVIYGSHLQGQPVPPEPQPQSAAPASAAQCQPRRLPAPRAQGHHRGALPGRVCRRAPGELPCHVRHPQAHQNEDSHQYLPSLTWPGDTLVLLTL

SEQ ID NO: 1018309 - protein, 205 aa, Homo sapiens
PPRPRVGPHSRLGVARRVEVLIVEPWLPGGRSRTVVDGGVAVAPDSARRGRSCFAIRVGLPRQWRHESWAPYAACPAWERGGCCKGPIGGYRTEWICRAVAWSPSSPRRSGRLSTAATFRGNLSLLSPNHSLLPPHLLLNASHGAFLPLGLKVTIVGLYLAVCVGGLLGNCLVMYVILRHTKMKTATNIYHLYTWPGDTLVLLTL

SEQ ID NO: 1018310 - protein, 172 aa, Homo sapiens
MKLKSNYFGLPAHSAAASGLASAEKILFYPALHLCSTASRLRAGVSTVVPAPKEVAEVPYRVDLQGSGMEPLFPAPFWEVIYGSHLQGQPVPPEPQPQSAAPASAAQCQPRRLPAPRAQGHHRGALPGRVCRRAPGELPCHVRHPQAHQNEDSHQYLPSLTWPGDTLVLLTL

SEQ ID NO: 1018311 - protein, 108 aa, Homo sapiens
AECQLQLHNFPMDEHSCPLIFSSSTILAFRLSLHAYQLTFKSFKLDGVLQITSSETRFHSWGNEGSERLHLPPWGPQSWLVVAVNWEITFSDFSSRVLTTQHWEEPLN

SEQ ID NO: 1018312 - protein, 75 aa, Homo sapiens
SGLQDPVLPCSPSFQALPCVQPQFACCRISTTLPRGQRHRQTHHAPCRHVLCCARQAPATSLPPELAFSGDSGQH

SEQ ID NO: 1018313 - protein, 154 aa, Homo sapiens
SHIQGGGGSRTIRAHRRRDRCRVSAPGRPTFARTTDTCCALVRGSDDITFVARLLDSLPRSTCAGLSARLHITDSPAALRQAFCFACAAAGSHDRIVEFTGSMLLASEPVQESLRAMAAVTIAVLAEYDRVHTADLVASLRAFLEANGHWETAA

SEQ ID NO: 1018314 - protein, 637 aa, Homo sapiens
MIQSDKGADPPDKKDMKLSTATNPQNGLSQILRLVLQELSLFYSRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISMEEEDDMKIDEKCVEADEETFESEELSEDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 1018315 - protein, 300 aa, Homo sapiens
MRFDLDLGKKLYKDEETFESEELSEDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 1018316 - protein, 182 aa, Homo sapiens
KPMSSTDLPVPDARAETAARARQLQLTKPPGSLGRLEELACWFAARSGNPIPEISRTEVFVFAADHGVAAQGVSAFPPSVTGQMVANFAAGGAAINVLARLESCPMQVVDVGVAGDAEPPPAVRREKVRAGTRDLLVEAAMTEDELTAALGVGARCAREAIQRGAQLLIAGDMGIANTTAAA

SEQ ID NO: 1018317 - protein, 113 aa, Homo sapiens
TLKLTFESRLLQQPISNPTTSNLQNKTDLKLPLFSQTPACLNQSQGSLLPLPYVTPTKSYLPILYCRLLRRQVLPVHPTAAPHSLSYPTSRNFFKRRFYIGRHPTLKGVPSQL

SEQ ID NO: 1018318 - protein, 192 aa, Homo sapiens
MKEMLRKFSTEITLDPATANAYLVLSEDLKSVKYGGSRQQLPDNPERFDQSATVLGTQIFTSGRHYWEVEVGNKTEWEVGICKDSVSRKGNLPKPPGDLFSLIGLKIGDDYSLWVSSPLKGQHVREPVCKVGVFLDYESGHIAFYNGTDESLIYSFPQASFQEALRPIFSPCLPNEGTNTDPLTICSLNSHV

SEQ ID NO: 1018319 - protein, 261 aa, Homo sapiens
GTRETPCVHHSTSLEETGDAFLCSLCSHSWCASWEADSEVRGALERSEPLLLQCPEATTTELSLCRITGMKEMLRKFSTEITLDPATANAYLVLSEDLKSVKYGGSRQQLPDNPERFDQSATVLGTQIFTSGRHYWEVEVGNKTEWEVGICKDSVSRKGNLPKPPGDLFSLIGLKIGDDYSLWVSSPLKGQHVREPVCKVGVFLDYESGHIAFYNGTDESLIYSFPQASFQEALRPIFSPCLPNEGTNTDPLTICSLNSHV

SEQ ID NO: 1018320 - protein, 99 aa, Homo sapiens
GAPQPTLDSGPPTLRSVLPPRGLQAPPPTFFAMFLFCWNHTRLISNIKYLCLQQGGEEGPHAAELAPPPGTQARGDIGKGTPAPCPPLSAPYCGKETRT

SEQ ID NO: 1018321 - protein, 101 aa, Homo sapiens
GAPQPTLDSGPPTLRSVLPPRGLQAPPPTPSPSPPSPRPALHPYSPYLTPSFNSERKSGRTRRSWPRRLVLKPAGTLGRGPPPPALPSLHRTVEKKHALSL

SEQ ID NO: 1018322 - protein, 66 aa, Homo sapiens
AILVKFTLKSRIPQLSVAQPVKWQVQPSPYLSSRLPKDFVNLFTGEDAPKLIDFLKLKRNQQEDDL

SEQ ID NO: 1018323 - protein, 129 aa, Homo sapiens
GVFGFVHFGEDLIQGLQFLVREIRSVMGEVCRIQGHLGYPSSGVLPRQGIVGGSSSIKLLSGGDIKHHSLHCQVDGLIFLLFPIAGQLLLGEKPHWGPPLRRARLSARPGLWASPGASARTRASAASAR

SEQ ID NO: 1018324 - protein, 144 aa, Homo sapiens
DLAASESLFGESSVAALDAWPTCCKRWPMKVGKSRIAWPCAILPMWTMSASKRCLCDECPLPDFPRYPLSLRQPGVPGPAQWRTCGRGLRLAACSSQQLEISPEPTSRRDELDVFGNPITRLAFERPHDELLVNAGLTVEVLRG

SEQ ID NO: 1018325 - protein, 171 aa, Homo sapiens
SADALSTSCTRSTQLNVATGKAGQACQYVKRPPIAAAEEPPNLSPQKDPQPPLSCSGPAGFPPQGMREGTLVKPLLPSAFRTRSPGERLVVSSKVGLQVVLGSNITAQPSLTTDFVTVDLMRVVGESVPGNNPQLFLVAAGRGRFYTADLSPGKKHGALGTHCAWMGAGPT

SEQ ID NO: 1018326 - protein, 341 aa, Homo sapiens
MKKISLKTLRKSFNLNKSKEETDFMVVQQPSLASDFGKDDSLFGSCYGKDMASCDINGEDEKGGKTDQSESLMGTLKRLSAKQKSKGKAGTPSGSSADEDTFSSSSAPIVFKDLRAQRPIRSTSLRSHHYRPAPWPLRPTNSEETCIKMEVRVKALVHSSSPSPALNGVRKDFHDLQSETTCQEQANSLKSSASHNGDLHLHLYEHVPVVIGLMPQDYIQYTVPLDEGMYPLEGSRSYCLDSSSPMEVSAVPPQVGGRAFPEDESQVDQDLVVAPEIFVDQSVNGLLIGTTGVMLQSPRAGHDDVPPLSPLLPPMQNNQIQRNFSGLTGTEAHVAESMRCI

SEQ ID NO: 1018327 - protein, 36 aa, Homo sapiens
MAVTPVMPVISAVVLSPSIKGPQKIARKAKAASIRV

SEQ ID NO: 1018328 - protein, 551 aa, Homo sapiens
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHGGLSSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSK

SEQ ID NO: 1018329 - protein, 129 aa, Homo sapiens
KAQWMHDSPEANHNKLNQDDARYGFRSCHIKNIWTAPLPLETELSRQMTTSTTSIDIMGLQAAYANLHTDQERDYFMQRYRDVISSFGGKTSYDADNRPLLVMRSNLWASGYDVDGTDQTSLGSTRPRI

SEQ ID NO: 1018330 - protein, 126 aa, Homo sapiens
KAQWMHDSPEANHNKLNQDDARYGFRSCHIKNIWTAPLPLETELSRQMTTSTTSIDIMGLQAAYANLHTDQERDYFMQRYRDVISSFGGKTSYDADNRPLLVMRSNLWASGYDVDGTDQTSLGQIL

SEQ ID NO: 1018331 - protein, 35 aa, Homo sapiens
PAELEDSGVYFCASSQSLEGTQYFGPGTRLLVLED

SEQ ID NO: 1018332 - protein, 131 aa, Homo sapiens
KTQGLSPKKRGCGKVPRRQTTDDPRPDAAEAEAAAFGGSPPSQIHTFWARPELSHVGVREPGAGGRCGGRAGGVLTPRTCFTGKAAVFTYLIANSDEFLYQLHSCAPRIQFLSSFGHPRFPAMDSCNKPLS

SEQ ID NO: 1018333 - protein, 171 aa, Homo sapiens
WPALTTLLFENVGGSEKSLLSSQVPLRDAGRAGHLGVTSASLALCLVVTLRLLREQYGLDVRQDAALGDGDFAQQLVQFLVVADGQLEVTRDDARLLFVPSSVGRQLQVYRGSDTLGPQPCKRERSAPLAPVSLPLRTGEMHSPYRELKANAGRARLGLGAGVASLRSTDQ

SEQ ID NO: 1018334 - protein, 34 aa, Homo sapiens
WPALTTLLFENVGGSEKSLLSSQVPLLSSSKQPY

SEQ ID NO: 1018335 - protein, 124 aa, Homo sapiens
APGKALRPLAIALRTNAQDQFLLKQLVSNVLIFSCTNIVGVCTHYPAEVSQRQAFQETRECIQARLHSQRENQQQERLLLSVLPRHVAMEMKADINAKQEDMMFHKIYIQKHDNVSILFADIEG

SEQ ID NO: 1018336 - protein, 204 aa, Homo sapiens
APGKALRPLAIALRTNAQDQFLLKQLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEPSRWSGLVRVD

SEQ ID NO: 1018337 - protein, 232 aa, Homo sapiens
SAWLSCGLNESLPYRYGVTKSTINGHLCPTWEQLNMCDWDLSQPYNQVRSHIPFKRSFLKIEDRELNIGPVVAGVIGARKPQYDIWGNTVNVASRMDSTACTRPHPGHHRHVPGAGCQHVPAGVPGRGQGQGQRRDDDLLPQWRVPAQLAAVGQWCQAAWPPEAWKQLLCVPGVAGKPCSSPQGCAAEIFHLDSRAASAFAGGQRPLSQAPGCQRPASTQLTKDVSLCRRLC

SEQ ID NO: 1018338 - protein, 190 aa, Homo sapiens
MKLMDQMKYINEHSFNNFQMKIGLNIGPVVAGVIGARKPQYDIWGNTVNVASRMDSTGVPDRIQVTTDMYQVLAANTYQLEFRGVVKVKGKGEDDDLLPQWRVPAQLAAVGQWCQAAWPPEAWKQLLCVPGVAGKPCSSPQGCAAEIFHLDSRAASAFAGGQRPLSQAPGCQRPASTQLTKDVSLCRRLC

SEQ ID NO: 1018339 - protein, 110 aa, Homo sapiens [sequence omitted]

SEQ ID NO: 1018340 - protein, 168 aa, Homo sapiens
TREFLEEKLGHRHGIDITCPQEPLSFPVGLGKAQHNPEVHVRAEPVQGCPCNYRAPSCKVTRTKSCSQQAIFVGQNYPTRIRQIIDKDRQPQKVEAFKGKILCQSHPQSMPHRKPVPHPNPTCRRQVSLVCPAVPTSAKSPVFSDVPFLTGQKMLPKHLQGGKFPPTK

SEQ ID NO: 1018341 - protein, 153 aa, Homo sapiens
CWYVYLESKNCIQRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 1018342 - protein, 389 aa, Homo sapiens
MALTPESPSSFPGLAATGSSVPEPPGGPNATLNSSWASPTEPSSLEDLVATGTIGTLLSAMGVVGVVGNAYTLVVTCRSLRAVASMYVYVVNLALADLLYLLSIPFIVATYVTKEWHFGDVGCRVLFGLDFLTMHASIFTLTVMSSERYAAVLRPLDTVQRPKGYRKLLALGTWLLALLLTLPVMLAMRLVRRGPKSLCLPAWGPRAHRAYLTLLFATSIAGPGLLIGLLYARLARAYRRSQRASFKRARRPGARALRLVLGIVLLFWACFLPFWLWQLLAQYHQAPLAPRTARIVNYLTTCLTYGNSCANPFLYTLLTRNYRDHLRGRVRGPGSGGGRGPVPSLQPRARFQRCSGRSLSSCSPQPTDSLVLAPAAPARPAPEGPRAPA

SEQ ID NO: 1018343 - protein, 104 aa, Homo sapiens
LPTAGAPAFLELLARFSELPAPQRVGTSGPRGGVGPVVGAGGIGTGQAPWLRIHKPGFGLSIYKCVYSPDCNHIPSRKCLGVFAALEARSLLTPTTSRPCTAAA

SEQ ID NO: 1018344 - protein, 105 aa, Homo sapiens
KQERLHLRLKTSVVWVVRKEKPTRFPRLGAVSHCPQLLILQLVLSPSTSKTLPRSPQTLRAHDQKEKESQVGEEQGPPTPQPSTLPRGPTLGCLEPPKVATPATQ

SEQ ID NO: 1018345 - protein, 130 aa, Homo sapiens
MRLSQSTAGVGVGLIPELWWPLHLASFEGTPAGARCGVLPPVFSAQERCLHIGLPGLKSISFLILQLVLSPSTSKTLPRSPQTLRAHDQKEKESQVGEEQGPPTPQPSTLPRGPTLGCLEPPKVATPATQ

SEQ ID NO: 1018346 - protein, 106 aa, Homo sapiens
DTQAYTFSRLEVWDFGGSQFYETQRDRFRIYPPHEGNSPPREKFRTRANFFFGKPPSPFMATVWEFPEHWTLPKPPRKISPFGDGRNPPRKNPRRYSRKTGVGPPF

SEQ ID NO: 1018347 - protein, 313 aa, Homo sapiens
NDFFKDMFPDLPGGPLGPIKAENDYGAYLNFLSATHLGGLFPPWPLVEERKLKPKASQQCPICHKVIMGAGKLPRHMRTHTGEKPYMCTICEVRFTRQDKLKIHMRKHTGERPYLCIHCNAKFVHNYDLKNHMRIHTGVRPYQCEFCYKSFTRSDHLHRHIKRQSCRMARPRRGRKPAAWRAASLLFGPGGPAPDKAAFVMPPALGEVGGHLGGAAVCLPGPSPAKHFLAAPKGALSLQELERQFEETQMKLFGRAQLEAERNAGGLLAFALAENVAAARPYFPLPDPWAAGLAGLPGLAGLNHVASMSEANN

SEQ ID NO: 1018348 - protein, 313 aa, Homo sapiens; identical to SEQ ID NO: 1018347

SEQ ID NO: 1018349 - protein, 108 aa, Homo sapiens
FYFVKVMTSYKLNFSDDWLVLSVFSWLQFGIVHCKISKDVEYCMILHTTGCHSSQQDCYTHPLFSEVICLGSRLSDSCLRFRHFSLKHAHVHQPTCPRVPPHQPSDWG

SEQ ID NO: 1018350 - protein, 172 aa, Homo sapiens
MFSWFLNLQQVLKRKALLAPCLPDLLSPSLPSLFLPSLLWFLSSPERRRVRPQGEPRAGVPNPCAMGTKRLQLFLLPWLFPEQKHNKQKGQRRAQTLSLSQLSRRDPLILHTTGCHSSQQDCYTHPLFSEVICLGSRLSDSCLRFRHFSLKHAHVHQPTCPRVPPHQPSDWG

SEQ ID NO: 1018351 - protein, 68 aa, Homo sapiens
PSVPLGSRDCRKEERQEGAGCAAPPPGGALGTGKESPVGGVRWLFTPASLSWSLDLSSAGRWHRTKHG

SEQ ID NO: 1018352 - protein, 316 aa, Homo sapiens
MEGAWALPTWKEEGREQAAGQGEEEECPICTEPYGPRERRLALLNCSHGLCVGCLHRLLGSASSADLGRVRCPLCRQKTPVLEWEICRLQEELLQADGPSRQPRREAPASYHRNPGPWGSLEHRYQLRFLAGPVGGRGCLPFLPCPPCLGARLWTLRERGPCARRLALLSLLALELLGLLLVFTPLLLLGLLFVLLDRLAAEQSPGQPAANRPGGPDWPTYPCLGAVRPDDQAGKTQGWVQGSGLQSRPPIAEPTTRATQRPDPARVHGCTAAQTLAEPKDTSAQGQLLEEASPAGKSVSRTPFTLRQTGTVLATG

SEQ ID NO: 1018353 - protein, 82 aa, Homo sapiens
LPLMALPPCHALCQFYVVNSGAVLPPEGRLGLRALQRRPSHEQTQHGPAEFTLGLFTPATKARGTRPSQAGFSKVEVTQARR

SEQ ID NO: 1018354 - protein, 73 aa, Homo sapiens
ATWASVCLFYIAIYALLTYIDCSTFTGLKPGDFIHIFGRCTYLPEIIIEPAENSASVVEPRTFPLVSGFFVKV

SEQ ID NO: 1018355 - protein, 234 aa, Homo sapiens
AGGGGVGVRGEARGLACGAACAPPGLSVPAPAAARPSRRRAHTQRTPCTPHTLAPLLTHTHTLSLAEQEPLTILQVSGPATARWAQTSRFPFPGFSLGDDDEGRRWARTQPRRRALVGPFSWQSRSPGRARASGQSRIQRSGRSRRARRMGTPLFPAGDSGKTKTVTRKKYERIVQLLNGSESSSTDNAKFKFWVKSKGFQLGQPDEVRGGGGGAKQVLYVPVKTTVSDSPSSV

SEQ ID NO: 1018356 - protein, 134 aa, Homo sapiens
AGGGGVGVRGEARGLACGAACAPPGLSVPAPAAARPSRRRAHTQRTPCTPHTLAPLLTHTHTLSLAEQEPLTILQVSGPATARWAQTSRFPFPGFSLGDDDEGRRWARTQPRRRALVGPFSWQSRSPGRARASG

SEQ ID NO: 1018357 - protein, 146 aa, Homo sapiens
AGGGGVGVRGEARGLACGAACAPPGLSVPAPAAARPSRRRAHTQRTPCTPHTLAPLLTHTHTLSLAEQEPLTILQVSGPATARWAQTSRFPFPGFSLGDDDEGRRNQRSPVWGSHHYSGYPPPAACLRLPTSPWNGYLFGALQSIL

SEQ ID NO: 1018358 - protein, 53 aa, Homo sapiens
LLSPPWAKQGRSGLGVAWMWAKSTVLLGGKSPLKKNQPSLPRILSWKIYEVGN

SEQ ID NO: 1018359 - protein, 159 aa, Homo sapiens
MGRIVQAPTPGLAPGSRAEGNPRADLWGRMRMKTWSFHCLGFDRPTGISTGDRGSGEGVALSRLFRGFPASGLLPLDRSQVRGGDVSAPGGGGDGEVEEVQPQAARLSPADSCGNRGGGTLPLSRRPRERWRGALNPRSFERLLCASAASRRARDKQWV

SEQ ID NO: 1018360 - protein, 257 aa, Homo sapiens
MNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVNRRSPPWDILPSSTAQACLAHIALQVVHCTSPSSVIHMDHSVNSIPSHAWNPALGELSKTLIIQTMDSQAIDERTGPENRIPERPDPDSRPIPITHLNVRMFGTSFVPAWFLHLASFAWTVLRCFPYAVPF

SEQ ID NO: 1018361 - protein, 169 aa, Homo sapiens
MNGRKHFVEKRYSEFHALHKKLKKCIKTPEIPSKHVRNWVPKVLEQRRQGLETYLQAVILENEELPKLFLDFLNVRHLPSLPKAESCGSFDETESEESSKLSHQPVLLFLRDPYVLPAASDFPNVVNRRSPPWDILPSSTAQVENPTWLKEAEASFEVTVKEINTTNLT

SEQ ID NO: 1018362 - protein, 126 aa, Homo sapiens
IRRLDHIVMTVKSIKDTTMFYSKILGMEVMTFKEDRKALCFGDQKFNLHEVGKEFEPKAAHPVPGSLDICLITEVPLEEMIQHLKACDVPIEEGPVPRTGAKGPIMSIYFRDPDRNLIEVSNYISS

SEQ ID NO: 1018363 - protein, 139 aa, Homo sapiens
LDTCEDRHYRQRHCRTDQCLPAQPPSRHHPVRSGRPIGGYTHTVNVTVDGRSYAVDTGFIVFNNWTYPNFIKLLGQIGVTFKPTEMSFSVCDPNAGFEYNGNNLNSLFAQRRNILSPGFWGMLRDILRFNRQAPLDLQE

SEQ ID NO: 1018364 - protein, 263 aa, Homo sapiens
MPIQAPSLPLLGPSPPPTHQSQHITHHHQQQQQQQQQQQQQQQQQQQQQQQTAAASRKLWGPLLLGAFPHPLEGGSYHHAHPYAMSPLPGVSEALATRDQTQPAPHLHSQVVLTGQAGTQMASSLFLFQLFLFHFSRVLPMFTPLRCRRALKGRPTLTIGDYGTPALRLPYKEHATVASIASTATRGLTTWAQRTAKRARTGGLQTAARAEYKPGRSSSEGAPRATSDPHRAGLRQPARDWPQRASGHRPTAPPARTKSVIHN

SEQ ID NO: 1018365 - protein, 123 aa, Homo sapiens
TNPGDKLGLQCGRGPSEVNRHKGDFRAQENVPSCCHRGHCHQERSREMRALACSPKANPKGHHCPAQKQGHQRQRQQLGPTSQGACVPSWSPPPQAKNGKHLGRPPSTAAGTDVCTEVSCLLN

SEQ ID NO: 1018366 - protein, 183 aa, Homo sapiens
HAAATPDTGFACNLCGQSFRGWVALVLHLRANSAAKRPIACPKCERRFWRRKTASSIIMRGATITAPEPGPSYAATVAGALPVGPASCHKRVHVAEALEEAAAKALEDTPGAPPVTAPRPGGDAVDRPFQCACCGKRFRKPNLIVTAACTRRAAPPVPECGKRFTNKPYLTLHRRIHTGEKPY

SEQ ID NO: 1018367 - protein, 59 aa, Homo sapiens
MVIPGEHWPAAVTVMLSPAPAPPGPDRQAPPARRRRGGGVDAVANAFARERVQEGAGGR

SEQ ID NO: 1018368 - protein, 151 aa, Homo sapiens
MWALHSLGVDQGGRLHSGGNNKQKQNKRGAERHKKYPQRRAPNYTDTQSFLEPRRLNRREGDINNAHQRHRRRRELTHTAPQRGKNSGNHGENHMEEEENPNHRRGARTHRWGTNSTGQRGYINTGETHINTTDESKVSEQTGDINRAVDK

SEQ ID NO: 1018369 - protein, 82 aa, Homo sapiens
MLKVHRLHILEGCLVWPLALQVLGASQQHGWRFLVLEAALCRLCRAGPLEKQWWGVAWLAGEAVVGSGLARWRSSAQAERPQ

SEQ ID NO: 1018370 - protein, 392 aa, Homo sapiens
MVRRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKMVDTPASEPAQASTPTDPKGLAQL

SEQ ID NO: 1018371 - protein, 471 aa, Homo sapiens
MAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 1018372 - protein, 459 aa, Homo sapiens
CSAFLEVGAARAMAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 1018373 - protein, 410 aa, Homo sapiens
CSAFLEVGAARAMAAAQPKYPAGATARRLARGCWSALWDYETPKVIVVVRIHRAEKLPGERDGPRELHHHQGQGDHHVRAQSVGRGGVREAGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 1018374 - protein, 509 aa, Homo sapiens
CSAFLEVGAARAMAAAQPKYPAGATARRLARGCWSALWDYETPKVIVVRNRRLGVLYRAVQLLILLYFVWYVFIVQKSYQESETGPESSIITKVKGITTSEHKVWDVEEYVKPPEGGSVFSIITRVEATHSQTQGTCPESIRVHNATCLSDADCVAGELDMLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVVRNPLWGPSGCGGSTRPLHTGLCWPQGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 1018375 - protein, 323 aa, Homo sapiens
MLGNGLRTGRCVPYYQGPSKTCEVFGWCPVEDGASVSQFLGTMAPNFTILIKNSIHYPKFHFSKGNIADRTDGYLKRCTFHEASDLYCPIFKLGFIVEKAGESFTELAHKGGVIGVIINWDCDLDLPASECNPKYSFRRLDPKHVPASSGYNFRFAKYYKINGTTTRTLIKAYGIRIDVIVHGQAGKFSLIPTIINLATALTSVGVGSFLCDWILLTFMNKNKVYSHKKFDKVCTPSHPSGSWPVTLARVLGQAPPEPGHRSEDQHPSPPSGQEGQQGAECGPAFPPLRPCPISAPSEQMVDTPASEPAQASTPTDPKGLAQL

SEQ ID NO: 1018376 - protein, 103 aa, Homo sapiens
MRLAAAGTWDVTALTLRHLLRRHRSCNSHWKVVKAKTVNHLLRVGVNLKRSNRRVKSRHLWNILVLALALFFLKLERDATNRATLDTPHQVCRETSDLVAQTL

SEQ ID NO: 1018377 - protein, 106 aa, Homo sapiens
LRSGGVPSNPPVSFLLVFTGGMRSCGRSHLVSLKRLPQGPADPSHPGGKRNYVLCGSPPTRLAGSEGEQDRSAATAPLTASSLGLRLRPWRGEGAPLCTPTSHQKL

SEQ ID NO: 1018378 - protein, 220 aa, Homo sapiens
MKVASGSTATAAAGSQCALKAGKTASGSGEVVRCSEQSVASRPGASGRACLPCWKYKVLFEMNGSRLKELVPTLPQDRKVSKVEIFQHASDTSGTFRLELNSESEVGTPGGRGLPVRAPVSTLNGENQRPDGGGGMRSCGRSHLVSLKRLPQGPADPSHPGGKRNYVLCGSPPTRLAGSEGEQDRSAATAPLTASSLGLRLRHWRGEGAPLCTPTSHQKL

SEQ ID NO: 1018379 - protein, 106 aa, Homo sapiens; identical to SEQ ID NO: 1018377

SEQ ID NO: 1018380 - protein, 126 aa, Homo sapiens
PQVHLLPPPSEELALNALVTLTCLVRGFSPKDVLVYWTNKGEEVPKDSFLVWKPLPEPGQEPTTYAVTSLLRVPAEDWNQNESYTCVVGHEGLAEHFTQKTIDRLAGKPTHVNVSVVVADVEGVCY

SEQ ID NO: 1018381 - protein, 137 aa, Homo sapiens
GTAPRRTRRACVQPPRKPAGPGAPLLVVGSSRNLLSPLSVMSASQALQTVALSAAHGSSSEPNLALKALAFNGSPLRFDKYRNSDFAHLIPLTMLYPKNHLDLTFHPPRPQTAPPSIPSPKHSFLAYLGLRERAETV

SEQ ID NO: 1018382 - protein, 135 aa, Homo sapiens
MFYEYIDMYTCTHSHRETHTGLLILTNPYKHDSGPLSVMSASQALQTVALSAAHGSSSEPNLALKALAFNGSPLRFDKYRNSDFAHLIPLTMLYPKNHLDLTFHPPRPQTAPPSIPSPKHSFLAYLGLRERAETV

SEQ ID NO: 1018383 - protein, 182 aa, Homo sapiens
KGIQRQCHIGDAICSERRRHKDNLWFHPAGKMTRAPMHTHHRVVVCSIARGGENGESHKPADGSLRRDLPAAATQRDPNFKLFIIRGSPQQIDHAKQLIEEKIEGPLCPVGPGPVCLSPAANGPFNPGPFNQGPPGSPTCRGPPPHQYPPQGWGNTYPQWQPPAPHDPSKAAAAAALDITRG

SEQ ID NO: 1018384 - protein, 689 aa, Homo sapiens
KGIQRQCHIGDAICSERRRHKDNLWFHPAGKMTRAPMHTHHRVVVCSIARGGENGESHKPADGSLRRDLPAAATQRDPNFKLFIIRGSPQQIDHAKQLIEEKIEGPLCPVGPGPVCLSPAANGPFNPGPFNQGPPGSPTCRGPPPHQYPPQGWGNTYPQWQPPAPHDPSKAAAAAADPNADVAAYYSHYYQQPPGPVPGPPHHGALPPPTGLQAPASPPPGSREMPPHQPEHYDPSRPAPPHTSLSPRNVQHAATPCSTTPRTPPQHPQQHPTPAPRAHRPSTQHTITPPAHRTLSPPAHRHQTPHAPSPTSRDRNTTTPPKPPHHPPPRHHTQTRAGHPHSERHGHTADDNQSQSTNKRNRATPPPPRGRQRKGTENTKGPQTHPLSHHPGTHTFTTYTTPHPTLDNTPSSPTHEYPQLQPTNNPKYHHKIPTLQLHLCPLYTTPRHPIPHTKPTQKLNQQPSDDKQPFAQTAPEPYVTDEKEWHTISPNGNTTQRAAPHPSRAWAEQSDRRRVTDQDNTDRTRRAYVPANTRPQINEGRTKQREKRDSTETPGTHVENSRPRTPTATHYTSRRRLIERQQRAHTVPEARWGKNRRGGTLEPTSAPADTDDSGVVHPLPHDITGHPHNPEHLTERSTVPELTDGHRYIATPMTHSHAQANSTPPARQQRARRLSTSETEAQTDKQEST

SEQ ID NO: 1018385 - protein, 158 aa, Homo sapiens
LDHPANGDESPGHLTSLQDAMCETMEQQLSSDPDSALTEDGSSSAPPSGLVLLPETSLGLQPGEATSHWIHPRPRFSILEGPSPGSRSVHDLPLVQFLISGLQWSSCARTQARLGVPQECEGQGRASQPACVQKLLPEGRAYLGTQKSIWEGRGLGVG

SEQ ID NO: 1018386 - protein, 80 aa, Homo sapiens
PMVKLFETPYGLFVKTFPGAQKKPFCCVICRADDVCVTHNGYSPFFDFDFCCVIKNLNSVRKSEFSVGESAFCSPGDNPN

SEQ ID NO: 1018387 - protein, 97 aa, Homo sapiens
IRGRVDLQKTTEGREVRDENKSLCLVIQEFFWKLPKTTTVVSVQACNSHSVIGLWGTPKVETGKVTKNLDDYTHVPSNTWKAFPRIGRNKPRLKRLQ

SEQ ID NO: 1018388 - protein, 71 aa, Homo sapiens
GSEVCGGLLRAPGIRGERASQKFGCSCPGGVVLAAPRAARGLSGRHLRSRAGFCVWHLLLMLRLATYRGGR

SEQ ID NO: 1018389 - protein, 119 aa, Homo sapiens
RYLKQFLTFMSQEEVEWENMLEATDFLSFYTLGMKVKLFFYNVSERLLMSDALVLAKMKGFDVFNALDLMENKTFLEEAQVWHRGRQPAVLPLQLEMPQHGGREGWTGATITSHQCDSR

SEQ ID NO: 1018390 - protein, 119 aa, Homo sapiens; identical to SEQ ID NO: 1018389

SEQ ID NO: 1018391 - protein, 127 aa, Homo sapiens
MSKLCTQEKSLGEASLCGLGPHGTDPRLAVDFRSGHFSNIRTHPVLTLNHTNSVASLWIKEQHVSAGPGNSPWKLENHPVPRCCQAQDLAPCRHLAGTGPAPGALGRTGVVTNSGPPTAGPRNQADR

SEQ ID NO: 1018392 - protein, 314 aa, Homo sapiens
SAPVARWRRPCWAPGLCVRSGRRRGPEGWRGDGVSPALGPSLRPLPPPIPSLLEMDLPVGPGAAGPSNVPAFLTKLWTLVSDPDTDALICWSPSGNSFHVFDQGQFAQGGAAQDLKANNHGQASCGKLNIVWFPEGGPHQPGAACSSQKKDNTESPSKPWFLAWPRSKLLGEPFKRNSDQVCPPLKECQTVTRSARNSVNQRCLTGPLQADDRGQQELQLGLPNAVLVPTEKPCNANLRGHYIGASRGDEMGPRPIFGARNDPHLPPAATRTGFRRATALAFRSSPGVVATWVATCPKNRELPLRGLQIKKTDS

SEQ ID NO: 1018393 - protein, 192 aa, Homo sapiens
SAPVARWRRPCWAPGLCVRSGRRRGPEGWRGDGVSPALGPSLRPLPPPIPSLLEMDLPVGPGAAGPSNVPAFLTKLWTLVSDPDTDALICWSPVRAAARARGLGGRRGSRAAADGAEGLRGGALPHFNLRAVSLPCPRQRRAAGPEPAQTQSLKLGKRLRDPHSVQPLPQRSFPVMGRMGRLLYWASANCWA

SEQ ID NO: 1018394 - protein, 73 aa, Homo sapiens
MACDSSRLEPAAAFTLARASAFISLVRNQSRGSSEAEPLISATLVSLSRKTSLNQLGYFRSSIVCGLSTRSGF

SEQ ID NO: 1018395 - protein, 1305 aa, Homo sapiens
LPVSADVISDGRGSRPSPAMASYAASPSHCLSVEGGPEADGEQPPRLATLGPGVMEGAAETDQEALCAGETGAQKPPGDRMLCPGRMDGAALGEQPTGQKGASARGFWGPRETKALGVCKESGSEPAEDSSRAHSRSEEGVWEENTPPLGPLGFPETSSSPADSTTSSCLQGLPDNPDTQGGVQGPEGPTPDASGSSAKDPPSLFDDEVSFSQLFPPGGRLTRKRNPRVYGKRCEKPVLPLPTQPSFEEGGDPTLGPARLPTDLSDSSSLCLCHEDPWEDEDPAGLPESFLLDGFLNSRVPGIDPWAPGLSLWALEPSREAGAEKLPSHCPEDDRPEAIPELHMVPAAWRGLEMPAPADDSSSSLGDVSPEPPSLERERCDGGLPGNTHLLPLRATDFEVLSTKFEMQDLCFLGPFEDPVGLPGPSFLDFEGTASSQGPQSRRTEEAAGAGRAQGRGRPAKGRRASYKCKVCFQRFRSLGELDLHKLAHTPAPPPTCYMCVERRFGSRELLRGHLQERHAQSKAGPWACGMCLKEVADVWMYNEHLREHAVRFARRGAGAEVLGGPARRPGGQQRCRPPSEQHHGTRAQTPQGQALRRQGRREPGRPVGARGRSQERQPGREGETPGTQHPQQPRRGRDPSSASATALADAGSPGPPRTTPSPSPDPWAGGEPLLQATPVHEACKDPSRDCHHCGKRFPKPFKLQRHLAVHSPQRVYLCPRCPRVYPEHGELLAHLGGAHGLLERPELQHTPLYACELCATVMRIIKKSFACSSCNYTFAKKEQFDRHMNKHLRGGRQPFAFRGVRRPGAPGQKARALEGTLPSKRRRVAMPGSAPGPGEDRPPPRGSSPILSEGSLPALLHLCSEVAPSTTKGWPETLERPVDPVTHPIRGCELPSNHQECPPPSLSPFPAALADGRGDCALDGALERPENEASPGSPGPLLQQALPLGASLPRPGARGQDAEGKRAPLVFSGKRRAPGARGRCAPDHFQEDHLLQKEKEVSSSHMVSEGGPRGAFHKGSATKPAGCQSSSKDRSAASTPSKALKFPVHPRKAVGSLAPGELARGTENGMKPATPKAKPGPSSQGSGSPRPGTKTGGGSQPQPASGQLQSETATTPAKPSFPSRSPAPERLPARAQAKSCTKGPREAGEQGPHGSLGPKEKGESSTKRKKGQVPGPARSESVGSFGRAPSAPDKPPRTPRKQATPSRVLPTKPKPNSQNKPRPPPSEQRKAEPGHTQRKDRLGKAFPQGRPLLRPPKRGTAVHGAEPAEPHTHRTAEAQSDLLSQLFGQRLTGFKIPLKKDASE

SEQ ID NO: 1018396 - protein, 79 aa, Homo sapiens
MVRSCRLDSLTVTFSSLKGFISGVHGLCTRQVRQRPEWELRGSGWLRLMDPSRSCAPGPVLSSRSVSMIYQKSVPMAAA

SEQ ID NO: 1018397 - protein, 79 aa, Homo sapiens; identical to SEQ ID NO: 1018396

SEQ ID NO: 1018398 - protein, 79 aa, Homo sapiens; identical to SEQ ID NO: 1018396

SEQ ID NO: 1018399 - protein, 121 aa, Homo sapiens
FLTLLSGTRNGPEFMTERSVRRERGDPGTDEALTAAISLASGAATGEDDADSEDEGSAHNGRERERGNVRVDLTCGDHAVDGNRLNGNGNEEGSKPAGGSRKPHVTEGSRDTEPASLEHES

SEQ ID NO: 1018400 - protein, 204 aa, Homo sapiens
MLVLLAGIFVVHIATVIMTFVSTIANVWLVSNTVDASVVFGKTVPTLAAVNSTVHMHSEDAPTRQCRPYMHYYYSYILTVYIALPGTYVLPDYLHHGEGKPVTYLLQGATTLVAGLLHYLLGGVHTNTSTLRIREWKRSIHHGLLPNILGLESDFCFQLSYGRYSLVGEKKIKGRDEFHGGSGGGGGGGPFEIWGGGSGRFAVT

SEQ ID NO: 1018401 - protein, 105 aa, Homo sapiens
RADAQAHSSPANGGGPPPPPQNVWPSHQAASQLGQGSRLRFSGVLRCSKAKEPPARLRLLRPPAEGVQRPECCPCGVGVAQEVYSPAGSRYDAALMVLQAGVCTT

SEQ ID NO: 1018402 - protein, 204 aa, Homo sapiens
PSRAKYAALGHWCRRILPHPRDGAVLENVSKELPFLPPPPGHTLEAWFLLRHCIRKGDPELRAHVIEFLLLPSNSGWTLTHGGLFYFQDADNFCPPPAGVAHEALVATQSSPDSFLMVPVPLGTLCFAPLFPSGSVPFPQFRHPEYREWFGYLSREGKVALSIKGGPFKGCFHVPRCLAMCEELLGALLRQPAPAPSPAPSPAC

SEQ ID NO: 1018403 - protein, 156 aa, Homo sapiens
RDVLLRKVFKIALVLACFEIASGLVLGKWLIALVFGVDYEQSYIVFVMFMLRPAVAIPSILLGYPFLGAMGNASAANRSVLFAGSVQLVTLGVLWIYGWTSALAVVVAVLIAEIRPSRGASGMHSPTSNSPHNSGSSMKEVKNVAVILAGGKGTRS

SEQ ID NO: 1018404 - protein, 133 aa, Homo sapiens
NNPTKQPLALNVANRRGLQILAAELFLPGSVGITDPCESGNFGQTVMTLGQQDMVCYTAQTLVPILSHGGFREILGQEGDAFLASEISTWDGVIVTPSKAYEKPPEKKEGEEEEENTEEPPQGEEEESMETQE

SEQ ID NO: 1018405 - protein, 91 aa, Homo sapiens
LVFPTIATIVGKLMFSSVTLIYKGQSWVDCVCCHKRSNLKFTSNSSKLRAHRKILYPTRRSKLTGCGSSLIHNESDELFGFHQLMHIVGDL

SEQ ID NO: 1018406 - protein, 99 aa, Homo sapiens
CGAALAPGPSWAPWSRSWPCSLCSARRVDVEGGAGSVLSASPCVGWDRPRGADLLACPPWPRRTPGPPAAKGSGMDPSPSSARDKVVVTGAVMFDSRAV

SEQ ID NO: 1018407 - protein, 156 aa, Homo sapiens
ARLRIVGELEQMVSEDVPLDHRVHARIIGALGKAIRKIMDEFKVDIRFPQIGAPDPHCVTVTGLPENVEEAIDHILNLEEEYLADVVDSEALQVYMKRPQHNEEANGHSARGFVVRYRTPGTASSSEKAPDMSSSEEFPSFGAQVAPKTLPWGPKR

SEQ ID NO: 1018408 - protein, 121 aa, Homo sapiens
ARLRIVGELEQMVSEDVPLDHRVHARIIGALGKAIRKIMDEFKVDIRFPQIGAPDPHCVTVTGLPENVEEAIDHILNLEEEYLADVVDSSSEKAPDMSSSEEFPSFGAQVAPKTLPWGPKR

SEQ ID NO: 1018409 - protein, 101 aa, Homo sapiens
HPRPPFPRGRPRRLLALPRCGDSCLAARAFLPEARKSPKVTRDPCVPGLAQRLLTYSFSSVLQEIPKRRGPGGERWAAVGRRKERARRPRNTIKRDSPAES

SEQ ID NO: 1018410 - protein, 182 aa, Homo sapiens
ASFWQPWENAWASHVNTPFGVERREIHCRRCGGHQGHVFDDGPAPTGLRYCMNGAAMTFTAAYSMSSYKGIPHVAFGSRVSGRRADDCQPVHLPVLPFVFARTGQPFLRSGLPLLLGMAMTFALVASLAAVGGGWVVQVNQYGRWLALLFVALFGLTLLLPSLSERLTRPLVAAGSHLSEAA

SEQ ID NO: 1018411 - protein, 108 aa, Homo sapiens
MSKHLYCQTEKAAEGEGEGLLGAASPVDEKVRVCDRIKFKESFAEMNRGSNEWKTVVGGAMFFIGFTALVSCGRSTMCTAPSAQSFDKEWVAKQTKRMLDMKVNPIQA

SEQ ID NO: 1018412 - protein, 111 aa, Homo sapiens
PSALCFLLHKCGFGELNAEEGAAEAFVPNVCPLCAPVYRIKFKESFAEMNRGSNEWKTVVGGAMFFIGFTALVSCGRSTMCTAPSAQSFDKEWVAKQTKRMLDMKVNPIQA

SEQ ID NO: 1018413 - protein, 126 aa, Homo sapiens
MDPHPRTREDNDLDSQVSQEGLGPVLQPQPKSYFKSISVTKITKPDGIVEERRTLVDSEGRTETTVTRHEADSSPRGDPESPRPPALDDAFSILDLFLGRWFRSPVALLTPQRHSSPFHLSPIAHH

SEQ ID NO: 1018414 - protein, 126 aa, Homo sapiens; identical to SEQ ID NO: 1018413

SEQ ID NO: 1018415 - protein, 79 aa, Homo sapiens
QAQHAASRRQSGSLSLESLQSRGRGRKEGGWRESRKPRRAPRPLAQSAGQQVVDPGQSIPGGKEKGAGVELGMIGSVLS

SEQ ID NO: 1018416 - protein, 212 aa, Homo sapiens
GFFFPNSLSLTGPWSLLALWGRRAFGGFEGERGRNDGEGRGGFKFHLETRGGLLKNGDFVVTAWGRGRIRVSKKTWSGGGVVARRVSLSVTVLTWSRRALTSRVVGESGCAWGFRRVVVVAWGAKEREFRVKNVNVAISVGRLGKGEKVFVRRGVGGEGGGVYESVRARRRASSCVARVEASRAERRFTVWRVGAGSRCNLPSLCLSLTPKQ

SEQ ID NO: 1018417 - protein, 212 aa, Homo sapiens; identical to SEQ ID NO: 1018416

SEQ ID NO: 1018418 - protein, 51 aa, Homo sapiens
GKEMGGPFSYVYFFCTVPEILHNIVLHGNFRTYIWPHPGSFEASVWGFHQV

SEQ ID NO: 1018419 - protein, 125 aa, Homo sapiens
TSRDSESSARGLGEQRRLTRHRSCTAMHLRPCGVTFTEVLWHRDSSLAGLSPPKHRSLQNAASRTSPGDLPCSCVSLETEAGQELITSTSEGSESDKISFGNRTCVLGNILNLGKHQLMEFLLTG

SEQ ID NO: 1018420 - protein, 285 aa, Homo sapiens
PGGHEALEMPFTSWCFSLWTLKQILDKSLQRKGLWAVPEAGWGQDNTAASPGCPLWGPAGGWQRASVSGAAGLAMRVHLQPFGFKDGDGFALPLCPRVGLVGLQLVWELPHGWRWRGFAPCWAPPDCSTECWGWGPAPGGLESSACLGEPLWRGIKTWAPASFSVAEILKSERNGPLLASLLSRGSFGRPPFGEREGRDHSRVCVCSTVGPQAFLLSSPSSSFPLSLSSFPRRTSTVCTYRGSSPNIYVYTHPYTYIVWFPLSFLFLSNKTMEIIPQQMSENVLL

SEQ ID NO: 1018421 - protein, 92 aa, Homo sapiens
VNPRARCSRTFITSSDDATFEEWFHQGRPPKVPVREVCPVTHRPALYRDPVTDIPYATARAFKIIREAYKKYITAHGLPPTASATGPRAFRF

SEQ ID NO: 1018422 - protein, 92 aa, Homo sapiens
VNPRARCSRTFITSSDDATFEEWFHQGRPPKVPVREVCPVTHRPALYRDPVTDIPYATARAFKIIREAYKKYITAHGLPPTASATGPRPATS

SEQ ID NO: 1018423 - protein, 132 aa, Homo sapiens
QDSWLLGDSSFFLRTWLMTPLHIPETPAEYRYNMAHSATHSVIEKTFRTLCSRFRCLDGSKGALQYSPEKSSHIILACCVLHNISLEHGMDVWSSPMTGPMEQPPEEEYEHMESLDLEADRIRQELMLTHFS

SEQ ID NO: 1018424 - protein, 86 aa, Homo sapiens
HDVLTAPPTSMFKRYPAVSLLSSWTSATQSTEQGPVGIHVATLHLNISSICVVLGTQVELSPPGKGNLDKIFEAFHTPPSPLPASL

SEQ ID NO: 1018425 - protein, 46 aa, Homo sapiens
MSKSLDLKVSRLPGNSSRRSDSDIRSSAAGGLETLSTFMREKNAHE

SEQ ID NO: 1018426 - protein, 69 aa, Homo sapiens
AKKPQPLRVGLHGYPGLRPSFSRRSRDHGRSSREQIKIKTGVVKRLVKEKVMYEKEAKQQEEKIETNES

SEQ ID NO: 1018427 - protein, 464 aa, Homo sapiens
MILANVFCLFFFLDETLRSLASPSSLQGPELHGWRPPVDCVRANELCAAESNCSSRYRTLRQCLAGRDRNTMLANKECQAALEVLQESPLYDCRCKRGMKKELQCLQIYWSIHLGLTEGEEFYEASPYEPVTSRLSDIFRLASIFSGTGADPVVSAKSNHCLDAAKACNLNDNCKKLRSSYISICNREISPTERCNRRKCHKALRQFFDRVPSEYTYRMLFCSCQDQACAERRRQTILPSCSYEDKEKPNCLDLRGVCRTDHLCRSRLADFHANCRASYQTVTSCPADNYQACLGSYAGMIGFDMTPNYVDSSPTGIVVSPWCSCRGSGNMEEECEKFLRDFTENPCLRNAIQAFGNGTDVNVSPKGPSFQATQAPRVEKTPSLPDDLSDSTSLGTSVITTCTSVQEQGLKANNSKELSMCFTELTTNIIPGSNKVIKPNSGPSRARPSAALTVLSVLMLKQAL

SEQ ID NO: 1018428 - protein, 176 aa, Homo sapiens
FHVYNRSDLYGRLQELFGLEPTIIPPKKDDDKTREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEEKK

SEQ ID NO: 1018429 - protein, 218 aa, Homo sapiens
RVRFQTATTTMQAADSRWFPRVFRGYAERKRRKRENDSASVIQRNFRKHLRMVGSRRVKAQSSDLQSSHCTLDEAFEDLDWDTEKGLEAVACDTEGFVPPKVMLISSKVPKAEYIPTIIRRDDPSIIPILYDHEHATFEDILEEIESKDEVTAISTPVEHGWKKNDRCGPETRRTPSAVPEGMLARRLPGGAPCGGGPVRRRPGPARPVARGCSAARH

SEQ ID NO: 1018430 - protein, 142 aa, Homo sapiens
KLAAAPSPGGQPVPPAPGWGQAAQLRTDRRDLPGATAGVHEATAGSGRLPGPLSQVIQAPGPRAGPCILPIVRDGKKVSSTHYYLLPERPSYLERYQRFLREAQSPEEPTALPVPLLLRPPASPFLFFSTVTVRPMPKAVLD

SEQ ID NO: 1018431 - protein, 150 aa, Homo sapiens
SLRPPPPLEDNLFLPPQGGGKPPSSAQTAEIFQALQQECMRQLQAPAGSPAPSPSPGGDDKPQVIQAPGPRAGPCILPIVRDGKKVSSTHYYLLPERPSYLERYQRFLREAQSPEEPTALPVPLLLRPPAPLYFFFSTVTVRPMPKAVLD

SEQ ID NO: 1018432 - protein, 132 aa, Homo sapiens
PFGQEAVIYPWSCQEKTKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRRIGKTSVKEECRNKEI

SEQ ID NO: 1018433 - protein, 136 aa, Homo sapiens
LLDKRRSSNHGHAKEKTKSNSKLKLVRSLAVCEESSTPFADGPLETQDIIQLHISCPSDKEEEKSTKDVSEKEDKDKNKEKIPRKMLSRDSSQEYTDSTGIDLHEFLVNTLKKNPRDRMMLLKLEQEILEFINDIK

SEQ ID NO: 1018434 - protein, 206 aa, Homo sapiens
MPVKGASSLLFLPLPPSAWQLCLLSKRRVHPIRTPLPFHSWIKALVISNQKVPERERPEGTGVLSDGCLGQSQEGEPLLSPPALAHFPLHARCCGSSWAWPGSAGEAIRMVSGAPFLCFLDGLDGLPCSSPMAALPAPMAALPARRQRQEHIEGGSQAVGSGVPLLAAGSLAQPPPAHFGFVQHKRQSDVFTAGCFPPGQVGQGEC

SEQ ID NO: 1018435 - protein, 206 aa, Homo sapiens; identical to SEQ ID NO: 1018434

SEQ ID NO: 1018436 - protein, 72 aa, Homo sapiens
RHTAADDRRRAGRGEVLIPRNAEQGQETRCPPGICPAPVASRKFSTKDVPQALCARLHQRPVRSFTLMGKPF

SEQ ID NO: 1018437 - protein, 206 aa, Homo sapiens; identical to SEQ ID NO: 1018434

SEQ ID NO: 1018438 - protein, 206 aa, Homo sapiens; identical to SEQ ID NO: 1018434

SEQ ID NO: 1018439 - protein, 141 aa, Homo sapiens
LNELLGTPPRRGGGRAEGLLTSPSMPGAVGAAGPGRGRRVKLSAWCLEHRFFASWMGWMGSRVLHQWQRYQHQWQRYQQEGKGRSTSRVGARAVGSGVPLLAAGSLAQPPPAHFGFVQHKRQSDVFTAGCFPPGQVGQGEC

SEQ ID NO: 1018440 - protein, 136 aa, Homo sapiens
SVSHEPVPVGSRAARFLPYPSKTQDEAHASLGVSFSLPAVHPLWTGPVSVPGGTRQSPINIQWRDSVYDPWLKPLRVSYDVASCLYIWNTGYLFQVEFDDATKASGECQLGLEDFLLSAPCSGSRVRGFAEKAEES

SEQ ID NO: 1018441 - protein, 176 aa, Homo sapiens
TCPPPCIVIHFLVCKPEEVEASINLNCLNKFPLVKALALNLFLTPSPAALCLEGLGREEGELEAAQEEYVKRALANSLPVKGKYTPSGQAGLLPASPSSSLTTPIKARGFPRVPPNTPGPAPFPLLEEEDILSRGFPGWPCRRSFFPRDNGCVVSSVNAKSITLSGTLPNKQLFKG

SEQ ID NO: 1018442 - protein, 85 aa, Homo sapiens
RIRRAIVRHRLGSTQAESGGAGMAETGASEYVRIPAGNTAIYAPGTKTRDYSYLGSDTVLHVGNELELVEDLWLTTGLAAIKSTW

SEQ ID NO: 1018443 - protein, 235 aa, Homo sapiens
EVDLDDPQVDLVLGDADYYISLTDSESDGYQHQSAGSGKGIAANFGYRFSPDLETRFYLRYRETTNDSPGRLTRDQISHDPRAANSLNAAHDSKRLQPGSTWIANKTTLRLDDNARVEVGLAYHDYPMDLREGTNRLKVAYTDISGTLNYIRQDSLFGHASTTTLGLRTTQAMPNNGASEYVRIPAGNTAIYAPGTKTRDYSYLGSDTVLHVGNELELVEDLWLTTGLAAIKSTW

SEQ ID NO: 1018444 - protein, 146 aa, Homo sapiens
LELPGSSVIRVPPNTKAFLGRSWAEPPGGQSLKRNCLGFRGRGRGNPTDMDPTLEDPTAPKCKMRRCSSCSPKPNTPKCAMCDGDSFPFACTGGEAEDRLREPETKKVLSSSLQHPGPVPALIMQLFQAHCFFLSTRPQPPTRPTM

SEQ ID NO: 1018445 - protein, 186 aa, Homo sapiens
MACRRCGGRSGREETRTGEEGTIYRIVVILFGVYLVCTLSRPPFYAPLVSPPRGPLLAFRGNGPPPPSDTRTVGFPPPKSAFNPPKIHIWAPGSQGGWKYQACPPPLEEKRKKNPDPFREKKQLMRLPETRPEKKRGEGKLTNNTRGPPDPRTPGLSPIKTGNSSSVACPSSHCCPGKYGTHGAAS

SEQ ID NO: 1018446 - protein, 186 aa, Homo sapiens; identical to SEQ ID NO: 1018445

SEQ ID NO: 1018447 - protein, 321 aa, Homo sapiens
MVAQALELSRKPHVVIATPGRLADHLRSSNTFSIKKIRFLVSSPRPCRPQELGSEPPGPMSEPGAPSHPFRKRMSVRLSSKTLGTVTGTVQGPTRGGPVLAMLFGGRALLDLGEGQASLGRRVLQGLGSMSMPLKEACFRGGQDPGPWTAPSPLPPLARQVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASR

SEQ ID NO: 1018448 - protein, 355 aa, Homo sapiens
MVAQALELSRKPHVVIATPGRLADHLRSSNTFSIKKIRFLVSSPRPCRPQELGSEPPGPMSEPGAPSHPFRKRMSVRLSSKTLGTVTGTVQGPTRGGPVLAMLFGGRALLDLGEGQASLGRRVLQGLGSMSMPLKEACFRGGQDPGPWTAPSPLPPLARQVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASGAWTSLRYRWSSTTTPPGSPRSTSTESAGRPVQQR

SEQ ID NO: 1018449 - protein, 376 aa, Homo sapiens
MVAQALELSRKPHVVIATPGRLADHLRSSNTFSIKKIRFLVSSPRPCRPQELGSEPPGPMSEPGAPSHPFRKRMSVRLSSKTLGTVTGTVQGPTRGGPVLAMLFGGRALLDLGEGQASLGRRVLQGLGSMSMPLKEACFRGGQDPGPWTAPSPLPPLARQVMDEADRLLEQGCTDFTVDLEAILAAVPARRQTLLFSATLTDTLRELQGLATNQPFFWEAQAPVSTVEQLDQRYLLVPEKVKDAYLVHLIQRFQDEHEDWSIIIFTNTCKTCQILCMMLRKFSFPTVALHSMMKQKERFAALAKFKSSIYRILIATDVASGAWTSLRYRWSSTTTPPGSPRSTSTESAGRPVQVSSGGGGRALGLCPSSLPSKFRW

SEQ ID NO: 1018450 - protein, 104 aa, Homo sapiens
MRRKKPPNQSREQTCETVFTSPWVHPLEVVMLDCIQKLIFNFPGNLQTVFPEWLYHFAFPDRSVKAPDAPRPHQPTVLSALIVLTILVGLQCISLCFNLHYLDN

SEQ ID NO: 1018451 - protein, 91 aa, Homo sapiens
QSESEELTIAGMTLITLMFGAERERQSRLKIYLPAFSGIVFMVDCADHSRLVEYKVELNALSTDEKYTNVQILILGNKIDRTDAISEEKNP

SEQ ID NO: 1018452 - protein, 129 aa, Homo sapiens
LFSSSSLTLPLTQIRTFQKCVHLGPCPGTHGFGVVATRLRAAVSSGMGQLRAWGPLACPWREHLQGGAPESREHCGELLRAELTRRQLINPPPMDRGAPSTGEDSALCPHARWVPVTLSCPAARGQQWV

SEQ ID NO: 1018453 - protein, 106 aa, Homo sapiens
MFGSWNGGKKSVCRVETVVAEAAAPGRQEKETWTQARMREDNVERQGEDGHLQAKERGLEHTLTSWPSEGGHPVNTLSSDFSLQSCEKRNFCCLSPSVWGNFLWWP

SEQ ID NO: 1018454 - protein, 145 aa, Homo sapiens
CPLTEGNLQIQAFSLFNKDVDGTITTKELGTVMRSLGQNPTEAELQDMINEVDADGNGTIDFPEFLTMMARKMKDTDSEEEIREAFRVFDKDGNGYISAAELRHVMTNLGEKLTDEEVDEMIREADIDGDGQVNYEEFVQMITAK

SEQ ID NO: 1018455 - protein, 247 aa, Homo sapiens
MADHLEGLSSDDEETSTDITNFNLEKDRISKESGKVFEDVLESFYSIDCIKSQFEAWRSKYYTSYKDAYIGLCLPKLFNPLIRLQLLTWTPLEAKCRDFENMLWFESLLFYGCEEREQEKDDVDVALLPTIVEKVILPKLTVILKLINGYPSVVNAENKNTQVYLKALLLRMRRTLDDDVFMPLYPKNVLENKNSGPYLFFQRQFWSSVKVIKPPFQRGSCPIPRRKECCSERPRRIWTDRPCVVFS

SEQ ID NO: 1018456 - protein, 564 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSVAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 1018457 - protein, 107 aa, Homo sapiens
MSILFVFFSETPSTEGHSDAESPPLSLKIASVPGRGDDLPSKASVKFRVQFVGVQQTPSPPHPNKNALISVEHLLSKASLSLGHWLLLDKPVTTVGWRWWDVSQAIH

SEQ ID NO: 1018458 - protein, 72 aa, Homo sapiens
VDDVMEPTLFATKRRGWRLYQVSRPANRKPAHPRVPTHSHHKPGGIKNAGHKVWGRCCVELGRLNPFTAIGQ

SEQ ID NO: 1018459 - protein, 71 aa, Homo sapiens
PGGNWAFQVLSRKKNPAGAFRCVTLFNAFRERRVPRLEPAPVLPPFLLFQEGFASEVRAQGLDVFLELGLR

SEQ ID NO: 1018460 - protein, 82 aa, Homo sapiens
MRLFLSLPVLVVVLSIVLEAQPQPRDPRRLQCLDKLKEFGNTLEDKARELISRIKQSELSAKMREWFSETFQKVKEKLKIDS

SEQ ID NO: 1018461 - protein, 1956 aa, Homo sapiens
MEFPIGSLETNNFRRFTPESLVEIEKQIAAKQGTKKAREKHREQKDQEEKPRPQLDLKACNQLPKFYGELPAELIGEPLEDLDPFYSTHRTFMVLNKGRTISRFSATRALWLFSPFNLIRRTAIKVSVHSWFSLFITVTILVNCVCMTRTDLPEKIEYVFTVIYTFEALIKILARGFCLNEFTYLRDPWNWLDFSVITLAYVGTAIDLRGISGLRTFRVLRALKTVSVIPGLKVIVGALIHSVKKLADVTILTIFCLSVFALVGLQLFKGNLKNKCVKNDMAVNETTNYSSHRKPDIYINKRGTSDPLLCGNGSDSGHCPDGYICLKTSDNPDFNYTSFDSFAWAFLSLFRLMTQDSWERLYQQTLRTSGKIYMIFFVLVIFLGSFYLVNLILAVVTMAYEEQNQATTDEIEAKEKKFQEALEMLRKEQEVLAALGIDTTSLHSHNGSPLTSKNASERRHRIKPRVSEGSTEDNKSPRSDPYNQRRMSFLGLASGKRRASHGSVFHFRSPGRDISLPEGVTDDGVFPGDHESHRGSLLLGGGAGQQGPLPRSPLPQPSNPDSRHGEDEHQPPPTSELAPGAVDVSAFDAGQKKTFLSAEYLDEPFRAQRAMSVVSIITSVLEELEESEQKCPPCLTSLSQKYLIWDCCPMWVKLKTILFGLVTDPFAELTITLCIVVNTIFMAMEHHGMSPTFEAMLQIGNIVFTIFFTAEMVFKIIAFDPYYYFQKKWNIFDCIIVTVSLLELGVAKKGSLSVLRSFRLLRVFKLAKSWPTLNTLIKIIGNSVGALGNLTIILAIIVFVFALVGKQLLGENYRNNRKNISAPHEDWPRWHMHDFFHSFLIVFRILCGEWIENMWACMEVGQKSICLILFLTVMVLGNLVVLNLFIALLLNSFSADNLTAPEDDGEVNNLQVALARIQVFGHRTKQALCSFFSRSCPFPQPKAEPELVVKLPLSSSKAENHIAANTARGSSGGLQAPRGPRDEHSDFIANPTVWVSVPIAEGESDLDDLEDDGGEDAQSFQQEVIPKGQQEQLQQVERCGDHLTPRSPGTGTSSEDLAPSLGETWKDESVPQAPAEGVDDTSSSEGSTVDCLDPEEILRKIPELADDLEEPDDCFTEGCIRHCPCCKLDTTKSPWDVGWQVRKTCYRIVEHSWFESFIIFMILLSSGSLAFEDYYLDQKPTVKALLEYTDRVFTFIFVFEMLLKWVAYGFKKYFTNAWCWLDFLIVNISLISLTAKILEYSEVAPIKALRTLRALRPLRALSRFEGMRVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIVVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 1018462 - protein, 700 aa, Homo sapiens
MGGSRSFSISHQVVVDALVGAIPSIMNVLLVCLIFWLIFSIMGVNLFAGKFWRCINYTDGEFSLVPLSIVNNKSDCKIQNSTGSFFWVNVKVNFDNVAMGYLALLQVATFKGWMDIMYAAVDSREVNMQPKWEDNVYMYLYFVIFIIFGGFFTLNLFVGVIIDNFNQQKKKLGGQDIFMTEEQKKYYNAMKKLGSKKPQKPIPRPLNKFQGFVFDIVTRQAFDITIMVLICLNMITMMVETDDQSEEKTKILGKINQFFVAVFTGECVMKMFALRQYYFTNGWNVFDFIVVVLSIASLIFSAILKSLQSYFSPTLFRVIRLARIGRILRLIRAAKGIRTLLFALMMSLPALFNIGLLLFLVMFIYSIFGMSSFPHVRWEAGIDDMFNFQTFANSMLCLFQITTSAGWDGLLSPILNTGPPYCDPNLPNSNGTRGDCGSPAVGIIFFTTYIIISFLIVVNMYIAVILENFNVATEESTEPLSEDDFDMFYETWEKFDPEATQFITFSALSDFADTLSGPLRIPKPNRNILIQMDLPLVPGDKIHCLDILFAFTKNVLGESGELDSLKANMEEKFMATNLSKSSYEPIATTLRWKQEDISATVIQKAYRSYVLHRSMALSNTPCVPRAEEEAASLPDEGFVAFTANENCVLPDKSETASATSFPPSYESVTRGLSDRVNMRTSSSIQNEDEATSMELIAPGP

SEQ ID NO: 1018463 - protein, 254 aa, Homo sapiens
MSPEKQHREEDEVDSVLLSASKILNSSEGVKESGCSDTEYGCIAESENQIQPQSALKVLQQQLESFQALRMQTLQNVSMPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFVTNLDDICHSIKQMKEELQKSHDGEVGTLQMNFQTLQTDPRWFPGTGKYDLFPYSPG

SEQ ID NO: 1018464 - protein, 291 aa, Homo sapiens
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFVTNLDDICHSIKQMKEELQKSHDGEVGTLQMNFQTLQTDPRWFPRNGKYDLFPYSPG

SEQ ID NO: 1018465 - protein, 307 aa, Homo sapiens
AEPRHATTRDRTAPDGSVTEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFVTNLDDICHSIKQMKEELQKSHDGEVGTLQMNFQTLQTDPRWFPRNGKYDLFPYSPG

SEQ ID NO: 1018466 - protein, 283 aa, Homo sapiens
MSPEKQHREEDEVDSVLLSASKILNSSEGVKESGCSDTEYGCIAESENQIQPQSALKVLQQQLESFQALRMQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFVTNLDDICHSIKQMKEELQKSHDGEVGLQTCNFTLTLAKLPGIGPHTMA

SEQ ID NO: 1018467 - protein, 221 aa, Homo sapiens
MQTLQNVSMVQSEISEILNKSIIEVENPQFSSEKNLVFGTRIEKDLPTENQEENLSMEKSHHFEDSKTLHSVEEKLSGDSVNSLPQSVNVPSQIHSEDTLTLRTSTDNLSSNIIIHPSENSDILKNYNNFYRFLPTAPPNVMSQADTVILDKSKITVPFLKHGFVTNLDDICHSIKQMKEELQKSHDGEVGTLQMNFQTLQTDPRWFPGTGKYDLFPYSPG

SEQ ID NO: 1018468 - protein, 397 aa, Homo sapiens
TQAEKKSTKTHSLLVGREDRNDMSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 1018469 - protein, 375 aa, Homo sapiens
MSTAGKVIKCKAAVLWEVKKPFSIEDVEVAPPKAYEVRIKMVAVGICHTDDHVVSGNLVTPLPVILGHEAAGIVESVGEGVTTVKPGDKVIPLFTPQCGKCRVCKNPESNYCLKNDLGNPRGTLQDGTRRFTCRGKPIHHFLGTSTFSQYTVVDENAVAKIDAASPLEKVCLIGCGFSTGYGSAVNVAKVTPGSTCAVFGLGGVGLSAVMGCKAAGAARIIAVDINKDKFAKAKELGATECINPQDYKKPIQEVLKEMTDGGVDFSFEVIGRLDTMMASLLCCHEACGTSVIVGVPPASQNLSINPMLLLTGRTWKGAVYGGFKSKEGIPKLVADFMAKKFSLDALITHVLPFEKINEGFDLLHSGKSIRTVLTF

SEQ ID NO: 1018470 - protein, 137 aa, Homo sapiens
KHTATHSRRNDRQLHEHLPARGDKRTVEGCVPYCAEWLLLLLCGLFSSGLRFLLQLSPGWRRCGAAAARKNSTGGNVSINQRRDSVRMSALNWKPFVYGGLASITAECGTFPSDVTATAPVYHHQDRHLPELEATIH

SEQ ID NO: 1018471 - protein, 323 aa, Homo sapiens
KHTATHSRRNDRQLHEHLPARGDKRTVEGCVPYCAEWLLLLLCGLFSSGLRFLLQLSPGWRRCGAAAARKNSTGGNVSINQRRDSVRMSALNWKPFVYGGLASITAECGTFPSDVTATAPSATIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFATYE

SEQ ID NO: 1018472 - protein, 293 aa, Homo sapiens
KHTATHSRRNDRQLHEHLPARGDKRTVEGCVPYCAEWLLLLLCGLFSSGLRFLLQLSPGWRRCGAAAARKNSTGGNVSINQRRDSVRMSALNWKPFVYGGLASITAECGTFPSDVTATAPSATIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQVLP

SEQ ID NO: 1018473 - protein, 133 aa, Homo sapiens
REQKRPRRNASGRKSRRAITAGGAQVGRAQGTWTNWTSETNTTLDPRKPDSTWTGLPPPHPTLEPLRAKQQSGAELWDLSGKLRVRCAGPWVKAAARLLAATLRPARGPVIFALLNSHSILCLTSVAFPVIVP

SEQ ID NO: 1018474 - protein, 133 aa, Homo sapiens; identical to SEQ ID NO: 1018473

SEQ ID NO: 1018475 - protein, 120 aa, Homo sapiens
VLCVVITSYGVIAEALLRLQLMQKCPLFLCLHKIFEKDLDHLEEQGYLGGFMQKFRYPFAPMYGGFPVKLRTYLGDPIPYDPQITAEELAEKTKNAVQALIDKHQRIPGNIMSALLERFH

SEQ ID NO: 1018476 - protein, 120 aa, Homo sapiens; identical to SEQ ID NO: 1018475

SEQ ID NO: 1018477 - protein, 120 aa, Homo sapiens; identical to SEQ ID NO: 1018475

SEQ ID NO: 1018478 - protein, 349 aa, Homo sapiens
MHRNFRKWIFYVFLCFGVLYVKLGALSSVVALGANIICNKIPGLAPRQRAICQSRPDAIIVIGEGAQMGINECQYQFRFGRWNCSALGEKTVFGQELRVGSREAAFTYAITAAGVAHAVTAACSQGNLSNCGCDREKQGYYNQAEGWKWGGCSADVRYGIDFSRRFVDAREIKKNARRLMNLHNNEAGRKVLEDRMQLECKCHGVSGSCTTKTCWTTLPKFREVGHLLKEKYNAAVQVEVVRASRLRQPTFLRIKQLRSYQKPMETDLVYIEKSPNYCEEDAATGSVGTQGRLCNRTSPGADGCDTMCCGRGYNTHQYTKVWQCNCKFHWCCFVKCNTCSERTEVFTCK

SEQ ID NO: 1018479 - protein, 1230 aa, Homo sapiens
MASASYHISNLLEKMTSSDKDFRFMATNDLMTELQKDSIKLDDDSERKVVKMILKLLEDKNGEVQNLAVKCLGPLVSKVKEYQVETIVDTLCTNMLSDKEQLRDISSIGLKTVIGELPPASSGSALAANVCKKITGRLTSAIAKQEDVSVQLEALDIMADMLSRQGGLLVNFHPSILTCLLPQLTSPRLAVRKRTIIALGHLVMSCGNIVFVDLIEHLLSELSKNDSMSTTRTYIQCIAAISRQAGHRIGEYLEKIIPLVVKFCNVDDDELREYCIQAFESFVRRCPKEVYPHVSTIINICLKYLTYDPNYNYDDEDEDENAMDADGGDDDDQGSDDEYSDDDDMSWKVRRAAAKCLDAVVSTRHEMLPEFYKTVSPALISRFKEREENVKADVFHAYLSLLKQTRPVQSWLCDPDAMEQGETPLTMLQSQVPNIVKALHKQMKEKSVKTRQCCFNMLTELVNVLPGALTQHIPVLVPGIIFSLNDKSSSSNLKIDALSCLYVILCNHSPQVFHPHVQALVPPVVACVGDPFYKITSEALLVTQQLVKVIRPLDQPSSFDATPYIKDLFTCTIKRLKAADIDQEVKERAISCMGQIICNLGDNLGPDLSNTLQIFLERLKNEITRLTTVKALTLIAGSPLKIDLRPVLGEGVPILASFLRKNQRALKLGTLSALDILIKNYSDSLTAAMIDAVLDELPPLISESDMHVSQMAISFLTTLAKVYPSSLSKISGSILNELIGLVRSPLLQGGALSAMLDFFQALVVTGTNNLGYMDLLRMLTGPVYSQSTALTHKQSYYSIAKCVAALTRACPKEGPAVVGQFIQDVKNSRSTDSIRLLALLSLGEVGHHIDLSGQLELKSVILEAFSSPSEEVKSAASYALGSISVGNLPEYLPFVLQEITSQPKRQYLLLHSLKEIISSASVVGLKPYVENIWALLLKHCECAEEGTRNVVAECLGKLTLIDPETLLPRLKGYLISGSSYARSSVVTAVKFTISDHPQPIDPLLKNCIGDFLKTLEDPDLNVRRVALVTFNSAAHNKPSLIRDLLDSVLPHLYNETKVRKELIREVEMGPFKHTVDDGLDIRKAAFECMYTLLDSCLDRLDIFEFLNHVEDGLKDHYDIKMLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 1018480 - protein, 605 aa, Homo sapiens
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPVIKGFTSAAAVTIGFGQIKNLLGLQNIPRPFFLQVYHTFLRIAETRVGDAVLGLVCMLLLLVLKLMRDHVPPVHPEMPPGVRLSRGLVWAATTARNALVVSFAALVAYSFEVTGYQPFILTGETAEGLPPVRIPPFSVTTANGTISFTEMVQDMGAGLAVVPLMGLLESIAVAKAFASQNNYRIDANQELLAIGLTNMLGSLVSSYPVTGSFGRTAVNAQSGVCTPAGGLVTGVLVLLSLDYLTSLFYYIPKSALAAVIIMAVAPLFDTKIFRTLWRVKRLDLLPLCVTFLLCFWEVQYGILAGALVSLLMLLHSAARPETKVSEGPVLVLQPARLSFPAMEALREEILSRALEVSPPRCLVLECTHVCSIDYTVVLGLGELLQDFQKQGVALAFVGLQVPVLRVLLSADLKGFQYFSTLEEAEKHLRQEPGTQPYNIREDSILDQKVALLKA

SEQ ID NO: 1018481 - protein, 554 aa, Homo sapiens
RLSPAIPADPAVATPGDPKLHRRVGPTVEMPSSVTALGQARSSGPGMAPSACCCSPAALQRRLPILAWLPSYSLQWLKMDFVAGLSVGLTAIPQALAYAEVAGLPPQASPLLLPSPSALDRSRTCWDYRTSPGRSSCRCTTPSSGLQRPECRVRTVARWGRLLPWDVCPSNLEAAALPHTRREQGLGRTSPSLLARNALVVSFAALVAYSFEVTGYQPFILTGETAEGLPPVRIPPFSVTTANGTISFTEMVQDMGAGLAVVPLMGLLESIAVAKAFASQNNYRIDANQELLAIGLTNMLGSLVSSYPVTGSFGRTAVNAQSGVCTPAGGLVTGVLVLLSLDYLTSLFYYIPKSALAAVIIMAVAPLFDTKIFRTLWRVKRLDLLPLCVTFLLCFWEVQYGILAGALVSLLMLLHSAARPETKVSEGPVLVLQPARLSFPAMEALREEILSRALEVSPPRCLVLECTHVCSIDYTVVLGLGELLQDFQKQGVALAFVGLQVPVLRVLLSADLKGFQYFSTLEEAEKHLRQEPGTQPYNIREDSILDQKVALLKA

SEQ ID NO: 1018482 - protein, 339 aa, Homo sapiens
MPSSVTALGQARSSGPGMAPSACCCSPAALQRRLPILAWLPSYSLQWLKMDFVAGLSVGLTAIPQALAYAEVAGLPPQYGLYSAFMGCFVYFFLGTSRDVTLGPTAIMSLLVSFYTFHEPAYAVLLAFLSGCIQLAMGVLRLGFLLDFISYPVIKGFTSAAAVTIGFGQIKNLLGLQNIPRPFFLQVYHTFLRIAETRVGDAVLGLVCMLLLLVLKLMRDHVPPVHPEMPPGVRLSRGLVWAATTARNALVVSFAALVAYSFEVTGYQPFILTGETAEGLPPVRIPPFSVTTANGTISFTEMVQVGGAGRQDGVAEAAVAPGLAPTLMYLLGARGSEVS

SEQ ID NO: 1018483 - protein, 151 aa, Homo sapiens [sequence omitted]

SEQ ID NO: 1018484 - protein, 605 aa, Homo sapiens; identical to SEQ ID NO: 1018480

SEQ ID NO: 1018485 - protein, 261 aa, Homo sapiens
MSSEPPPPYPGGPTAPLLEEKSGAPPTPGRSSPAVMQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQQAITTKISYEIGLMNFVLGFFCCFMGCDLGCCLIPCLINDFKDVTHTCPSCKATSTRTSACANGAGTRDSPACQSGPLCFAPCAQWSLSRSHLGLGAVPPSPRSPVLFTLPYLSR

SEQ ID NO: 1018486 - protein, 153 aa, Homo sapiens
IRGRVDLDPLYVTGVGDQDIAPAQAHEHQAVHRQRQHVIQRQQGDVGFLLVLIQLIARPRPWLHQVGEDITVGEHRPLASPVVPPVYCRKAMSSWASLTFLTRSVAPCFIIRGKRIAPGRMETRHLFLDMPQHKVQGRALERPHQVADGVDAA

SEQ ID NO: 1018487 - protein, 164 aa, Homo sapiens
MALWLGDPVDFYLAQQRGSDGWLNTHPLLYHVISVHIFPMSLRCLDLSPGHHHQCCSFPMWFCFGGVTAWLLEAAGISGEASSLGPHSVPRVFKDGSGSHSSPDAHGHHSVCPLPTALQLIEQRDVPVVQCSSVGALWLHPPGGSPSGVVASPHSRQPGLQRPH

SEQ ID NO: 1018488 - protein, 93 aa, Homo sapiens
ARAGVSPPVPLAARCVAARWLFRTEARLVFLQKFPPWAVVEVVTVIVAAPAAATATTRDGGGCSRNCNIPEVFPELLGCPNRRGPPGGVRGAD

SEQ ID NO: 1018489 - protein, 333 aa, Homo sapiens; identical to SEQ ID NO: 916514

SEQ ID NO: 1018490 - protein, 365 aa, Homo sapiens; identical to SEQ ID NO: 916524

SEQ ID NO: 1018491 - protein, 122 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDSADANFSVWIKRS

SEQ ID NO: 1018492 - protein, 93 aa, Homo sapiens; identical to SEQ ID NO: 1018488

SEQ ID NO: 1018493 - protein, 303 aa, Homo sapiens
MAAAAAGTATSQRFFQSFSDALIDEDPQAALEELTKALEQKPDDAQYYCQRAYCHILLGNYCVAVADAKKSLELNPNNSTAMLRKGICEYHEKNYAAALETFTEGQKLDSADANFSVWIKRCQEAQNGSESEVWTHQSKIKYDWYQTESQVVITLMIKNVQKNDVNVEFSEKELSALVKLPSGEDYNLKLELLHPIIPEQSTFKVLSTKIEIKLKKPEAVRWEKLEGQGDVPTPKQFVADVKNLYPSSSPYTRNWDKLVGEIKEEEKKNRGYKGGRKKRYGKGLGPSCFRTQFLCPGGKSAGS

SEQ ID NO: 1018494 - protein, 333 aa, Homo sapiens; identical to SEQ ID NO: 916514

SEQ ID NO: 1018495 - protein, 390 aa, Homo sapiens
MAAQKDLWDAIVIGAGIQGCFTAYHLAKHRKRILLLEQFFLPHSRGSSHGQSRIIRKAYLEDFYTRMMHECYQIWAQLEHEAGTQLHRQTGLLLLGMKENQELKTIQANLSRQRVEHQCLSSEELKQRFPNIRLPRGEVGLLDNSGGVIYAYKALRALQDAIRQLGGIVRDGEKVVEINPGLLVTVKTTSRSYQAKSLVITAGPWTNQLLRPLGIEMPLQTLRINVCYWREMVPGSYGVSQAFPCFLWLGLCPHHIYGLPTGEYPGLMKVSYHHGNHADPEERDCPTARTDIGDVQILSSFVRDHLPDLKPEPAVIESCMYTNTPDEQFILDRHPKYDNIVIGAGFSGHGFKLAPVVGKILYELSMKLTPSYDLAPFRISRFPSLAKAHL

SEQ ID NO: 1018496 - protein, 317 aa, Homo sapiens
MKSVLTWKHRKEHAIPHVVLGRNLPGGAWHSIEGSMVILSQGQWMGLPDLEVKDWMQKKRRGLRNSRATAGDIAHYYRDYVVKKGLGHNFVSGAVVTAVEWGTPDPSSCGAQDSSPLFQVSGFLTRNQAQQPFSLWARNVVLATGTFDSPARLGIPGEALPFIHHELSALEAATRVGAVTPASDPVLIIGAGLSAADAVLYARHYNIPVIHAFRRAVDDPGLVFNQLPKMLYPEYHKVHQMMREQSILSPSPYEGYRSLPRHQLLCFKEDCQAVFQDLEGVEKVFGVSLVLVLIGSHPDLSFLPGAGLTLQWILTSR

SEQ ID NO: 1018497 - protein, 219 aa, Homo sapiens
RPPRAIYTKIKRATCGFLPLFLYLAPPRCGSGLVETSPYNTGVVSSFNPLAFDTFVVGLVPKGVCYPVYWTILFLFRMSRSKVVGTQSPTTAGQQVVDFNSCLDYSVLDSSFLTLFEAPTLRGGLYWGPCPLAQFELKTPVPFSAGLLCWTDKRDLFLDISRGDLEEPWKLSKKGAAQKQGQGPGWGGPEIQFINTLADIVIVGLTLVEALGYLSLLCF

SEQ ID NO: 1018498 - protein, 174 aa, Homo sapiens
RPPRAIYTKIKRATCGFLPLFLYLAPPRCGSGLVETSPYNTGVVSSFNPLAFDTFVVGLVPKGVCYPVYWTILFLFRMSRSKVVGTQSPTTAGQQVVDFNSCLDYSVLDSSFLTLFEAPTLRPLLDRLRVTCFVDISRGDLEEPWKLSKKGAAQKQGQGPGWGGPEIQFINTLG

SEQ ID NO: 1018499 - protein, 136 aa, Homo sapiens
INKGGGIKGWAKRQAGAGDAAGQAGSAVAFVATVAVAVTGSFWKWRRGGPPHRVFTCYFYTGWVDERDPTQAKCRCDRSPRTRRSSPAKPAAAVWPRTRPEKLHLRPEPAGPPSQVGPWAPPRKRGSVHLPWHQGV

SEQ ID NO: 1018500 - protein, 154 aa, Homo sapiens
MSEPDVRIRTKRAQELRLADPEKRGLDRSAAGEGSGARPPRQAGATAADGANKPPPEAEPSAVAMAAGRGREREARAARGTRGRRQRASRARGTWAERGAIPHIRPPITAAVFWRQRFPPPANPERRHAGIRGVNCPPAGRGGKGPSRWGRGHG

SEQ ID NO: 1018501 - protein, 332 aa, Homo sapiens
MLVVYCRYSSWCSPRTGMIYYDAALCMPPFGSAWKGPPMPVLGLQVSGPGCCAEGMPLVPPSIGHPGDSHESSPKVPWTPWRLSWVRPRRLVRCVQCNDVVPPKDSRRGTMVNLNYSTRGLRVPSSPNGGPPSDVKYSYSKPTAHARRHCTSRYADCGFGSWPSSCNQFGKQEPGSNEEIKESPAGYNVKFDMFSKICVNGDDAHPLWKWMKIQPKGKGILGNAIKWNFTKFLIDKNGCVVKRYGPMEEPLVIEKDLHPLVFSSQKFVATARAPAKAFGAFHRHLMAAFLENLLVGQTQKSSVHPAGGSSHGLLGFARPPHPWLPCGNKQTN

SEQ ID NO: 1018502 - protein, 156 aa, Homo sapiens
MLTGLALVNERNHQWKGYQGAFSKERDSKLQDEQLNAIQVWMRKNSRETEFQEWKHSKHHLPLSSPAAEEEGKNTDLLRTCGANHWLQKSKQGLPSAQQEAVSLVGGLTEETNVSTDNGQEPEALEPRGNPKKLIQVREPRIMQFHMATSKQESVK

SEQ ID NO: 1018503 - protein, 137 aa, Homo sapiens
MPSTESGAAHTNLHPPTYNRHPSDYNDTTPTTHAHPQPSVLHSSGPRSISLTTPCSLNTKRPPRRNTPKNALTSAHTALAYNIHARPITADTHQTQHHTPPPSTTHETGPPVYATSHRPHLRPATSSHTRITTMSQR

SEQ ID NO: 1018504 - protein, 105 aa, Homo sapiens
SLPRAVTSGPLLSLGCVPKTQGPWKVHLSVSHGSFFTQQEQRYREWRPGLLKDSQSMRQEAPQGSSGPPPPISSHTALCTFCSFFCKPKTALNNEVRHAETAHGC

SEQ ID NO: 1018505 - protein, 664 aa, Homo sapiens
FAVRSGGATGVVVKGPDDRNPISFRMDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLLPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVDFFLYGVFKHYRQKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGATAPLVQDNPYITPIRLSTTDSSNSSSDMYTIITTIGQGAAISHFRIGLGQKGPMSAIKFDEPSLSGRITVFGRHVWVDIEFRRHCVWVIIALGTLWKDEKM

SEQ ID NO: 1018506 - protein, 608 aa, Homo sapiens
MDDKGEVKCIKFSLENKILAVQRTSKTVDFCNFIPDNSQLEYTQECKTKNANILGFCWTSSTEIVFITDQGIEFYQVLPEKRSLKLLKSHNLNVNWYMYCPESAVILLSTTVLENVLLPFHFRAGTMSKLPKFEIELPAAPKSTKPSLSERDIAMATIYGQLYVLFLRHHSRTSNSTGAEVVLYHLPREGACKKMHILKLNRTGKFALNVVDNLVVVHHQDTETSVIFDIKLRGEFDGSVTFHHPVLPARSIQPYQIPITGPAAVTSQSPVPCKLYSSSWIFQPDIIISASQGYLWNLQVKLEPIVNLLPDKGRLMDFLLQRKECKMVILSVCSQMLSESDRASLPVIATVFDKLNHEYKKYLDAEQSYAMAVEAGQSRSSPLLKRPVRTQAVLDQSDVYTHVLSAFVDFFLYGVFKHYRQKKEMPHKFVIAVLMEYIRSLNQFQIAVQHYLHELVIKTLVQHNLFYMLHQFLQYHVLSDSKPLACLLLSLESFYPPAHQLSLDMLKRLSTANDEIVEVLLSKHQVLAALRFIRGIGGHDNISARKFLDAAKQTEDNMLFYTIFRFFEQRNQRLRGSPNFTPGEHCEEHVAFFKQIFGDQALMRPTTF

SEQ ID NO: 1018507 - protein, 252 aa, Homo sapiens
MMFALLKVYCTYIPHALQLQRGPDYQLEINLRIQEIDLHYNISIVAILKTNRTSLLVCPGIEGRVAIHYINPPNPAKDNFTFKCHRSNGTNTSAPQDIYAVNGIRSILFMAPLQLWDLMVDSASGTKMPEQNQKLRNSQTSPPQLAVSITMTSHTLPATTQRNKLTNPITLPCPTHPKSKSPGKRSSGPPPTPPPLCLISVRIWVPALLGCHPWTWISTPGENDVIVQQLRPQASAGDLPFLHSTACCRVFL

SEQ ID NO: 1018508 - protein, 102 aa, Homo sapiens
MRMFSPSALYPFSFCPRQQGSPNGAEQRGSDRLWGWSRTGTGGNGHLSVRRLCCFPYHRNKQCSASLCRPAQPPGVEGGVSFVRVGVALCILSQWSKNMFIP

SEQ ID NO: 1018509 - protein, 126 aa, Homo sapiens
PWALFLREALGQEREGPQSQSEEVNTLLLFLPKTLESVDVHCFGHLLYEMTYGRPPDSVPVDSFPPAPSMAVGQYGVGKGLLGPSSVQSHSSPFSESRKDPEEVAVLHSPEFLQNLKVDPDHLDEY

SEQ ID NO: 1018510 - protein, 461 aa, Homo sapiens
RYSDFDLLNNSLQIAGLKSTSSSQKIDGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSVEHAPF

SEQ ID NO: 1018511 - protein, 468 aa, Homo sapiens
RYSDFDLLNNSLQIAGLKSTSSSQKIDGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNQGYLHYLHLLHLHHHQQLPCLLRAPRHLPSSRLRL

SEQ ID NO: 1018512 - protein, 203 aa, Homo sapiens
ASRVQVILLPQPPEYWNYRLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 1018513 - protein, 456 aa, Homo sapiens
RYSDFDLLNNSLQIAGLKSTSSSQKIDGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSG

SEQ ID NO: 1018514 - protein, 461 aa, Homo sapiens; identical to SEQ ID NO: 1018510

SEQ ID NO: 1018515 - protein, 461 aa, Homo sapiens; identical to SEQ ID NO: 1018510

SEQ ID NO: 1018516 - protein, 104 aa, Homo sapiens
MRKDSSFAYSSTWHPDPSQEVDLSKERFSFIPIKCGLAKHVGEDFHGSCLMWDMLTSYGLLKIHQHRRLTRAQSHHGSEEERKKRKILARKVSLLSLCSPSMSS

SEQ ID NO: 1018517 - protein, 524 aa, Homo sapiens
RYSDFDLLNNSLQIAGLKSTSSSQKIDGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 1018518 - protein, 506 aa, Homo sapiens
RYSDFDLLNNSLQIAGLKSTSSSQKIDGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDSLPASQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 1018519 - protein, 524 aa, Homo sapiens; identical to SEQ ID NO: 1018517

SEQ ID NO: 1018520 - protein, 456 aa, Homo sapiens; identical to SEQ ID NO: 1018513

SEQ ID NO: 1018521 - protein, 424 aa, Homo sapiens
RYSDFDLLNNSLQIAGLKSTSSSQKIDGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKVSLLSLCSPSMSS

SEQ ID NO: 1018522 - protein, 108 aa, Homo sapiens
MCRARAGEGSERRTQGAGRRAERGCPFPGDKSGKPGWTASAPRASWTQGSLLDSGFPVLSSGDVQSHTAARSATQRSNLPPASLVPETTDILRFLTVAPFYPAQCAAA

SEQ ID NO: 1018523 - protein, 231 aa, Homo sapiens
MHPCGEFPGPSSGRGSAGWEGAAKKPELAAYSEIRGPPSLYSRVQLELAPPRSEPGRSLGVWCLCSDGGLWGSFLPALTSLFVPGLGLGQPWGIRRGHLGPAVYSEGGQPPPLHSASTKSAPESSRLLLFICAGPGPVKGQRDGHKEPAGGRSEDVLSRETSRESLAGLPQPRAPPGLRVVLSSGDVQSHTAARSATQRSNLPPASLVPETTDILRFLTVAPFYPAQCAAA

SEQ ID NO: 1018524 - protein, 157 aa, Homo sapiens
PPIFSDIPMRQWLVVLQISPVILWMRPQVPVPEPHARRNEPEVSAGNRVELRARAGEGSERRTQGAGRRAERGCPFPGDKSGKPGWTASAPRASWTQGSLLDSGFPVLSSGDVQSHTAARSATQRSNLPPASLVPETTDILRFLTVAPFYPAQCAAA

SEQ ID NO: 1018525 - protein, 110 aa, Homo sapiens
MNVLLGSVVILATFVTLCNASCYFIPNEGVPGDSTRKCMDLKGNKHPINSEWQTDNCETCTVLRNRNFMLHPVFLHLWVMTKTMPKNLQEGGLQVYRGGEEGPKKDLFCQ

SEQ ID NO: 1018526 - protein, 108 aa, Homo sapiens
MPVFCSPQVRTFPKRGQTCVVHYTGMLEDGKKFDSSRDRNKPFKFMLRQAGSVTPTAGEEGVAPELQVWGQTSQTDYISTIMPMVPLGTQASFPPHVALSSSMCGAFY

SEQ ID NO: 1018527 - protein, 95 aa, Homo sapiens
VEPPPGRCWSTPPVAPPARSASAAAMGVQVETISPGDGRTFPKRGQTCVVHYTGMLERWKGNLIPPGTETSPLSLCYGKQECDSDVLEKKGLPQN

SEQ ID NO: 1018528 - protein, 139 aa, Homo sapiens
STAYAPQANSKQAILGEQRRGEDVKTSKNWVVGKNNHNSITRNTAKLGREDRGSCNHDKGDPWRWGKVIQQGRQSKGLTQKELGTKINEKPQVIADYESGRAIPKEGAWHNPSGAFGLKLRGKGHLESPSRKGATGGNE

SEQ ID NO: 1018529 - protein, 108 aa, Homo sapiens
PGLFKELEGKKIRSQFMQGTVSQGRRQSCSPSSTAGLTQEALHLHVPHIAEGRAEDEREERAEPRASFSPTVPLLCVALDTRNHPRTVGLLEKIIAHEGSKSKACYIL

SEQ ID NO: 1018530 - protein, 121 aa, Homo sapiens
PTAKAAPHPDANTQEGLQNLLQGVGACGNRELPADSHLAPGSCFIEWAFVATRNRKPGKEDLRFRKRRPGLQATATGSGEHGAFPVNSQGVWASTHWQGTAVCPLQTPPPDAFIRNNKVLS

SEQ ID NO: 1018531 - protein, 195 aa, Homo sapiens
DERRQLTMVPYPIPGRLPYLHVTLIPSAHFSTGMDYAQCLQPAVGSGTVGVPLLLQSLERQRSSATCVVPAPRVGRDGESDEPGVVGSNSKRRRVVLGSSPAPSSPGFTRTPRLLDGTAMNARGLPSDLGNERKKGLRLALPPPNFARELRRLRAAGKLLPRAPPGSRRPRQPGEQSRAGPGSRMQPRAPELCGG

SEQ ID NO: 1018532 - protein, 503 aa, Homo sapiens
MGGKELWSWPWLHLTLCPGGPRRPVLGTCVHFVGNTSMSWNASVSTAISSTGAASAAIPVRPHCGQVATSSTQEMDISTASSTCPRQTTKRKAAIEALRVRYKTEGVYVYWGMGRGRGSRQTSALLGVTECRLLQHVSSVKAGMPVCLHFLFSQVSKTQPDTVCKWFEVNECQGSPLLRRGGLTPRPHSTLGRSLTRTTWWLFQELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 1018533 - protein, 134 aa, Homo sapiens
MPPARVCPDCWPPSLVGEPHLFFSASCFLQEPRGPPDLSERSGFHRAPVPPSGAIVPLLPVEDALGVPFPTLPEWTLSVGALRGWLGQPAEKRHPLPPRAVHFGFIIHMAGSRRPDSSRSLYQPFPETQQIFHL

SEQ ID NO: 1018534 - protein, 73 aa, Homo sapiens
GTRNAEYTEQHQKKTLLRQAECFRGYGNLEARRTIGQKKPGYLNNLVEHRHLRGLDCQLTMGLSVREGNFPLV

SEQ ID NO: 1018535 - protein, 84 aa, Homo sapiens
FFRFLYLHVELLIAQRRGLGIRIRWLYAGGWSRGSAARLIAVVGSDGEIASRLESLSIVFHCRSYTPDMKTTSTLKRSFHLFSI

SEQ ID NO: 1018536 - protein, 56 aa, Homo sapiens [sequence omitted]

SEQ ID NO: 1018537 - protein, 112 aa, Homo sapiens
PRQTFFKSLKHNSSGGQSGNAVPKSISYRNALRKKLHSSSSVPNFLKFLAPVDENNTSDFMNTKRDFESKANHLGDSGGTPVKTRRHSWRQQIFLRVATPQKACDSSSSYEV

SEQ ID NO: 1018538 - protein, 133 aa, Homo sapiens
PRQTFFKSLKHNSSGGQSGNAVPKSISYRNALRKKLHSSSSVPNFLKFLAPVDENNTSDFMNTKRDFESKANHLGDSGGTPVKTRRHSWRQQIFLRVATPQKACDSSSSYEDYSELGELPPRSPLEPVCEDGP

SEQ ID NO: 1018539 - protein, 79 aa, Homo sapiens
NPGGTARVGHSSIVHGDPSPIKPDSSACLGPRFGPDTGSQQSTTGTIFPDLSVPFYMRTFIPLKLSSNTLTFVLILKIV

SEQ ID NO: 1018540 - protein, 71 aa, Homo sapiens
RPGVQEMGFNTRERDVFLDYEVRPQGKGCASALEVTSPEKTQKLWERLPQDKGTDESSWSHGKESYKLGPN

SEQ ID NO: 1018541 - protein, 115 aa, Homo sapiens
ELHTSCFFSGPMLLPRAVDFRGDDPGLPWAGLEELYPSMQSSLALPLLGRLREVKGVIQCHTALGSAVPGSLEGMCHDPFSLGSGGPSQALPGLRTQGTFPGVRLLMPLSHRERL

SEQ ID NO: 1018542 - protein, 115 aa, Homo sapiens
AAPYNLEAGQGDYAAPAAYDYFPAAPPPHRYPYLVTGITSPHPRVYKIQSRTVHRQLATSIVVEEACPLFQGLGAWRIATTFLGIFLAIILLPLGVFCCFALRKRRCPNCGATFA

SEQ ID NO: 1018543 - protein, 502 aa, Homo sapiens
GLIYFYSYIIDLLSGTGFLEETSLFYGHYTIDEVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 1018544 - protein, 179 aa, Homo sapiens [sequence omitted]

SEQ ID NO: 1018545 - protein, 217 aa, Homo sapiens
MSCAGAAAAPRLWRLRPGARRSLSAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 1018546 - protein, 217 aa, Homo sapiens; identical to SEQ ID NO: 1018545

SEQ ID NO: 1018547 - protein, 217 aa, Homo sapiens; identical to SEQ ID NO: 1018545

SEQ ID NO: 1018548 - protein, 217 aa, Homo sapiens; identical to SEQ ID NO: 1018545

SEQ ID NO: 1018549 - protein, 217 aa, Homo sapiens; identical to SEQ ID NO: 1018545

SEQ ID NO: 1018550 - protein, 217 aa, Homo sapiens; identical to SEQ ID NO: 1018545

SEQ ID NO: 1018551 - protein, 179 aa, Homo sapiens [sequence omitted]

SEQ ID NO: 1018552 - protein, 179 aa, Homo sapiens [sequence omitted]

SEQ ID NO: 1018553 - protein, 179 aa, Homo sapiens [sequence omitted]

SEQ ID NO: 1018554 - protein, 179 aa, Homo sapiens [sequence omitted]

SEQ ID NO: 1018555 - protein, 179 aa, Homo sapiens [sequence omitted]

SEQ ID NO: 1018556 - protein, 615 aa, Homo sapiens
GLIYFYSYIIDLLSGTGFLEETSLFYGHYTIDEVKFQNFTYDLPLAYLLSTIASLALSLLWIVKRSVEGFKINLIRSEEHFQSYCNKIFAGWDFCITNRSMADLKHSSLRYELRADLEEERMRQKIAERTSEETIRIYSLRLFLNCIVLAVLGACFYAIYVATVFSQEHMKKEIDKMVFGENLFILYLPSIVITLANFITPMIFAKIIRYEDYSPGFEIRLTILRCVFMRLATICVLVFTLGSKITSCDDDTCDLCGYNQKLYPVSCGAVAFGCMGPSGIQCMVKRTVVEAMGLNCICFVSCSSDETESGPMESNPRHFMRALKLKVCAEAQSLNQLMPSLEPQDLELERELKVSREPGFLCLSWGLSVSLTLFDFQCWETQVGQEMYKLMIFDFIIILAVTLFVDFPRKLLVTYCSSCKLIQCWGQQEFAIPDNVLGIVYGQTICWIGAFFSPLLPAIATLKFIIIFYVKEWSLLYTCRPSPRPFRASNSNFFFLLVLLIGLCLAIIPLTISISRIPSSKACGPFTNFNTTWEVIPKTVSTFPSSLQSFIHGVTSEAFAVPFFMIICLIMFYFIALAGAHKRVVIQLREQLSLESRDKCYLIQKLTEAQRDMRN

SEQ ID NO: 1018557 - protein, 615 aa, Homo sapiens; identical to SEQ ID NO: 1018556

SEQ ID NO: 1018558 - protein, 615 aa, Homo sapiens; identical to SEQ ID NO: 1018556

SEQ ID NO: 1018559 - protein, 101 aa, Homo sapiens
HGGESVVEEADSNCLNTLGTTCKITTVVNECFSEGINTNMRFLRVFHQFVFGSGGGINQERKEEGKFQAEEITCAKALLSMKEARAAPANLGVQRVTMSMV

SEQ ID NO: 1018560 - protein, 136 aa, Homo sapiens
FFERVSLSVDRLEHSSTTSGHCNLHLLGSRDSPASAFQAAGTTGACTTPSQPLHLQQRQGFTIAGQAGLGLFDPVIHPPWPPKVLGLQARRLCPAPAQVFQYSLDLGIQYPHSMVLINFLALFPFSCSLSLQLVFL

SEQ ID NO: 1018561 - protein, 325 aa, Homo sapiens
MELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 1018562 - protein, 364 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 1018563 - protein, 320 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGYLLPRAARTRNLSGPACKSWKKTRIY

SEQ ID NO: 1018564 - protein, 364 aa, Homo sapiens; identical to SEQ ID NO: 1018562

SEQ ID NO: 1018565 - protein, 178 aa, Homo sapiens
MANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 1018566 - protein, 364 aa, Homo sapiens; identical to SEQ ID NO: 1018562

SEQ ID NO: 1018567 - protein, 398 aa, Homo sapiens
MIPEPKRHTTVITHFTYSMHVLRHEYTAIPTQGTMTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPPGFHRAYSSPLYSNQQYACVKDLSAANRNDPVFETLRTGVIMANKERKKGQADKKNPVAAMMEEEPESARPEEGKPQDGNPEGDKKAEKKTPDDKHKQPGFQQSHYFVALYRFKALEKDDLDFPPGEKITVIDDSNEEWWRGKIGEKVGFFPPNFIIRVRAGERVHRVTRSFVGNREIGQITLKKDQIVVQKGDEAGGYVKVYTGRKVGLFPTDFLEEI

SEQ ID NO: 1018568 - protein, 178 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPHKFKDHFFKKPKFCDVCARMIVLNNKFGLRCKNCKTNIHEHCQSYVEMQRCFGKIPSPAWGLGYLLPRAARTRNLSGPACKSWKKTRIY

SEQ ID NO: 1018569 - protein, 102 aa, Homo sapiens
MTEKEVLESPKPSFPAETRQSGLQRLKQLLRKGSTGTKEMELPPEPQANGEAVGAGGGPIYYIYEEEEEEEEEEEEPPPEPPKLVNDKPRPACKSWKKTRIY

SEQ ID NO: 1018570 - protein, 123 aa, Homo sapiens
TLGFFFSFSFKTHLDKEKTSLGSDFTLLVLVLGSYCVCVFLNGDERRRGTKPAGSIHHRGWLLTFSVFSRYSFFKQPLFTMNKLYIGNLSENAAPSDLESIFKDAKIPVSGPFLVKTGYAYVD

SEQ ID NO: 1018571 - protein, 111 aa, Homo sapiens
VCGFETELNVQFVSHMSLHVDKEQWMFSICCTACDFVTMEEAEIKTHIGTSTAGEDRKTPSESNTLSSSSLSALSDSANSKDDSDGSQKNKGGNNLLVISVMPGSQPSLEQ

SEQ ID NO: 1018572 - protein, 67 aa, Homo sapiens
DTSWRSEATFQFTVERFSRLSESVLSPPCFVRNLPWKIMVMPRFYPDRPHQKSVGFFLQCNAESDST

SEQ ID NO: 1018573 - protein, 72 aa, Homo sapiens
LRHPCEWTAYPPILGVLRDGVLLCCPGWFQTPGVKQSSRIGLQKRWDYRHETLLLDCAILKTGANNPLKCEF

SEQ ID NO: 1018574 - protein, 51 aa, Homo sapiens
MSQEGSSTQACRAQQGLAPVGRVGPGLPRRWTSPASSRCPSSCRLDLGPAF

SEQ ID NO: 1018575 - protein, 143 aa, Homo sapiens
VGLLVGMVTRAHHRPAGGMREAHGLRLALEHREDIGMRIAQHRQVVAGGRQVLSDGEHADVVGAQVAHDGKDFLVGLADADHQACLGRDGRVARLEGLEQGQRMRVVGAGARLPVEPQHGFQVVVEDVRRRGGEDVHGDVQAA

SEQ ID NO: 1018576 - protein, 80 aa, Homo sapiens
RALLGRKLPRWNPSPEKQVAGPRRGLTQWLNTRKELALGVQDILKFGIVPWIHHSQLKLSAQDQWTNQQDIDHLTRMILQ

SEQ ID NO: 1018577 - protein, 97 aa, Homo sapiens
RALLGRKLPRWNPSPEKQVAGPRRGLTQWLNTRKELALGVQDILKFGLLIRNIQSITESIVNRTTSTPLMALNKYQPVPNREELTCNEELNDSDAFY

SEQ ID NO: 1018578 - protein, 80 aa, Homo sapiens; identical to SEQ ID NO: 1018576

SEQ ID NO: 1018579 - protein, 1311 aa, Homo sapiens
MSRRKQAKPRSLKDPNCKLEDKTEDGEALDCKKRPEDGEELEDEAVHSCDSCFQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSKLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 1018580 - protein, 1347 aa, Homo sapiens
RYFLSDYVQSESLRVRGPLWSHPDGFGGLASIFHYYVDYRSDSAVQDLADPNCKLEDKTEDGEALDCKKRPEDGEELEDEAVHSCDSCFQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSKLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 1018581 - protein, 1347 aa, Homo sapiens; identical to SEQ ID NO: 1018580

SEQ ID NO: 1018582 - protein, 204 aa, Homo sapiens
CCPCCVRAHDSSAGLSPLRVLCAEGLRICQRKWRAPPPPPQLRFWAAWPCQSPPVGQEPSEHSGLARRGPPRPGSSAQPAPVSAEGGVCYSLPHPPPPPRGHLAPPSGTSPDGESLARVSDSVSPDICPGEPLGLREALAQLTGSEVWASGVRQQVSPCPGMKDTARELPCTPMVSCITAQRGSLVATAVCSVSALGKLEVLGG

SEQ ID NO: 1018583 - protein, 307 aa, Homo sapiens
LSLMYLAIKSFLPYIPSSDKMIFPPPTWWIDSQGLLKALDVGAPDPFCIIVNWLICRVTHPFHVFGRALTAAPAAGLNFGGGIFQAEAWSLFKKITEREGKFSRESLLLGLVVTATQSFLDTMFLLTPENFPLECAMKRRRQRQQQSSAQGATAAPGESEANFGAASPALCSVPGSLPGSRSLGPATPPLPSTAPAPGPAGALGCCPRSGQRWRGGGASLHGLCLDAAAPGPGPAARNGPQGGSESAKCLVGARGGAAGPRRRQQRLGSAQAARRGASDAKNVRNEDRNEMNARTDSLRRGGASRPA

SEQ ID NO: 1018584 - protein, 185 aa, Homo sapiens
MFLLTPENFPLECAMKRRRQRQQQSSAQGATAAPGESEANFGAASPALCSVPGSLPGSRSLGPATPPLPSTAPAPGPAGALGCCPRSGQRWRGGGASLHGLCLDAAAPGPGPAARNGPQGGSESAKCLVGARGGAAGPRRRQQRLGSAQAARRGASDAKNVRNEDRNEMNARTDSLRRGGASRPA

SEQ ID NO: 1018585 - protein, 256 aa, Homo sapiens
LSLMYLAIKSFLPYIPSSDKMIFPPPTWWIDSQGLLKALDVGAPDPFCIIVNWLICRVTHPFHVFGRALTAAPAAGLNFGGGIFQAEAWSLFKKITSAQGATAAPGESEANFGAASPALCSVPGSLPGSRSLGPATPPLPSTAPAPGPAGALGCCPRSGQRWRGGGASLHGLCLDAAAPGPGPAARNGPQGGSESAKCLVGARGGAAGPRRRQQRLGSAQAARRGASDAKNVRNEDRNEMNARTDSLRRGGASRPA

SEQ ID NO: 1018586 - protein, 110 aa, Homo sapiens
THIHTHTHTHLRPPEDTSIPRAQQYTLGFQSSQWTCQRQHFPASETKLQRGAFWRSCWDRTSHCGRWEPSLRTAGDLGRNLLPILFSTPSCVTLSLESIVTLPGYISGLT

SEQ ID NO: 1018587 - protein, 118 aa, Homo sapiens
RVAWVPEGLLGTGSAELSAQQLLVGGGPRPRPQLLGVLRLLPAIRPLPRAEDARKSVMIWARKMPHALGPVSLPIPFVHCCLLQLLYIWSCSRQLILMLRSSSSSRSPSTFHYSQLLS

SEQ ID NO: 1018588 - protein, 166 aa, Homo sapiens
LSRKFNRETRSSTEVERGLGSSLSWSCVVMMFQSWAKALFLVSRFDAISQSRIANQPSKRNCVCMLYLFATSNIPLSGAGCSRWVVTLLCTQESCIINQFHNWKIAFGPECGTGVREMNWVAFVAGGVDEAWPVCTDGVGVLGSVVCCARSSYCLLDHSPFVNREL

SEQ ID NO: 1018589 - protein, 418 aa, Homo sapiens
MDFLTEDSAFQPYQDDIDSLNPVLRDNPQLHEEVKVWVKEQKVQEIFMQGPYSLNGYRVRVYRQDSATQWFTGIITHHDLFTRTMIVMNDQVLEPQNVDPSMVQMTFLDDVVHSLLKGENIGITSRRRSRANQNVNAVHSHYTRAQANSPRPAMNSQAAVPKQNTHQQQQQRSIRPNKRKGSDSSIPDEEKMKEEKYDYISRGENPKGKNKHLMNKRRKPEEDEKKLNMKRLRTDNVSDFSESSDSENSNKRIIDNSSEQKPENELKNKNTSKINGEEGKPHNNEKAGEETLKNSQPPWDQIQEDKKHEEAEKRKSVDQLQEDMIIHSSEQSTVSDHNSNDLLPQECNMDKTHTMELLPKEKFVSRPPTPKCVIDITNDTNLEKVAQENSSTFGLQTLQKMDPNVSDSKHSIANAKFL

SEQ ID NO: 1018590 - protein, 253 aa, Homo sapiens
SGPRAAATLAGAAVKLDPQAGVRGAGAAAAPQRCDSGPEGQLESSVLRGRGGRMFVASERKMRAHQVLTFLLLFVITSVASDRTASIIPEACECLDLLSLTYRVLLLLTMDAYSRGIGGGERVSQEAGALITLVLMLILLGAVALHQGDRRNEEPCGPPLSVPPGDLGALWGLDVLLSSIQEDENHLRLSDRFLWGRSLLRSGFSWLVEPGMARAGGLGAALARGPRAGSWVGLGLCLMLVTRHHRCAVGGGH

SEQ ID NO: 1018591 - protein, 104 aa, Homo sapiens
MSDNDDIEVETDEEHPRFQSAADKRAHHNALERKRRDHIKDSFHSLRDSGSHHFKERRHPGPKSLAKPQDFSSICRGKNPPPQQDFDDLKRQNALLEQQGESES

SEQ ID NO: 1018592 - protein, 106 aa, Homo sapiens
RVLFNFRTMCRMPGIILRQIAIKDVGENALIRWKQPAFQCPGVGMRSKTFGGRSGRTAADTVRVDDAHIRVKPLLSITFKCPQTIEKRLPFAISSLWRACICACDQ

SEQ ID NO: 1018593 - protein, 113 aa, Homo sapiens
SGVTQGRRTQAGWGLSALLGGIRGESFPWNPSPNRLSPALSGEERSAASGGSAFPKQFIFGRFSLKEKATNRLPAPAPHTRRRREKPRPGFLCLCASLAGCWRRGEGGGDGSA

SEQ ID NO: 1018594 - protein, 178 aa, Homo sapiens
SCRELKPNSVRDVRLLDRMIEHRVQRRRDVGRRVGRVEEAVRGAVLQTGRNVGDVPVGVIILVIGKRGIDRIDRLVRDVEHGDDDAAVLQRRAGRRRIDRGSMVAAGTMIRSHALDLRILRAIGDEEDVRQRVVPARCRADARYQRIHARQRRVDICAARAEIGVDVGVEQGREVRGR

SEQ ID NO: 1018595 - protein, 144 aa, Homo sapiens
GPRQGANTDVVTWSRRTREDARAETGSRALGRSKARTRHPRPRRACENGAEPARRMRGRRPAHHRVLNTRSSRGRAASGSPWNGSSDPCSLIRYQPSTSVDSSSRLPPSARRVAAGGARPPCFVSGGIYFSEGRSGLPFVPLSF

SEQ ID NO: 1018596 - protein, 104 aa, Homo sapiens
FLKSWEHKGFKKSCDNVVAGWAYKPTLLGQGVRATTIIVLKGWSTKQQEAERGSPQRGQGQAVRPSGSLGELAAHWEHGGFPERLSSHHTYPSSPLLSDTLFPA

SEQ ID NO: 1018597 - protein, 174 aa, Homo sapiens
HSSPHSSMNSGVGRGPQSGSCVSAGSPVRIHHKGYPPRGTTASFKLFLLKHSSRGKKSRVESLPGRTLGLGVSARQGHRDYSPGVPEPALPCSPEIPAIVKRICFLRWSLALAQAGVQWCNLCLPGSGGSPASASQVAGAAGMRHHTRLILVFLVEMGFHHVYLPGCSRAPGLK

SEQ ID NO: 1018598 - protein, 179 aa, Homo sapiens
HSSPHSSMNSGVGRGPQSGSCVSAGSPVRIHHKGYPPRGTTASFKLFLLKHSSRGKKSRVESLPGRTLGLGVSARQGHRDYSPGVPEPALPCSPEIPAIVKRICFLRWSLALAQAGVQWCNLCLPGSGGSPASASQVAGAAGMRHHTRLILVFLVEMGFHHVYLDNMVKALSLRMMQKN

SEQ ID NO: 1018599 - protein, 74 aa, Homo sapiens
MARADGARQGETTDLREFPAHYRRLCQQLALTQERGYSSHLVDALQQLALRGHQQLYRHRSHLGASVLGFVFVD

SEQ ID NO: 1018600 - protein, 174 aa, Homo sapiens
ARAVTLARRDDDPSLRQRVALLQFGGPGEQQVAFPLSHNLTAIHEALETTQYLSSNVGEGVVHAINAIVRSRVAGPEGTEGLSFVYLTDGVNGQSRVGNSMRKQVVPTGLALGSDVDMDVLTTLSLGDRAAVFHEKDYDSLAQPGFFDRFIRWVCSAAARAPQSRVVSPPRPWC

SEQ ID NO: 1018601 - protein, 176 aa, Homo sapiens
IPIPENEAWNEFSLDDLLPTSCSTGQQAPSSPPSILQGEPGTGLMTQKHERMKVYANGFSAFPFEVLHTPEKWVRFKYPKLISYSYMARGGHFAAFEELELLAQDIRKVPGGGGSGKDPPFSPRLPPPPTSALQAFFGEDTPFLRNEFASVPGPCWEPTLTPSPLQAHSPTPNSVW

SEQ ID NO: 1018602 - protein, 133 aa, Homo sapiens
RLFVCASWARRGFFDARRRLMKRLCPSSCDFWYEFPFPTVATTPPPPRTKTRVVAEGRNVTFPCGQKILPKKGKVDWDKDQEPLEFSYPGYLALGEGPLSIIANPVNEGPYPWVVGPQQGVLAPYSWGGRVRG

SEQ ID NO: 1018603 - protein, 1487 aa, Homo sapiens
MIRLGAPQSLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 1018604 - protein, 117 aa, Homo sapiens
MAENTDKKEAKEQTRQQKNNTKARRKSKRRKTTTQRRQRDERSEQERESTTRTNATRTRTPTRARHHAQIASAERMDGEERKKQQHEREGARRSDERNDTKKRERERERCKDNRTTK

SEQ ID NO: 1018605 - protein, 951 aa, Homo sapiens
GAWPRAPLPQAPPRTSPGLLLLCQLRQLASTWRGPAPLPAPSDRPRPAALSDHRLSDDQVPGELSESPPPPSFSPGCSCSASHAPPVHPGPPPRGHSADRPAPSPDSGKLRLLQLQAPANPEEPHGEGSRAPPAPGRPAAAGRSLILPPPPPSLFSSSPEVEFERRHGGGAALLPLLCLPMDMHCKADPFSAMHRHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSEAAVGPSSSLMSKPGRKLAEVPPCVQPTSPYYYSAAPRSAPAARAAAYDRHYYRGDHIKLQADSFGLHIVPSDPTPEEGGPTRRMPPGHRPSLTPSHDPRNPSHHPPRRSDRTGGAAGRDPQARAHRPQPRLPPLPACLDCAAPEGDSAQLVPASTKPAPKPASHPAVLGRDLLVRAGCFCDTQSARTAARPSPGHPPRTLGRQELRWRGWAKEIKKKTTFCRRKSPLPNPWEKFFSPSASRTALAFRVCPVPEDGMGVWGSGSRNGLWGRQVFPRLGPKDRGAQQPAPIEPDSRLFTAPPGLPSSPGPGTSCCETRLSALPCPYLSVSSTCWPPSFPSCQSFACPLTPCILLPDSQPHRTLSRDRRRTSFHRLRTGVFLQQLLDAPSPDTDSQSAGGKNRF

SEQ ID NO: 1018606 - protein, 275 aa, Homo sapiens
GAWPRAPLPQAPPRTSPGLLLLCQLRQLASTWRGPAPLPAPSDRPRPAALSDHRLSDDQVPGELSESPPPPSFSPGCSCSASHAPPVHPGPPPRGHSADRPAPSPDSGKLRLLQLQAPANPEEPHGEGSRAPPAPGRPAAAGRSLILPPPPPSLFSSSPEVEFERRHGGGAALLPLLCLPMDMHCKADPFSAMHRCQDTMVIFPCLCLGDAAKNKEGLREEIEVRERASSAAFQVGPRQSAALLSALEAPCLDCRLPIEDHAASNLARGSAKSKK

SEQ ID NO: 1018607 - protein, 151 aa, Homo sapiens
MTSVTTERCGPIPPWTSPSMLTSTSPACRFGRAPLRYQLTPVVTTAPEAQPMSGPPNVPTLPATPPEAAAIPLATLPRIVLIASACCRVRGLEMQTVSRHGRFRACIRSYISTTMLLTWYMGAFRFAKVQLGQATSVAFHEGELRQIEDNP

SEQ ID NO: 1018608 - protein, 585 aa, Homo sapiens
MSQQHTLPVTLSPALSQELLKTVPPPVNTHQEQMKQPTPLPPPCQKVPVELPVEVPSKQEEKHMTAVKGLPEQECEQQQKEPQEQELQQQHWEQHEEYQKAENPEQQLKQEKTQRDQQLNKQLEEEKKLLDQQLDQELVKRDEQLGMKKEQLLELPEQQEGHLKHLEQQEGQLKHPEQQEGQLELPEQQEGQLELPEQQEGQLELPEQQEGQLEVPEQQEGQLELPQQQEGQLELSEQQEGQLELSEQQEGQLELSEQQEGQLKHLEHQEGQLEVPEEQMGQLKYLEQQEGQLKHLDQQEKQPELPEQQMGQLKHLEQQEGQPKHLEQQEGQLEQLEEQEGQLKHLEQQEGQLEHLEHQEGQLGLPEQQVLQLKQLEKQQGQPKHLEEEEGQLKHLVQQEGQLKHLVQQEGQLEQQERQVEHLEQQVGQLKHLEEQEGQLKHLEQQQGQLEVPEQQVGQPKNLEQEEKQLELPEQQEGQVKHLEKQEAQLELPEQQVGQPKHLEQQEKHLEHPEQQDGQLKHLEQQEGQLKDLEQQKGQLEQPVFAPAPGQVQDIQPALPTKGEVLLPVEHQQQKQEVQWPPKHK

SEQ ID NO: 1018609 - protein, 585 aa, Homo sapiens; identical to SEQ ID NO: 1018608

SEQ ID NO: 1018610 - protein, 77 aa, Homo sapiens
KFAAASTQDGQLKHLEQQEGQLKDLEQQKGQLEQPVFAPAPGQVQDIQPALPTKGEVLLPVEHQQQKQEVQWPPKHK

SEQ ID NO: 1018611 - protein, 34 aa, Homo sapiens
MSDPSQLTQNVCLTQEMELSKAFFGQRNQPSAFN

SEQ ID NO: 1018612 - protein, 151 aa, Homo sapiens
MAPSGPIEGTCENSGPAGKGLAYSVGVPIQILGRLAPMFGRPPSSRAPHEASVHHRASKKAPPGGLNFPGFWRNIFSSSLSRGKTPGSQGTRSLQKLREHSTCGTGQQGYLGALGGPHSGDVFSRSSSSSLGPLLYGSRGCPTYVGPVIPS

SEQ ID NO: 1018613 - protein, 132 aa, Homo sapiens
AKIVRWSPCRLWGHTCVRHLASFFAFPGSQAGRWEARLRSGPGCDVGARAGKGLFGRRCLSFCPSVVPAISPCQPSTLGIMVKLMQRCPGGGLGGGGAGPPYGMPTAGSSSCPWSPYHTPPPRPPPFNTVWI

SEQ ID NO: 1018614 - protein, 261 aa, Homo sapiens
SGARAGPGRGLSAAGGMPTNFTVVPVEAHADGGGDETAERTEAPGTPEGPEPERPSPGDGNPRENSHSSTMSRWNKRASLKGRTWHFSRRRWTVTPWCPRCSTSLANYTNLSQGVVEHEEDEESRRREAKAPRMGTFIGVYLPCLQNILGVILFLRLTWIVGVAGVLESFLIVAMCCTCTMLTAISMSAIATNGVVPAGGSYYMISRSLGPEFGGAVGLCFYLGTTFAGAMYILGTIEIFLTYISPGAAIFQAEAAGGEAA

SEQ ID NO: 1018615 - protein, 100 aa, Homo sapiens
MPAGCWKTLLRWLPVFLQTMLTAISMSAIATNGVVPAGGSYYMISRSLGPEFGGAVGLCFYLGTTFAGAMYILGTIEIFLTYISPGAAIFQAEAAGGEAA

SEQ ID NO: 1018616 - protein, 85 aa, Homo sapiens
DICFRVAASSFLRHKAISSAAARDYSRPLLVFLESEEPATSGGPPAVTLHGISPDVFTHVLYYMYSDHTELSPEAAYDVLSVADM

SEQ ID NO: 1018617 - protein, 218 aa, Homo sapiens
MSESSGSALQPGRPSRQQAVHPENLSLDSSCFSSPPVNFLQELPSYRSIARRRTTVHSRDKQSGTLLKPTDSYSSQLEDRIAENLSSHSLRNYALNISEKRRLRDIQETQMKYLSEWDQWKRYSSKSWKRFLEKAREMTTHLELWREDHPQHRREIWHWDSVLFLLLEIPGVAEFGDILIIFMLVFLPVLLTKYKITNSSFVLIPFQRHGLTNVQSIQ

SEQ ID NO: 1018618 - protein, 107 aa, Homo sapiens
MSESSGSALQPGRPSRQQAVHPENLSLDSSCFSSPPVNFLQELPSYRSIARRRTTVHSRDKQSGTLLKPTDSYSSQLEDRIAENLSSHSLRNYALNISEKRRLRFVH

SEQ ID NO: 1018619 - protein, 185 aa, Homo sapiens
IHLGGLSDCPCPGLCPEVVPISSMDKVAGVVVARHCRTNMVPASVDAINFHDKIRKGCVITIRDRMTLPSNKIHGDRGVGGRRPCLAASQKRYRAASAFFTYVLLSQEGRVAALSPNWCPKPRTKKSAFRKAKGGSCKLRRNDRAPRSLSPRLPPPAPGASSNHGNGPSVQSLKSSPLGPKPHSH

SEQ ID NO: 1018620 - protein, 145 aa, Homo sapiens
FAAASTRRSAASGWSKVALFQYSINCLRASVVSGLPRDKCDVVDADDCLGLLGRRVDSGLGQLRDTVLGQVNGVQRLMWPQALRPLGDPGVSQIHPAQVRQGTEVGSTRQGVAAQVDRLSEVSPSSRSTSASVRDNRLPLRSRRV

SEQ ID NO: 1018621 - protein, 87 aa, Homo sapiens
KGDVYLSLIPGTTARGSGGLQGDGEKSPDVPHPEGEFQPRRGQRKKCMDQENLAIGKQQRPRNFNITVHLPELITFPPPSHRLCAVS

SEQ ID NO: 1018622 - protein, 44 aa, Homo sapiens
MIAFRTTTSDFLGCRDVEFTQLRLKIEVHSSRARLEMQIDSSVL

SEQ ID NO: 1018623 - protein, 109 aa, Homo sapiens
VLLFEVVCDAWVSSWTAPHLALTGTGTDAVVPRPPPREAPAPAVWATRPAPHGQGCGGAGSTAHGGASGQVLPPLAVAVTLMPRWTAQTRLGAPSPPRRAGVDSRQRLP

SEQ ID NO: 1018624 - protein, 102 aa, Homo sapiens
SEVFCELWLCSRLSVSQTVGAVSLSLGLPPAFCDLCIPSRRQLLTPRAPLLGHQQGGRQRGQALSRGGAGRDPLPGPLGRTQTQMEPVPSTPGLGPSPALLE

SEQ ID NO: 1018625 - protein, 77 aa, Homo sapiens
AAYRSGIFLPCFIAIDQYMPFNPHSAGKFNQCFEPDWANSMTLILRHQNDVPLTRQFIDNPGFRFPFHQQPAACKQR

SEQ ID NO: 1018626 - protein, 120 aa, Homo sapiens
RFLSPLGPLGPATCPHAALDLGLGGHSLLPTEVRLIYISVHNRIHKTLHTGTHRVSPPTGIGAGPAHTPFLLEAKAFPMLPTWRKLCKISVAQSRTRKSSTHNRKEKAKFCKRGCRTHIF

SEQ ID NO: 1018627 - protein, 80 aa, Homo sapiens
IVLQRGGTGFAGSGVKLQSGEITAGDAGLSVCGRPNKPAWVRNDVAPSFAAWAPRGQGRRGCRAVQTVLLQRTLEFERAG

SEQ ID NO: 1018628 - protein, 48 aa, Homo sapiens
AAAAAAIGLVIYYLAFSAKSHIQAWRRHPSPALASFNKLPKDLGLQKK

SEQ ID NO: 1018629 - protein, 371 aa, Homo sapiens
GSSSGAAGTAAAPQAEKPGAGEAAAAAAMAGIELERCQQQANEVTEIMRNNFGKVLERGVKLAELQQRSDQLPGYELQPFNKTYTEPGPSKKLLGSNIRSTRTLRGGSVVRLAVPASLILTCGCLARPLSYRQQQLTTQLRCPTGPSALHGTCPQRPWAPRPPAWLLTARPANTGLHLADFWLSSRTSTLFRSPLTHPHVTAPRASPTMWPPPAFSLLLPQTGPLTGQHAAHCPLPGAQPHLAAPPHLLLRINTHPTHKPHTTTTILRAPPALNKTPQHTTMEGDSDAPAQTMSNPHPRVHSDETPQDRRHTTATTRWTRAISPTTINITPRGATRSVLRTHHTPRAPSERPRGDHIAHRRTRDSEPTPSA

SEQ ID NO: 1018630 - protein, 163 aa, Homo sapiens
GSSSGAAGTAAAPQAEKPGAGEAAAAAAMAGIELERCQQQANEVTEIMRNNFGKVLERGVKLAELQQRSDQLPGYELQPFNKTYTEPGPSKKLLGSNIRSTRTLRGGSVVRLAVPASLILTCGCLARPLSLRAMTAVMPQGPQDAGNCLRAWELNPTVLEGEL

SEQ ID NO: 1018631 - protein, 115 aa, Homo sapiens
VQIRSGSQILGVRTWTALWGSPFKSLQLCLVPSRGSRGGSFLPLPVPGGFRHFWASGRITAISASISTWPSLLCLCLLFCLSEGHLSLHLGSTLTPYDLISTYLSNHIYKDTISK

SEQ ID NO: 1018632 - protein, 103 aa, Homo sapiens
MDDDKDGGIEVEERAEFIREDMPIYTMLLINTAICPEKKTYNDGGFMDTMENPQKFTNWTLEDTLQWLIAVGELPQYDEDILRDNTCRRNDTSQDSSARNLHL

SEQ ID NO: 1018633 - protein, 111 aa, Homo sapiens
AHWRKRQEASVHARGLLVAEAALPRPPVGNLVLRVRAGGALWAVRERGEKRERREPDIWEGQACLWDGEEPVHGSCCASVQGAPSSLGFARKCNQTTWAKCDAFILSQEHA

SEQ ID NO: 1018634 - protein, 112 aa, Homo sapiens
AHWRKRQEASVHARGLLVAEAALSAPASSGTWVLRVRAGGALWAVRERGEKRERREPDIWEGQACLWDGEEPVHGSCCASVQGAPSSLGFARKCNQTTWAKCDAFILSQEHA

SEQ ID NO: 1018635 - protein, 138 aa, Homo sapiens
MDRHRVMDDHYSPDRDRDCEAADRQPYHRSRSTEQRPLLERTTTRSRSTERPDTNLMRSMPSLMTGRSAPPSPALSRSHPRTGSVQTSPSSTPVAGRRGRQLPQLPPKGTLDRNNGVKEIEPYEEAGGKKLRSTVPKE

SEQ ID NO: 1018636 - protein, 65 aa, Homo sapiens
MRSARILAWLSISLHVISEILPLHVASFPLGLSRRTVRFLHDDPLSRKHKSISCRAFLHPDLEEL

SEQ ID NO: 1018637 - protein, 194 aa, Homo sapiens
WSVTRPGDRPDMWCPHPEGRPWRDDPPLPPPPIRLWTPSSLPPSTLPDPPKSPGSSLPQGTRSTAPSIPNGPDSQRGVRKEKAISHRLILLAPGSSTGRRVGLCRHDGSVVREGPPPMCLGRGPPKPLRGSAKGLESAPAHTGPCSLVAIVSATSTFRSLPRACPRSLSPPWHAPLCPHTLCVSGDSGDSSGVT

SEQ ID NO: 1018638 - protein, 194 aa, Homo sapiens; identical to SEQ ID NO: 1018637

SEQ ID NO: 1018639 - protein, 87 aa, Homo sapiens
PGPRGLLSTKVLLTGKPCRNFRVLVAYSMLQMVREQVLQESMGGDDILLACNNLIDLDADELISAACVVYAELIQKDVPQTLKDFFL

SEQ ID NO: 1018640 - protein, 102 aa, Homo sapiens
MVGRPVRPRPRMPRPCSRHVAVSLQGPCVHKVPSIFHPKLTKTQLGDPEVRGEMWVTSPSTTLSSRPARGKEGSQGLWGAHAGERQRPLGETGSVLSPGHAP

SEQ ID NO: 1018641 - protein, 225 aa, Homo sapiens
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTASVSLSVSQPCETDSSSPQVSWKRGIEE

SEQ ID NO: 1018642 - protein, 303 aa, Homo sapiens
MAPSTEPPWEEMHRLGVGIPTSCVEGETARTRGGPLGFPFPRGPLFGLYTLSGGSCHPQLGLHRLPPREHLGREFFTLTLTRVRRLSSGEIVSLYSRHTPGREEILFRGGARPRETRGRPGRYNETLGARRLFLVRVIKINPSLVKNGSFRGIFGHTETLPHPLLEKSETHFRERRVESSVETTESDNSLLVGNTVLNRPRRFTTRNEESLRGPAQRRERRSPITEHSSHTMHEARPGAQPGMWRHPRLDECQPQELLQNIAPAPARRRKCTRLTRTSRELLGISQPRSPTPFFPHPWKNFQK

SEQ ID NO: 1018643 - protein, 154 aa, Homo sapiens
FFFFEGGMRCFLGKTWGKMNQPCNSMEPRVMDDDMLKLAVGDQGPQEEAGQLAKQEGILFKDVLSLQLDFRSMYPRFRGGGQGGPSLAFSAPSSSPRIPCKVHGRGSHISIKGLPGLQGIRSSTDVCKSVIFKCLHHFEYPRRSGFLISVGRMS

SEQ ID NO: 1018644 - protein, 397 aa, Homo sapiens
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEVRLGPGHKCQNLAMQLHIHR

SEQ ID NO: 1018645 - protein, 397 aa, Homo sapiens; identical to SEQ ID NO: 1018644

SEQ ID NO: 1018646 - protein, 397 aa, Homo sapiens; identical to SEQ ID NO: 1018644

SEQ ID NO: 1018647 - protein, 248 aa, Homo sapiens
MAFTAFMQAPVQHPCPCAGGCSMAEAAWQRRCGSEEPLVTMPLPFPGQKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEVRLGPGHKCQNLAMQLHIHR

SEQ ID NO: 1018648 - protein, 523 aa, Homo sapiens
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSSLSAIREELELPNIEKMILECSADISELFDALMTLEMQLVEQLEETINMFERNIVDMVGLFIENVQSLMAQCRDLENHHHEKLLEISISTLEKIVEGDLDEDLPNDLRALFVDKDTIVNAVGASHDIHLLKIDNREDELVTRINSWCTRLIDRIHKDEIMRNRKRVKEINQYIDHMQSELDNLECGDILD

SEQ ID NO: 1018649 - protein, 357 aa, Homo sapiens
MNQPCNSMEPRVMDDDMLKLAVGDQGPQEEAGQLAKQEGILFKDVLSLQLDFRNILRIDNLWQFENLRKLQLDNNIIEKIEGLENLAHLVWLDLSFNNIETIEGLDTLVNLEDLSLFNNRISKIDSLDALVKLQVLSLGNNRIDNMMNIIYLRRFKCLRTLSLSRNPISEAEDYKMFICAYLPDLMYLDYRRIDDHTKKLAEAKHQYSIDELKHQENLMQAQLEDEQAQREELEKHKTAFVEHLNGSFLFDSMYAEDSEGNNLSYLPGVGELLETYKDKFVIICVNIFEYGLKQQEKRKTELDTFSECVREAIQENQEQGKRKIAKFEEKHLSVGPEPPEALPVSCCRPSLLLPLPL

SEQ ID NO: 1018650 - protein, 89 aa, Homo sapiens
RPLLLLLNSRRVDIVVLCCSYCADLSEIRVRCCARRTRRLMLRAVRIIAEETTAMLYSCRTERRRQQFIRALLQHHRPILMHDYDSTPM

SEQ ID NO: 1018651 - protein, 307 aa, Homo sapiens
SHMFSCCPEGRQLDIKKSSYKKLSKFLQQMQQEQIIQDERRLRQKGVGEPFVVCCNWDTTPRDYTLFVHSSSPPQNYSRRVDRVTASITPPRYNNPLLLCPQPSMTLLFSGVWRTEKGSFVEGSEVRTIVINYAKKNDLVDADNKRCCEIWIPCLCDCILEKNEQHTVYEASMGQSSDHGVCEKLQPAYQVTLPGQEPIVKKGRICPIDITLAQKSVYIKKVTVVSDTLEAYGLDPYSVAAILQHADATASTTVKSVPLGDQGPAFTVQIQGKPGPPPRLAIRYEEYQLPRKHIQGLEKALKPGKKK

SEQ ID NO: 1018652 - protein, 112 aa, Homo sapiens
VSPPFFSPRPVGKKVRVPGLSGGRPEGRAHAPRACFQTPARKGLELFSEPVRVGSYGPGSYLAAFLSLGRSLHYLVSPRNKMFTYSLLVRLAQSTLLAVKPQVTRSPRRDHG

SEQ ID NO: 1018653 - protein, 99 aa, Homo sapiens
SKVKEDDFPPILTTPQSSPPKTDSAGYPRPGTSCWIQENSGTQTARSKHFIGSETASNPEPSARPRLESEPKACELGHPTSVFTLIRKPDTPGLPLNEY

SEQ ID NO: 1018654 - protein, 61 aa, Homo sapiens
MKEDDFPPILTTPQSSPPKTDSAGYPRPGTSCWIQENSGTQTVHYRGSGLAQSTYWVRADS

SEQ ID NO: 1018655 - protein, 107 aa, Homo sapiens
MGRDATRIGERLQGEGNFQLNFVTISSKLKVSWTESGKGVTQERRYSTETGAGGEAQILKAACFLSGEAWSLRQVFSPAHRLPGNKLSAIGVHSESETSLSGCVGAG

SEQ ID NO: 1018656 - protein, 364 aa, Homo sapiens
MPHPYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHVYLEGTLLKPNMVTPGHACTQKFSNEEIAMATVTALRRTVPPAVTGVTFLSGGQSEEEASINLNAINKCPLLKPWALTFSYGRALQASALKAWGGKKENLKAAQEEYIKRALANSLACQGKYTPSGQSGAAASESLFISNHAY

SEQ ID NO: 1018657 - protein, 132 aa, Homo sapiens
NGPAHPHPRPPKPLPNPPETNEPPAHPRRPPPPHRHPHPTPSHPHNTPRHTTASTRPRQVPPPARCNHQSPATQAASRRTPTGTPPPTQNIRQGPATRTHTLCPNGAQQKQTTPAARNPRRDRNLILNEIEC

SEQ ID NO: 1018658 - protein, 75 aa, Homo sapiens
PLSTHPGPKVLPAQVGVWSFEQEEDMKHIPVSYDREGQGTHWTFQAPPEKQVLLCWEYLWSAGCVALGFNYFRNI

SEQ ID NO: 1018659 - protein, 75 aa, Homo sapiens; identical to SEQ ID NO: 1018658

SEQ ID NO: 1018660 - protein, 69 aa, Homo sapiens
HRAGSLREFTQGPPPISAFMSYILPGHPFLGEVIPGTGSPYRTLVESIRKVSSSGRFKDLIARSGFQHR

SEQ ID NO: 1018661 - protein, 149 aa, Homo sapiens [sequence omitted]

SEQ ID NO: 1018662 - protein, 82 aa, Homo sapiens
MAVFHAMVEIEDFQYDEDSETYFYPCPCGDNFSITKEDLENGEDVATCPSCSLIIKVIYDKDQFVCGETVPAPSANKELVKC

SEQ ID NO: 1018663 - protein, 105 aa, Homo sapiens
TFFTPPPNARGWGNLAQSNGGRNFRTKPPYTVCLRQKITPASRPPSPLKEIFINPVGFPENSFFKKPPPPKEAHLSRVLDPQLQLCIPSFVFQKNQRGPICLFPL

SEQ ID NO: 1018664 - protein, 119 aa, Homo sapiens
MSLDVLHSNRVVAILICKHAQSTGCQWAALAPGCATRCEQTVMPDVRRKLMLVLVIRTPSISLGNKHNRLKLLTIRKVFVLVTNLSYLPIITTLSSNTLHPPPDTQWWMWILVPKCNWW

SEQ ID NO: 1018665 - protein, 116 aa, Homo sapiens
MSLDVLHSNRVVAILICKHAQSTGCQWAALAPGCATRCEQTVMPDVRRKLMLVLVIRTPSISLGNKHNRLKLLTIRKVFVLVTNLSYLPIITTLSSNTLHPTSRYAMVDVDTCAQM

SEQ ID NO: 1018666 - protein, 104 aa, Homo sapiens
MVRSLSCSAELVACGQFELTFRALRTDALVLLITRLSVGITGEHLPTWQHFTGSLQFKALGGIGHAFVSVPAVFGAADVLGEVVLLGLEHRDTGIERTAVELVD

SEQ ID NO: 1018667 - protein, 87 aa, Homo sapiens
PSGSLLGSYELAGGDLAGLLGALFDMGLKEGVRLLRGPETRAKLPSTRVKEASGSGSQSVEQEAKKLGPPPEPPGGFCQGPPQPQVH

SEQ ID NO: 1018668 - protein, 139 aa, Homo sapiens
WSPAGIASFDHITLRPGLKGSVLVIPLLMGKKSAGQREMLTQKLRSSFSRIPCPDGLSIQCTRSAGRPCRPTHPEMRDAAKQWLCRTSGRVWMGAWRFPHMCADPLESRIEPETERRVPVGRWGLAPMVTCKSEASWRP

SEQ ID NO: 1018669 - protein, 143 aa, Homo sapiens
NVEQKKKRTFRKFTYRGVDLDQLLDMSYEQLMQLYSARQRRRLNRGLRRNNSSLLKRLRKAKKEAPPMEKPEVVKTHLRDMIILPEMVGSMVGVYNGKTFNQVEIKPEMIGHYLGEFSITYKPVKHGRPGIGATHSSRFIPLK

SEQ ID NO: 1018670 - protein, 82 aa, Homo sapiens
AQVPRAGTTSAGSRDGPGGNRDGPGGNRDGPGGNRDGPGREWQQQIKPRSPCPGWVPASLRHSVPVTLLCAEMNETGKATAP

SEQ ID NO: 1018671 - protein, 76 aa, Homo sapiens
HHAKIVCLAWSPANEHFASGGMDMMVYVWTLSDPETRVKIQDAPRLPHVSSLAGLDEPPLVPPSHDASVKEWPIPF

SEQ ID NO: 1018672 - protein, 72 aa, Homo sapiens
YDGFLDPDFVLVCPIFLYSLAITRGTHNGPPFVNIELYSEQTFRYYAIQKSCSRPYFKKVWVLGSIIRTGSA

SEQ ID NO: 1018673 - protein, 72 aa, Homo sapiens; identical to SEQ ID NO: 1018672

SEQ ID NO: 1018674 - protein, 743 aa, Homo sapiens
MILEILRICATLNIFSGGSLEAYRTVEELYKRPDEEYNEGTSSVQNRVRFELLPILKKGLFFDPEFWNFVMIKKNCVALLSDKSAVRFLNESTLENNAGNLKRTEEQQGLDEGFDSLTDQSTGETDPDDVSGVQPKGHINTKKNLTALNTSKVDHNVPRHRCMLCNKEFLGGHIVRHAQAHQKKGSFACVICGRKFRNRGLMQKHLKNHVKKIQRQQIAAAQQDDQEVTALEEINCSSSSISFENGNSDSKDLEVETLTASSEGNKEVIPEHVAEFIEIPISVPEDVIENVIENGSPNNSLNNVFKPLTECGDDYEEEEDEEGDYEEDDYDLNQETSVIHKINGTVCHPKDIYATDQEGNFKCPALGCVRIFKRIGFLNKHAMTVHPTDLNVRQTVMKWSKGKCKFCQRQFEDSQHFIDQLNRHSYPNVYFCLHFNCNESFKLPFQLAQHTKSHRTFQAQCSFPECHELFEDLPLLYEHEAQHYLSKTPESSAQPSETILWDVQTDSNPNQEKDSSSNEKQTISLPVSTSKSRKESTEPRTCIESMEKKTDSLVQNGNERSDDTVSNISLIDQKMPDIEPNSENNCSSSDIVNGHSEIEQTPLVSSDPALKIDTNRIRTENGSILPSVVPQEHNTLPVSQAPSKPNLTSEHTSYGLILTKPYVRPLPPSYLDERYLSMPKRRKFLTDRVDACSDQDNVYKKSVKRLRCGKCLTTYCNAEALEAHLAQKKCQTLFGFDSDDESA

SEQ ID NO: 1018675 - protein, 743 aa, Homo sapiens; identical to SEQ ID NO: 1018674

SEQ ID NO: 1018676 - protein, 743 aa, Homo sapiens; identical to SEQ ID NO: 1018674

SEQ ID NO: 1018677 - protein, 159 aa, Homo sapiens
MNCYLENYCNRSGTNAFSPRHKARPFCLPFPVILQACGKPRTSRARGPARSSCHHSSLCRCQHRRKPRSRLPLRHCGAVPGWSHGAPHPENPTWRGAGTQEGHRWEASLGSLKAQSRAHTHTQTHIHTRTHTHTHTHSVGGAGAGALPVLPALEEVGVF

SEQ ID NO: 1018678 - protein, 144 aa, Homo sapiens
CPSSTQGAYLEPQSQAACPSLLELQPCSFLFLSLCCWLSHFPPCQPQDSVPLLKVSMAEPGGSYNRLHAEGGRCGTIREGTELMVYGVGAGSLEGVVWGAGLRRPEAWAHHPGHAVPVMQSESCCQGRYPAPSLGVPRAKSTAD

SEQ ID NO: 1018679 - protein, 75 aa, Homo sapiens
RAVRLAASPFPAAGPRQYPERPFSLAMAALSVCPELAIGEVKVGFTLGTTVFLWIYLIKQHNEDILEYKSRNGLE

SEQ ID NO: 1018680 - protein, 107 aa, Homo sapiens
CQLPEFCLKMAPQHWLGTKGKIGAPQSCLGPGAQKPGNLWVQGPLGALPVERGRCFALSVSASACAKGGEVSPPKLFGRALLLPVLGPLVPTLGVPFLILGDPPSPN

SEQ ID NO: 1018681 - protein, 112 aa, Homo sapiens
FFASSGILLFISRGASSKQSYKVKGNSKFLTQSNPGSVFKNIEVGNPFWNSAFEVEVLGQLSSSSTSSSAHGVIRSAPKLPTRVWKAWLGVVRAVVHVAVPPGQSCFRAFIR

SEQ ID NO: 1018682 - protein, 76 aa, Homo sapiens
SGGTPMYPGIAGRIRKEITAWAPSPMKIKIIAPPERKYSVWIGGSILASLSTFQQMWITKQEYDEAGPSIVPRKWF

SEQ ID NO: 1018683 - protein, 204 aa, Homo sapiens
SRVKFGGKFENPSQVVERLTRKYNELLKSYQWKMLNTSSLLDQLKEQFNWVSRLANLTQGEDQYYLRVTTVASHTFDSDVPSGVTEVVVKLFDFDPITVTVPVEVSRKNPKFMETVAEKALQEYPKKPREELNVDVAFAPTGAFESSSPQNEVQPPKKSFARPQVTRPQPPGPQIRPAFPRFGSCTLTLDFAAHGKNKIAPACN

SEQ ID NO: 1018684 - protein, 71 aa, Homo sapiens
PLERTPTTTKFAAASTLEAHGGVKAVGVQAIVRDVIRNACDAAAAKRFLAAHVGQTDVATGHKCAVGPDDA

SEQ ID NO: 1018685 - protein, 72 aa, Homo sapiens
SVQRGIQTLADPGSFDSNAFALLLRAAFQSLLDARADEAALSTHTETDRPSGFKALSCSSCNLHPGGRKAPS

SEQ ID NO: 1018686 - protein, 147 aa, Homo sapiens
METPALHFATNNVKILRFGSANLLQFTFLSAGRIVEFFLKIEKQFRQSEISTRRIRSTAEAILGRKSIHSTVCAPNNCLHWESYEVQTTARPLILSLVISEEITSQLSNSLSKHLALTEVRRITICITIFMKLEYFPLLVSYMNGRC

SEQ ID NO: 1018687 - protein, 98 aa, Homo sapiens
GHFRRSHGGNATTNPSQLLPLELVDKCIGSRIHIVMKSDKEIVGTLLGFDDFVNMVLEDVTEFEITPEGRRITKLDQILLNGNNITMLVPEEKDLKCE

SEQ ID NO: 1018688 - protein, 98 aa, Homo sapiens; identical to SEQ ID NO: 1018687

SEQ ID NO: 1018689 - protein, 66 aa, Homo sapiens
ALPHTPITVLMAAPVPLPVDVAVRSLKEPPIIIVPESLEADTKQDTISNSLEEHVTQILNEQADIS

SEQ ID NO: 1018690 - protein, 102 aa, Homo sapiens
MADENIHDHNYKEISQPSPCSKATGAYEDNEPGRHPKEEVSKEKPAFEATTALPHAQKAKIGSCMRSDFQPPKTNKQKNQPNLKKNPDGSREYLGVCLVVCG

SEQ ID NO: 1018691 - protein, 123 aa, Homo sapiens
FAASTRQQHRQAVLIQAQGDTTRVGQVAVVHQRLHFHQHRPGAFPRCHHHTAWDFFLGTGKKNRRRVGDFFQAPVSHGEHSELVDRAKTVLHRPQQTQPPIGLAFEIQHGVDHVFQQSTRPRI

SEQ ID NO: 1018692 - protein, 120 aa, Homo sapiens
READLAKVKKTLALEIINFKQPQSHETALHCAVASLHPKRKQVTELLLRKGANVNEKNKDFMTPLHVAAERAHNDVMEVLHKHGAKVRHTPEQSARLSTEQPAALNTASLSPIFLKKLIL

SEQ ID NO: 1018693 - protein, 192 aa, Homo sapiens
LYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYAFSNFYYTFHFLNLTSRQPLSTVNATIWEFCQRPWKLVEASYPGQDRWLRDYCASGLYILTLLHEGYGFSEET

SEQ ID NO: 1018694 - protein, 128 aa, Homo sapiens
SKGRYTVRSCGIRRNRRIAVPCAVRGAKAEEILYKGLKVREYELRKNNFSDTGNFGFGIQEHIDLGIKYDPSIGIYGLDFYVVLGRPGFSIAGKKRRTGRIGAKHKISKEEAMRWFQQKYDGIILPGK

SEQ ID NO: 1018695 - protein, 33 aa, Homo sapiens
MVARAGAWPGPGAWHGRPAEVQRALWCRTLRGR

SEQ ID NO: 1018696 - protein, 290 aa, Homo sapiens
LEHVGQHALARIEENRFQCDICKKTFKNACVKIHHKNMHVKEMHTCTVEGCNATFPSRRSRDRHSSNLNLHQKALSQEALESSEDHFRAAYLLKDVAKKAYQDVAFTQQASQTSVISKGTSRMGSLVYPITQVHSASLESYNSGPLSEGTILDLSTTSSMKSESSSHSSWDSDGVSEEGTVLMEDSDGNCEGSSLVPGEDEYPICVLMEKADQSLASLPSGLPITCHLCQKTYSNKGTFRAHYKTVHLRQLHKCKVPGCNTMFSSVRSRNRHSQNPNLHKSLASSPSHLQ

SEQ ID NO: 1018697 - protein, 108 aa, Homo sapiens
TAAVAGVLDGSGEPPGSITGLVYSSNFQNVKQLYALVCETQRYSDVDWMPVISSCRASSVLKKLTDAPGQGVLVRGGEVNPDWSVALSSGFSPDAVHCGDLEQVAQLK

SEQ ID NO: 1018698 - protein, 132 aa, Homo sapiens
HRRKSSPLHFAAGFGRKDVVEHLLQMGANVHARDDGGLIPLHNACSFGHAEVVSLLLCQGADPNARDNWNYTPLHEAAIKGKIDVCIVLLQHGVDTALRNTDGKSALDLADPSAKAVLTGKKTESYRMIISV

SEQ ID NO: 1018699 - protein, 150 aa, Homo sapiens
MQVQGTEIPPWAMWMLQPLWATDLGVGKKAAGEVVLLKSWIWGWVASLPKEISLRMVLHFFLRDKVLPWCPGWLHTLGSSDPPASASKVAGRVASAAPFRVVEASVLTHCDGFLLYGVPLLQKFTLSHYTGVSEAKVLKMGVFWFWFSHM

SEQ ID NO: 1018700 - protein, 175 aa, Homo sapiens
ASKQADVNLVNVRLLVKKAGLNVTPLQSLAAPGEQGFGECLLAVALAGAPSRAVGLVQGTTPVPQGLNGAVFRPEVPLRRDLPLLLFRTQTSDPAMLPTMIGLLAEAGVRLLSYQTSLVSDGETWHVMGISSFLPSLEGVEPAHVTEAFQFHFYPWSSLVPAFGAFLKKPPPCDQ

SEQ ID NO: 1018701 - protein, 122 aa, Homo sapiens
ASKQADVNLVNVRLLVKKAGLNVTPLQSLAAPGEQGFGECLLAVALAGAPSRAVGLVQGTTPVPQGLNGAVFRPEVPLRRDLPLLLFRTQHVTEAFQFHFYPWSSLVPAFGAFLKKPPPCDQ

SEQ ID NO: 1018702 - protein, 182 aa, Homo sapiens
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 1018703 - protein, 138 aa, Homo sapiens
MIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 1018704 - protein, 156 aa, Homo sapiens
RGSQLPGKAGFWFFTLLGMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 1018705 - protein, 175 aa, Homo sapiens
LCHVQVPASPSAMSKNSLRPPQKPSRCWSHACRACRTMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 1018706 - protein, 138 aa, Homo sapiens; identical to SEQ ID NO: 1018703

SEQ ID NO: 1018707 - protein, 147 aa, Homo sapiens
SSGNYSLILHRYTFWGYMMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNF

SEQ ID NO: 1018708 - protein, 111 aa, Homo sapiens
MNNAGHGPTRRLRGLGVLAGVALLAALWLLWLLGSAPRGTPAPQPTITILVWHWPFTDQPPELPSDTCTRYGIARCHLSANRSLLASADAVVFHHRELQTRRSHLPLAQRP

SEQ ID NO: 1018709 - protein, 32 aa, Homo sapiens
MILRVDYGHVNLQKSFTYIIQTHYVVPTLATS

SEQ ID NO: 1018710 - protein, 92 aa, Homo sapiens
PGGKAAHTMEEKRRLLQNKRKEPPENVAQRAARLKTFPFKRFKEGPCQPGGQCCYSPSPPTPRVFADAAPDCPKTSNQTPPGPGAAAGPGID

SEQ ID NO: 1018711 - protein, 70 aa, Homo sapiens
IFQMDRQSVVVAKPLNLALPAVRGMAICKLQTIGIIHLETELRLLAPGSVDPREEHGLAGRLDVATDNTP

SEQ ID NO: 1018712 - protein, 105 aa, Homo sapiens
MGLGLLAKEVGRCRGAHRPYSAARSGRPLILPLQGVQLQDEASPTRTPDSGDPSVCGRPAPPKRRPGSAEAPSRICRSAIQDLPKRRPGSAAARKSPTIEDSGGT

SEQ ID NO: 1018713 - protein, 136 aa, Homo sapiens
GTSNIKAAWGKIGGHGAEYGAEALERMFASFPTTKTYFPHFDVSHGSAQVKGHGKKVADALANAAGHLDDLPGALSALSDLHAHKLRVDPVNFKLLSHCLLVTLASHHPADFTPAVHASLDKFLASVSTVLTSKYR

SEQ ID NO: 1018714 - protein, 108 aa, Homo sapiens
EIMWLHSAIITLKTDFKPHCHFSIKPDDPEDRPLQKVGYTLFQLQCWPHYHGNLVEAPTLLLVPACAPQLGTCISSEQRVSRWLLLLVPKEELGTLQQTAGFPAGEQE

SEQ ID NO: 1018715 - protein, 122 aa, Homo sapiens
AAAKDFCIPLTPPENPGLPSSGLSDSRLLLNHGEQPWRCRSQLDPRSLEKEMRFSTRGRPWLPSSGICKMATSSEIMGRGMARGQRSRPSSINLSIWAQNRHFWIFPSFPTPRMRLSKDVLN

SEQ ID NO: 1018716 - protein, 296 aa, Homo sapiens
VCRHFKSLERYCKETPRPSVPEIFDHIQDVQTPSISYLAYQGAGFVHNHFSDSDAKMFQTCVPQPSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 1018717 - protein, 114 aa, Homo sapiens
MACVDINECDKAKAASPLCVNARCLNTDGSSAFAARDLHPRTNRTIVGPHGPGLKPWHPLAAHPRPPLGAPAAHPAARLWVCARGRPPGPGKGTYGRLEIATPCTAPASTRASH

SEQ ID NO: 1018718 - protein, 101 aa, Homo sapiens
MALLVLLREALLEALDGFAQILADVAQTLGAEDQHDDRQHDQPVPDAETAHGVARGGKEGSKDNAAPAGRRVTARPSGQRFDLGRALDGLERLLCGLGGGR

SEQ ID NO: 1018719 - protein, 200 aa, Homo sapiens
MSTQLNHASLIRCPSHQLAQSVPMVKGTFMLMQEQWNICHMLPPPAKGCCAQLAVHRPDSTAQYTGRHRPPFPSKQQVADEDEIWKQRRRQQSEISAAVVRARKRREEEERRMEEQRKAACAEKLKRFDENCAILKNTHLQRKFGEGGQKKNRGLGKDFEKDQDQGRGRGGEKTKGNHQEKEKELEREQEKQREMEKERK

SEQ ID NO: 1018720 - protein, 118 aa, Homo sapiens
MSLPPRSLSGGLRKSKERPKETSEQGELMASFLWGWRDNPEMNRAGRPPLRAAPIVPPGAGLPPPPPPLPPPPPPRFVEEAEEQESTCPICLGEIQNAKTLEKCRHSFCEGCITRALQ

SEQ ID NO: 1018721 - protein, 69 aa, Homo sapiens
FFSPLQNFFEERGKGKATPLPPPPPPRFVEEAEEQESTCPICLGEIQNAKTLEKCRHSFCEGCITRALQ

SEQ ID NO: 1018722 - protein, 137 aa, Homo sapiens
SPGPAVSLRCSAGRGRTLPPQLIPGQRLHATVPGSANPCLAVMVLVISLAAQVQSPRRAGPITGPLPLPLLLLLPFGPPPPAKPAPEAALPSAATRGRAGALRALEPADPASVSWEGPAPAQSTHGNKGQAATVSTG

SEQ ID NO: 1018723 - protein, 106 aa, Homo sapiens
PKKNLAVLDDEKYGTDGLKQYANTSVPALKTALLSDSFLGLQPYGRQPTWCYSKYIEALEQERILLKIQEELEKKLFAGLQPLTNFKASSSTMSLKKNMSAHSSQK

SEQ ID NO: 1018724 - protein, 119 aa, Homo sapiens
MAPLHSSRGDRHSVSKKKRGVQGGSLKPYIEKVRHSLNATRCDILFNIVSGCPSNIFPSHRIKPRVFMSYKPYETWVPHSLWEPKFLQLSPSGTVLVALTKPSPQMLHSFHLPFPQLQC

SEQ ID NO: 1018725 - protein, 117 aa, Homo sapiens
STSIGIKDSNGRYVAALCMNLDLSLFQSMQSAMGQFTNVVKNGVTENLDTSNADAIRQRIDEFAARQAMTPRALKAEDKRLLLRELKGTGYLEVRKSMEVIAQHLGVSRAAAYSYVK

SEQ ID NO: 1018726 - protein, 99 aa, Homo sapiens
TQAPAPASEDEKVVVEPPEGEEKVEKAEVKERTEEPMEKSPKAEVKERTEEPMETEPKGAADVEKVEEKSAIDLTPIVVEDKEERRTRRRREKRDGGFT

SEQ ID NO: 1018727 - protein, 110 aa, Homo sapiens
KQFLVGKKPKSPDRLKVKSEKEPKVEDSADDFMMGASIKDWDKESEGEEPCWWQGKGRSQPLSGRREHSSSAANDPTVGSLRMAICQMLGLPENLCSRVPQVQTVLKLYF

SEQ ID NO: 1018728 - protein, 84 aa, Homo sapiens
AEAPLDTARSCSCLHIPATGEEGQLLQRQPWPWALSPSERLPSVRHRPTSVSALGHVPGVSSPSSACLKSSPTSQQSEKWASIT

SEQ ID NO: 1018729 - protein, 130 aa, Homo sapiens
SNWAWRAFSSSVVALMVACGEKGAHGGTRELGPAVEGEAAGMRRRPRPLTAVMSPSPAAQCPGDGAQALHPGSESPSVPQGPAAWTPRPPSRRPACASVQSVRRAPVQNGQRRGLPPAPGTMACVLFTAH

SEQ ID NO: 1018730 - protein, 130 aa, Homo sapiens; identical to SEQ ID NO: 1018729

SEQ ID NO: 1018731 - protein, 110 aa, Homo sapiens
CVQSVPNCPVGSCPWGGLVPLQGLGHLALLEQTLCAPHPPPSILAQYQPLPFRGWGRGTQALPASSLVHRVLWGPQAPPVPPPIHSAWGVVPPGLQDKSGPPLCLPPSPL

SEQ ID NO: 1018732 - protein, 180 aa, Homo sapiens
MAGVKYPGQDPVDLDIYQSSHMVDYQPYRKHKYSRVTPQEQAKLDAQLRDKEFYRPIPNPNPKLTDGYPAFKRPHMTAKDLGLPGFFPSQEHEATREDERKFTSTCHFTYPASHDLHLAQGDPNQVLQSADFPCLVDPKHQPAAEMAKGYLLLPGCPCLHCHIVKVPILNRWGPLMPFYQ

SEQ ID NO: 1018733 - protein, 175 aa, Homo sapiens
MSTADLMENLREELTCFICLDYFSSPVTTECGHSFCLVCLLRSWEEHNTPLSCPECWRTLEGPHFQSNERLGRLASIARQLRSQVLQSEDEQGSYGRMPTTAKALYDDEQGGKRLRSPETMVQTECISPDEAAGRHQQQRNSREMLESSQPCKENTEAPAGLTHEKERGENVPRQ

SEQ ID NO: 1018734 - protein, 145 aa, Homo sapiens
GDDGAPPQHAGAQHRGLGHADDGQVEQFSRAQQARVAEGSDDRRIDVRVMLGQHLTARWRRRSAARRGWRYRPPRVGRSGARVRCRARRHAGRGHQGAVMPSLVLGFRTRMRMVSRDASRVQRAAVSAIGVSAGGQQLLDEARGR

SEQ ID NO: 1018735 - protein, 97 aa, Homo sapiens
RVLHGDLGVVITSGQLTSPTFGDPFPVLLVESWGEAVGAAWNSRSGPTGAQSYPLLITEGGGPRVRSWSKPGGNWNTKFALLLEEFKELLLTPAFVI

SEQ ID NO: 1018736 - protein, 106 aa, Homo sapiens
ARGSWPPGGGVEAPRSGSRVLSATTPQCEDSPRRSPWELRGSCSGWGEGRGAAQRVRPGLKSRGVLGHTEPCLRVLHGDLGGNWNTKFALLLEEFKELLLTPAFVI

SEQ ID NO: 1018737 - protein, 106 aa, Homo sapiens
SSICPDASCGPSVRAALSWLSLCPGLGHGPPRPTHSRPGAVSEEAGRSRQLYPWPECQPPQARGLAGQNLVGEGEDCCGHRPPEGQGPQNLEGGKGWEQVWSGARG

SEQ ID NO: 1018738 - protein, 68 aa, Homo sapiens
ARGNGSGSPRIWGWERDCTDCFKKMADKPDMGEIASFNKAKLKKTETQEKNPLPTKKTFEQEKRSEIS

SEQ ID NO: 1018739 - protein, 68 aa, Homo sapiens; identical to SEQ ID NO: 1018738

SEQ ID NO: 1018740 - protein, 115 aa, Homo sapiens
FVLVNHDFTPLEILWTFSIYLESVILPQLFMVSKTGEAETITSHYLFALVYRTLYLFNWIWRYHFEGFFDLISIVAGLVQTVLYCDFFYLYITKSPKGEKVFSGNTPLNILGSGK

SEQ ID NO: 1018741 - protein, 115 aa, Homo sapiens; identical to SEQ ID NO: 1018740

SEQ ID NO: 1018742 - protein, 143 aa, Homo sapiens
MCECLPHMRGVLRLGSVLFRTSTLTPCLPSVLWRVLRGLERLAYLLMCTAWQLSRLTPGLLCLCLPRPVPLVAGAGVHLLLTFILFFWAPVPRVLQHSWILYVQLPLGCGSALNKTGLSTLLGILYEDKERQDFIFTIYHWWQ

SEQ ID NO: 1018743 - protein, 216 aa, Homo sapiens
QYQKNQNNKIPTQQKNTTTLDHKDKEKTKNKKKKNAPPRTRPGGHDPHRTGIEVLPVAERTRLVLKAKGIRHEVININLKNKPEWFFKKNPFGLVPVLENSQGQLIYESAITCEYLDEAYPGKKLLPDDPSCSTQLASTACIFSSCFLKVPSLASGKLSFRQPQIKDSTMLALQRQQFRQQHIYQAQQEVLTNQAQHDLLGGNSISHDRLPHLALV

SEQ ID NO: 1018744 - protein, 111 aa, Homo sapiens
KEKKNNNTHIRPTTEKNMITMDDVREEDLAPFSLRKRWESEPHPYVFFNDDHTTMTFIGFHLQPNINGSVDAISHLTGKVIKRDVMTRDLYQGLLAQEVPFNVDFDKLPRH

SEQ ID NO: 1018745 - protein, 70 aa, Homo sapiens
YADTVIDAARAGIVTEALRGTFWKSVWTNIFSGALYTVILIVFALILSKSGIDLLGIFEHMTKTAPATGG

SEQ ID NO: 1018746 - protein, 139 aa, Homo sapiens
MTLINGLWSKVNVEEVGGEALGRLLVVYPWTHRFFDSFGNLSSASAIMGNPSVKAHGKKVLTAFGESIKNLDNLKSALAKLSELHCDKLHVDPENFKLLGNVLVIVLASHFGNEFTAEMQAAWQKLVAGVATALSHKYH

SEQ ID NO: 1018747 - protein, 56 aa, Homo sapiens
APKNNGPGNGPGHAGRASLCCLPLWAPASTLWLKKVPPFYVPYPPICDYNKFFIPV

SEQ ID NO: 1018748 - protein, 33 aa, Homo sapiens
MNLLDKSPAPHYEDHCPPALCSPHCAARPHPYW

SEQ ID NO: 1018749 - protein, 143 aa, Homo sapiens
LVSGPGHEGLISMKGVIREDLMCGVWSAGTWSMWAAEHCLDKPGAMCIIEGPVDSWDSPVMAKGLVKSGQSTCLDGPGRSCSEILKDKGKGRARVAAEMVTVYGLHRMKEARKQAGWAVGVQGEAGACWEVRPCEGFGGVRLG

SEQ ID NO: 1018750 - protein, 148 aa, Homo sapiens
ARQQHVAQVRDVAEGQAQRLNLGELAAAGSVGISVRSAVKAVFTLLVRSRSRAFAVLPLPGLTAWPAPWPPAPGPPAPRPPPGALEAAARRVHATGFLVGARAVAAAVLVLRQRAHLGVQVAARRRRAQRGEGHGAGGGAASALSRAA

SEQ ID NO: 1018751 - protein, 291 aa, Homo sapiens
LRSSGEGPYSSLVSCRNHQDVAIEPVQSVLRMSVSSIGGPTLDSVSIEAWHESRTADDLEAVLHGVIWTGSTDARTELSWALMHADTCLVYTPKTSDCCVIDESFGNPRSLYRYNGEWRATGPAGGLSWEAIINLATQPKRPMSIPIIPDIPSRWDAQSGEDYKSLPYVQRCTCYDSPSGTQRPSVSDDTEHLVNGRMDFAFPGSTNSLHRMTTTSAAAYGTHLSPHVPHRVLSTSSSLTRDYNSLTRSEHSHSTTLPRGLLQPHLVSSHGLPPIWEHGREQASAVWAWGP

SEQ ID NO: 1018752 - protein, 260 aa, Homo sapiens
LRSSGEGPYSSLVSCRNHQDVAIEPVQSVLRMSVSSIGGPTLDSVSIEAWHESRTADDLEAVLHGVIWTGSTDARTELSWALMHADTCLVYTPKTSDCCVIDESFGNPRSLYRYNGEWRATGPAGGLSWEAIINLATQPKRPMSIPIIPDIPSRWDAQSGEDYKSLPYVQRCTCYDSPSGTQRPSVSDDTEHLVNGRMDFAFPGSTNSLHRMTTTSAAAYGTHLSPHVPHRVLSTSSSLTRDYNSLTRSEHSHSTTLAKE

SEQ ID NO: 1018753 - protein, 105 aa, Homo sapiens
MTFYDSPSGTQRPSVSDDTEHLVNGRMDFAFPGSTNSLHRMTTTSAAAYGTHLSPHVPHRVLSTSSSLTRDYNSLTRSEHSHSTTLTEGHTPTVTSVILPNEISA

SEQ ID NO: 1018754 - protein, 83 aa, Homo sapiens
ITEEFVQMNYLKDQRVPYVEPPEYEFWGSRASRGITMQMELARVFKKDPQAWPSRNREALEEARAPREANPTAHNPRSSVSEH

SEQ ID NO: 1018755 - protein, 100 aa, Homo sapiens
NPSGIKKRWILANGPWAPPPHPWFGPLLAKALFPEPPPNKMGASPLACLGFSPNPFKWGGEKEERGGGLPPPQGFGRALPPWAFPFPGGSLPDPFVKNKP

SEQ ID NO: 1018756 - protein, 98 aa, Homo sapiens
PRSVLRRIRGSAQAITNSALVKDEILTAALSFVEPQPLAVVASHAADGSLWSSVLFGRPGFVRAVDTHEVRIDLSGAHLIPGDPVLQNLQDDPRVGML

SEQ ID NO: 1018757 - protein, 94 aa, Homo sapiens
VAGTLEDSPTVVYRRTVVLPSYCGVTVVLWCYRRTVVLPSYCGVTVVLWCYRRTVVLPSYCGVTVVLWCYRRTVVLPSYCGVTVVLWCYRVNEG

SEQ ID NO: 1018758 - protein, 412 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKVGLFSCCLYL

SEQ ID NO: 1018759 - protein, 475 aa, Homo sapiens
MLESYVTPILMSYVNRYIKNLKPSDLQLSLWGGDVVLSKLELKLDVLEQELKLPFTFLSGHIHELRIHVPWTKLGSEPVVITINTMECILKLKDGIQDDHESCGSNSTNRSTAESTKSSIKPRRMQQAAPTDPDLPPGYVQSLIRRVVNNVNIVINNLILKYVEDDIVLSVNITSAECYTVGELWDRAFMDISATDLVLRKVINFSDCTVCLDKRNASGKIEFYQDPLLYKCSFRTRLHFTYENLNSKMPSVIKIHTLVESLKLSITDQQLPMFIRIMQLGIALYYGEIGNFKEGEIEDLTCHNKDMLGNITGSEDETRIDMQYPAQHKGQELYSQQDEEQPQGWVSWAWSFVPAIVSYDDGEEDFVGNDPASTMHQQKAQTLKDPIVSIGFYCTKATVTFKLTEMQVESSYYSPQKVKSKEVLCWEQEGTTVEALMMGEPFFDCQIGFVGCRAMCLKGIMGVKDFEENMNRSDN

SEQ ID NO: 1018760 - protein, 124 aa, Homo sapiens
RYPRCHNTVILGLSSAAVKWLNPVSTDTTNFSPGQHAGNAFQTHLRQYFNISKSFRQSFRPFFLMRRAHGSLIRIPESASKPINSRQCSSGQCLSSTGRRMKELRHIRPASCRQVRLEKCCAIA

SEQ ID NO: 1018761 - protein, 234 aa, Homo sapiens
MARLSVSLALQGTCPNGCLASAAAVICLQGNWGVRKLGTHINMANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVPEADLLKTSGTLISAIYPSQNPELLNKLSQGKSTDLGNGPGSKKSQLLRDMMR

SEQ ID NO: 1018762 - protein, 70 aa, Homo sapiens
QRRMGRKPGVLPWRDFRLAGPAGHMPNGCLASAAAVICLQGKLGSQKIGNSYQHGKPIENSGDWLLVSST

SEQ ID NO: 1018763 - protein, 248 aa, Homo sapiens
MRSARGQGPACAQRDVLSRTSGHSRMGCGLSAGLLAFMGSGESENGERRYSIYGQIRSGKILVVTCGVSCTLVSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVPEADLLKTSGTLISAIYPSQNPELLNKLSQGKSTDLGNGPGSKKSQLLRDMMR

SEQ ID NO: 1018764 - protein, 165 aa, Homo sapiens
SAFIGGGNMARSMIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPEYSSPARCRRDRTIRHLSTPRPHNAPAEELFNRRKARPWTEGSVNGRRD

SEQ ID NO: 1018765 - protein, 143 aa, Homo sapiens
SAFIGGGNMARSMIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPEYSSPLLRLPRALYLCTPPLSNYLVRL

SEQ ID NO: 1018766 - protein, 173 aa, Homo sapiens
LANVLLAGKASGAGQPCHSTPAFFYAARAGSPPPPPPPPPARDGENTQPKQICTFCLSNQKKVEQGPRQKDSDSQLGGGRQQPGGRRCWGRWTPGVTADSPHLGPELGKAHRKHAPRPALAASGAEGQTDVQTGAGSGTLRWPQHLPGPTGTFCAGFSSGHCVMASCVFDMII

SEQ ID NO: 1018767 - protein, 98 aa, Homo sapiens
SRGIQMSLKLPPVWGLPRLHGIEPNEVNVTLPLGERVGHTLALGTTRVGKTRLAELFITQDIRRKDAEGEHEVVIVFDPKGDADLLKRMYVEAKRAAA

SEQ ID NO: 1018768 - protein, 85 aa, Homo sapiens
WDEVRSESFRFVIIDEAFGRGERVGHTLALGTTRVGKTRLAELFITQDIRRKDAEGEHEVVIVFDPKGDADLLKRMYVEAKRAAA

SEQ ID NO: 1018769 - protein, 102 aa, Homo sapiens
MRCVQNQFRFVIIDEAFGRRSDESAEYGLRLFQKLNLQLLIVTPLQKIHIIEPFVFSVGFVQTRAGCDSQLRCLSDLRSTKPGRQLETHRGILLEVDLGHKA

SEQ ID NO: 1018770 - protein, 224 aa, Homo sapiens
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLRGYRYVILDIPLLFETKKLLKYMKHTVVVYCDRDTQWHRDAADSLNRKDAEARINAQAALTDKARMAAMSKTTRAKWSVTKPPGQSSLHTELERFLEYLRLRLGSSQGSLALAASLLVPH

SEQ ID NO: 1018771 - protein, 132 aa, Homo sapiens
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLREPRTSPRGKKHVPSALKEADSLMRRDT

SEQ ID NO: 1018772 - protein, 132 aa, Homo sapiens; identical to SEQ ID NO: 1018771

SEQ ID NO: 1018773 - protein, 224 aa, Homo sapiens; identical to SEQ ID NO: 1018770

SEQ ID NO: 1018774 - protein, 114 aa, Homo sapiens
MATVTALRRTVPPAVTGITFLFGGQSEEEASINLNAINKCPLLKPWALTFSYGRALQAFALKAWGGKKENLKAAQEEYVKRALAHSLACQGKYPPSGQAGGAANESLFVSNHAY

SEQ ID NO: 1018775 - protein, 140 aa, Homo sapiens
FFPPGWGEWVLTSCVPLGSGPRVLAPGTVVVLWLQGSQEFPPKKFFFWAFRQGPSQGPPPLFFDQLFGGGTQGVEKGGPLFLLGGPRGPSVGLSPEGLCPFGGLTPPCPFVCCFGGGGGALVFWPPPCPPPWFNSLFPPA

SEQ ID NO: 1018776 - protein, 102 aa, Homo sapiens
DESQAAARLGLIDESQAAARLVRRTRGAESLRPAVHAVRSVTARRGASHARWSGWHGPSRSGLDARESVAVSTMLGRRVFPWSGAVSAMRLPALAVVSAVAG

SEQ ID NO: 1018777 - protein, 271 aa, Homo sapiens
EVPGCRTHRLAQFPGLSFLREADSGRVGEAQREGEAPPGPLDRPDGPLRPRGPGTRSLDTLLIVPGHGSLPSARSSPRPRASGRAIGRAGRGGGGGDLIAVPRGRLAGAESQVPLTGAPPDRARAAQGPGAGPGDWGRNRQLFLEGPFPGVQRDQAFLGRGVTPQRVACVLAVEDASVPRTSFSRKPGTLQPGQGQVLEGLTHPPIGGRHTSPPRWQTPHPPHSSGQTGTAATPERKASSHNTPRKSNKTLATARGTDKPRTTTQGETKTH

SEQ ID NO: 1018778 - protein, 102 aa, Homo sapiens
GTRTGVTGRPSGADMGTLKPQHNAEGALPRLCISEDQVLHPARDSGLSWSCGPYPEVESVERTSFHTPMIASPTSQPHPPSSHLPTKLSLKTLVSEFSRRVN

SEQ ID NO: 1018779 - protein, 121 aa, Homo sapiens
RHPTVAAGKPSPPHQTARRVHHSAHRPALPQPSPSIASHRQNAAPSDLDSPRRYLGWPQSLDSDPDSWPPPKGFVTFSETYFLPTPRNLLCFCLGPGVPGSQIESLIFSCGPVSFAHNPVF

SEQ ID NO: 1018780 - protein, 98 aa, Homo sapiens
DAQLSIAHDARKARIASSVGNIQMTVGIGSGTKQGVGGGDDRLFGSTKYSTNNRHTGLRGVHAILIRRQSDLASLDVFGTQRKRLSHSDHDLGSIDLD

SEQ ID NO: 1018781 - protein, 120 aa, Homo sapiens
MSLKLPPVWYNNAKFGIFIHWGVFSVPAFGSEWYSRNMYQQGSKEYQHHLATYGPQNTFGYKDFIPQFTASTFDPNAWATLFKQAGARYVVPVAEHHDGFALYDSHLSDWTAVKTGPKRR

SEQ ID NO: 1018782 - protein, 311 aa, Homo sapiens
YFQQRVLCHNLTVNFFSLLLISPNLQGNYTCLALNQLSKRHRKVTTELLVYYPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLNQPEVIIQPSSASHYPGWQNSNLTIHKCSQDLDEGYYICRADSPVGVREMEIWLSVKEGEIWGDSWEPNVEPPFCWDWTLSQGLLLHYSPVFCWKGRKHFQGDKNMDDVMVSVDSEEEEEEEEEEEEDAAVGE

SEQ ID NO: 1018783 - protein, 302 aa, Homo sapiens
FPAASPLPQPDSQLFLTVTDIAKPPGELHLFSLESAQQETSKDPPPSAPQCWAQMASGSFMLQLTCRWDGGYPDPDFLWIEEPGGVIVGKSKLGVEMLSESQLSDGKKFKCVTSHIVGPESGASCMVQIRGPSLLSEPMKTCFTGGNVTLTCQVSGAYPPAKILWLRNLNQPEVIIQPSSASHYPGWQNSNLTIHKCSQDLDEGYYICRADSPVGVREMEIWLSVKEGEISGGLGEPNVEPPFCWDWTLSQGLLLHYSPVFCWKGRKHFQGDKNMDDVMVSVDSEEEEEEEEEEEEDAAVGE

SEQ ID NO: 1018784 - protein, 86 aa, Homo sapiens
PCLENFKKLSDENSQKTQEYDITTDTEPGVMTVQVKEHQGSPAATQPRKRILLLKSLYFGTYEFQPCPSYPVGVKIPGRTLFPRCN

SEQ ID NO: 1018785 - protein, 134 aa, Homo sapiens
KAWDCLQSSSLPLGLQCREQPAPPLCRNHFNHFLFHDCTALTGLPPAQTADSPWSGRSRLLPWPLTEFCLLIRKPKWRLKISVFLISRDFTSVKQNCLETWVIFVVFCGELFCYDFWPVYFILNLVLNKSCIKI

SEQ ID NO: 1018786 - protein, 397 aa, Homo sapiens
MTYHETRALAQSDLQQLYAALETTEFGAYFATPADDTLRFGIGAIATAKTAQALQGAVVFGAQSFDEQEYPQSELMAGFWFVPEVMVTIAADKITFGSDTVSDFTTWLAQFVPKQPNTVTTSHVTDEVDWIERTENLIDTLAIDQTLAKVVFGRQQTLQLSDTLRLAQIIRALAEQANTYHVVLKRHDELFISATPERLVAMSGGQIATAAVAGTSRRGTDGADDIALGEALLASQKNRIEHQYVVASITTRLQDVTTSLKVPAMPSLLKNKQVQHLYTPITGDIAAHLSVTAIVDRLHPTPALGGVPREAALYYIATHEKTPRGLFAGPIGYFTADNSGEFVVGIRSMYVNQTQRRATLFAGAGIVADSDAQQEYEETGLKFEPMRQLLKDYNHVE

SEQ ID NO: 1018787 - protein, 154 aa, Homo sapiens
MACTISCAEENGGFDLILGAVSSRRVCLLLRRGLCCKLCCQLQVRGHNSAQSGNWRRPVTAWNMAECKELGTLMVPLRESGTVLTMPPGGSGSGMWIFRGEIWGYSGRSGECWGLFFVIERRELDLDGRAGKPEGTLLGQKPVKLVAENEKERN

SEQ ID NO: 1018788 - protein, 114 aa, Homo sapiens
CSFSTAHTLRDLALPGATPLPLSWLQGGRAASLEGPVHEDAVLAEAAQVEVRLLEAELQVAPRDEAGQAHAQVHRALRRVAADGDAGLAHEELELAALQPRQRRPRALPYRGGR

SEQ ID NO: 1018789 - protein, 229 aa, Homo sapiens
MACTISCAEENGGFDLILGAVSSRRVCLLLRRGLCCKLCCQLQVRGHILHKAVTGGDRHRVDMAECKELGTLMVPLRESGTVLTMPPGGSGSGMWIFRGEIWGYSGRSGECWGLFFVIERRELDLDGRAGKPEGTLLGQLQGGRAASLEGPVHEDAVLAEAAQVEVRLLEAELQVAPRDEAGQAHAQVHRALRRVAADGDAGLAHEELELAALQPRQRRPRALPYRGGR

SEQ ID NO: 1018790 - protein, 132 aa, Homo sapiens
GRKPCHNDAHLLPAEIIQQASLKAPNYCGPIDHCELAQVPPLLRDGGYATEFTVNAALHGVGTPVTPTRGHKVLLQLSQSSEAHGLSPTLYLEGSERADFLAEYRGVSLSCACITIASRERLPMMRWTRDME

SEQ ID NO: 1018791 - protein, 84 aa, Homo sapiens
RYTLEKEDSSVAFAFQALSKFFLHLCGLCPRLPKDISFTSWIVCKEKQGEAGVEARRNKGRAGDKGSRLADTQGPVGVSLPCGR

SEQ ID NO: 1018792 - protein, 163 aa, Homo sapiens
RAFSNGRQRPQDSKPWALTSASPLGGPASLSFELSRHTCFGLQVRFLRVAFRPFGNANPPKWVGHLNPNAYVIWILGSPNEDPAKVAVCSTGGQLFLFQPPGLRTLNLGRKSPQFQDQEGAMGPPFLWYFMQEGLQWVRTSKPNFYFEKLAGQYFKKKCPEGS

SEQ ID NO: 1018793 - protein, 68 aa, Homo sapiens
MRVLALRFLACWERGCIGTRARIHACTGTQWVVFTDPRRCGSANPYTVYLVTPHFLVYLCDAYCTVLW

SEQ ID NO: 1018794 - protein, 91 aa, Homo sapiens
MQHRDGEGDALLVSALGQCSACHEGAGLAFSCVLGAWLHWNRGRGFMPALRTQWFVYTDSRRCGSANPYTVYLVTPHFLVYLCDAYCTVLW

SEQ ID NO: 1018795 - protein, 187 aa, Homo sapiens
MPGHLPQRHAAPLLIRSVFPWCPGERSRQKVRVYFLLSSTQSPTAANARGQKMFGGRKTKAGSGGGLTVRVCLQRREGAGSVSSCFSKLQGPGSPLQGRAPLLPARHWRWPPGEEKANACARLVRRKRLTRRFGQQNRPSLSEASSDLARKVGEGGLAQSLRDPPLWGLPSLSLTLLSTAFAGGISE

SEQ ID NO: 1018796 - protein, 187 aa, Homo sapiens; identical to SEQ ID NO: 1018795

SEQ ID NO: 1018797 - protein, 96 aa, Homo sapiens
KQELNEPPKQSTSFLVLQEILESEKGDPNKPSDSEVVKAPVTKVAASIGNAQKLPMCDKCGTVLQQASAAAFSLSVALSSLESSLPTLVFPLLVKH

SEQ ID NO: 1018798 - protein, 235 aa, Homo sapiens; identical to SEQ ID NO: 796183

SEQ ID NO: 1018799 - protein, 106 aa, Homo sapiens
ASEEMLVDCVPLVEVDDMMIMGKKPDPKCVFPYVQSLYNHPGTPRTGPARQECLACPPAWPASGKLPPPLSGPRFLPGGPPPAALFVGTPLPPPYTRRVLINYWFS

SEQ ID NO: 1018800 - protein, 77 aa, Homo sapiens
RSTRHLKRLALMIQSSGNTVLLLILCMQHSFPEPGRLYLDLILAILALELICSLICLLIYTVKIRRFNKAKPEPDIL

SEQ ID NO: 1018801 - protein, 67 aa, Homo sapiens
KHMGIISILLLKVIAKIWFSKSKKLQPSGINGLGGHVMRNMGSFVIFSCRIGAVLDMADPDYKSIGI

SEQ ID NO: 1018802 - protein, 95 aa, Homo sapiens
VTVNASLSTRFIANVVLPIDGRAATMIKDGCKPAVLFVEIVITGVYPGNAIVWLLKQLLNTRHGCVEHIGDVLRPFVFVRTTFGNLKDAALTVTK

SEQ ID NO: 1018803 - protein, 106 aa, Homo sapiens
ASDTSAKNRVKSRLKKFFTRSPSLKTLQEKGLIKDQIFGFHLPKVCERENSPVPWFVKQCIEAVEKKGLDVDGIYRVSGNLATIQKLRFIVNQEEKLNLDDSQWED

SEQ ID NO: 1018804 - protein, 89 aa, Homo sapiens
ASDTSAKNRVKSRLKKFFTRSPSLKTLQEKGLIKDQIFGFHLPKVCERENSPVPWFVKQCIEAVEKKGGWLNVQQFPPFLPPLPNQYSS

SEQ ID NO: 1018805 - protein, 177 aa, Homo sapiens
ISSSCSPSWRMISEKENPMRELRIRKLCLNICVGESGDRLTRAAKVLEQLTGQTPVFSKARYTVRSFGIRRNEKIAVPCTVRGAKAEEILEKGLKVREYELRKNNFSDTGNFGFGIQEHIDLGIKYDPSIGIYGLDFYVVLGRPGFSIRKQKAQDRLHWGPTQNQQKGGPALVPAKV

SEQ ID NO: 1018806 - protein, 79 aa, Homo sapiens
PSPGPMTAFPEDPGHAAVPPHGQMDTQSLGGHLLARCERQAFPPRPFRRPNQGLCKRGGPGTQMPFRPGSWAGLWQAPP

SEQ ID NO: 1018807 - protein, 344 aa, Homo sapiens
GQLNHRHIRYTRCKDEWVLVQLTHKAALAGSSGAPGFEDSAPPCPFNPLCSGAIRANGEVNPQYDSTFLFDNNFPDLQPDAPSPGPSDHPLFQAKSARECVLCFHPCSGVTLQLLSVPIRAVVNAWAYTEELGAQYPWVQIFENKGAMGCSPHPNCQVWASSFLPDIAQREERSQQAYKSQHEPLLMEYSRQELLRKVPLVLTSEDWLGLVPFWATWPFQTLLLPRRHVRRLPALTPAERDVLASLMELLTKYNLFETSFPYSMCLGAPTGSEAGAYWNHLQLHAHYYPPLLRSATVRKFMVGYEMLAQAQRGLTPGHAAEKLWALPEVHYHLGQKDRETATIA

SEQ ID NO: 1018808 - protein, 119 aa, Homo sapiens
GQLNHRHIRYTRCKDEWVLVQLTHKAALAGSSGAPGFEDSAPPCPFNPLCSGAIRANGEVNPQYDSTFLFDNNFPDLQPDAPSPGPSDHPLFQAAEKLWALPEVHYHLGQKDRETATIA

SEQ ID NO: 1018809 - protein, 468 aa, Homo sapiens
MAPWLQLLSLLGLLPGAVAAPAQPRAASFQAWGPPSPELLAPTRFALEMFNRGRAAGTRAVLGLVRGRVRRAGQGSLYSLEATLEEPPCNDPMVCRLPVSKKTLLCSFQVLDELGRHVLLRKDCGPVDTKVPGAGEPKSAFTQGSAMISSLSQNHPDNRNETFSSVISLLNEDPLSQDLPVKMASIFKNFVITYNRTYESKEEARWRLSVFVNNMVRAQKIQALDRGTAQYGVTKFSDLTEEEFRTIYLNTLLRKEPGNKMKQAKSVGDLAPPEWDWRSKGAVTKVKDQGMCGSCWAFSVTGNVEGQWFLNQGTLLSLSEQELLDCDKMDKACMGGLPSNAYSAIKNLGGLETEDDYSYQGHMQSCNFSAEKAKVYINDSVELSQNEQKLAAWLAKRGPISVAINAFGMQFYRHGISRPLRPLCSPWLIDHAVLLVGYGNREFRCLSCIQPGHRQGWDHSISGPLEGK

SEQ ID NO: 1018810 - protein, 484 aa, Homo sapiens [sequence omitted]

SEQ ID NO: 1018811 - protein, 102 aa, Homo sapiens
LLLPGSEAQPSAPSTPRQLLASAPHGPWEEGQARGSLLQPGRPGLPVTLTPQQEQPAWWPSGARTPGGQRSHRNRPRPPPPRRTWRPPRRPVPRLPGRAASV

SEQ ID NO: 1018812 - protein, 69 aa, Homo sapiens
VIVPCPLSPTPPKRRPRPSTKPTKKKEGPRGTSERQGSGYFEFSIDIVKISAIWISCFLIFILVSQMND

SEQ ID NO: 1018813 - protein, 313 aa, Homo sapiens
HGSWEVKGETTDYTDQVQIDARDCPHISQRSQTESVSFWGNHDDSRALYAIPGLDYVRHARHPTPTRLHVIRFPSNMNSLKDFVLYDQIEAPPFVASGDAIGPVKRRICPWLELSRVVHRETIEEHYVSLVIPFYMGVREAQKYPRGIGGAFVSVWRTLSSDVVQLLERHWRIFSLSGTLETVRGRGVVGREPVLSKEQPAFQYSSHVSLQASSGHMCGRSFERADGIQVEVRISLLAGKNQDVKNTSGFTVGSGPVASLGYGKKFSPNVELSPLGQVLMRGATGGRETPTRGPGGANGTDAKGQKRPEETES

SEQ ID NO: 1018814 - protein, 79 aa, Homo sapiens
MAPGPRCPSTGCGRLGQAQASRSPCPPWLATEWPDAGFLLPLPPGQPPPFLVVGLGAQPTRHCHVCHPPAPTSIFQKFP

SEQ ID NO: 1018815 - protein, 47 aa, Homo sapiens
MERAISPGLLVRALLLLLLLLGLAARTVAAGRARGLPAPTKEAAFGL

SEQ ID NO: 1018816 - protein, 101 aa, Homo sapiens
VSRYCPRSANPAMQLDRFIQCATLLELEAFREKTAVQGNIRFSFGFVTTASRSFDPPCGWSAPGTPGFLEEKVHSSFPVPLEEHSPLLDGKLFQKRVKSPA

SEQ ID NO: 1018817 - protein, 329 aa, Homo sapiens
MFKDLLGLRRVGPAPGRTPPIRGREWSGPRPQCCWLLPGCWVQSAGFWVSGFAGRSHVACAGSSGESVRARCPGTARLPGVRGPRHSGLQIDGDPGCTARPRALTDGSKTWWERRCGDGSLRIPMPTSPRCSGSLEKQGLAGKAAPAVTKDHKQHEDPRGSWPSVGCRPSAFSTAAEVATGSRPGRHMWMMTLFGSPAGTRPTPPDFDPPWVEKANRIRGVGQEASKALGAEKGSCEINSSSRGSSPTAHTKEEEQIQTHQPLPVLPVMSRCLAPDLKAPAVGAPRNGEGGLPPKLPGSLVDATTYPQGVATRPAQGGTLRAITSWLKK

SEQ ID NO: 1018818 - protein, 81 aa, Homo sapiens
MFKDLLGLRRVGPAPGRTPPIRGREWSGPRPQCCWLLPGCWVQSAGFWVSGFAGRSHVAWPLPHHPLSCCQVRINGVIANL

SEQ ID NO: 1018819 - protein, 212 aa, Homo sapiens
MLKRKKKKLVKLFARRSLEKQGLAGKAAPAVTKDHKQHEDPRGSWPSVGCRPSAFSTAAEVATGSRPGRHMWMMTLFGSPAGTRPTPPDFDPPWVEKANRIRGVGQEASKALGAEKGSCEINSSSRGSSPTAHTKEEEQIQTHQPLPVLPVMSRCLAPDLKAPAVGAPRNGEGGLPPKLPGSLVDATTYPQGVATRPAQGGTLRAITSWLKK

SEQ ID NO: 1018820 - protein, 268 aa, Homo sapiens
MPYEAKGMLQFNKVLDLHIVTFNPQFCVDPYKLDKIRSYFHRACRKRDLNCETRACVKRFLVAREGEAFGKQGGFWAWARGNNLGVNPREPQGSMKTPVELAVSGMQTLGLQHRCRGGYRVKARTSYVDETLFGSPAGTRPTPPDFDPPWVEKANRIRGVGQEASKALGAEKGSCEINSSSRGSSPTAHTKEEEQIQTHQPLPVLPVMSRCLAPDLKAPAVGAPRNGEGGLPPKLPGSLVDATTYPQGVATRPAQGGTLRAITSWLKK

SEQ ID NO: 1018821 - protein, 168 aa, Homo sapiens
MRKVAILSLQGDERTWVWIQSPGGQCPPAGRLLSPRFSGAASPRPRLGPPSSSSSAAASSSSSGCSRLGGQVPALPARGRGRGRLLPAADRCAPAALPGPGVEAAEIPHDQRLQQQHRERREQRRVERRASLRAHGAATIFGARPASEARGPRHAPGRPRAPRSSRGR

SEQ ID NO: 1018822 - protein, 74 aa, Homo sapiens
ASVSSPPPLPLARRGDCTTAARAKPATSSGPTLSSHDDKSTFEETCPYCCQLLVLITLECSIKPKARLLSKSPV

SEQ ID NO: 1018823 - protein, 66 aa, Homo sapiens
MSAQPLVLLPPATRTYVPEKGHSISLGPEMRGHMELNLKMAHSRPAVNSQPLCNAGKEGNVNIIDY

SEQ ID NO: 1018824 - protein, 187 aa, Homo sapiens
TTNSVPITSNVMIPSEPRKPFEGLSMPKKTRKQPKRRKCLTDPKHTEAKSWAKFMNHVMESGKKAVAERIVYGALEKVKERKNSDPLEIFEKALDAIAPLVEVKSRRVGGATYQVPVEVRPSRRNALAMRWLVRLRPYSAGEKSMALRLAGELVGRLLKVKVLVVKKREDVPPYGLKPTKAFSHYRF

SEQ ID NO: 1018825 - protein, 165 aa, Homo sapiens
LKPAHRTNARGPGPGAKAPSPAPPRRRRRRRRLPSHPGGKTRRGETRGGLARDRAAGRAPTAFSAVPHPPHIHAGSTPARGERASRPQASHPLKPMGRTAPAPRPRGRGPQGRDPALSPSEQWTGCRGSPSPPDPRLARLLAASLWGPGVPIRGLCLDGRRQDAE

SEQ ID NO: 1018826 - protein, 68 aa, Homo sapiens
MYAAVNVFLHFPIFPVNIQYFRNSEYKRKRAREGRILPAGARGALAGSNEFSVSENLSLLTFSDSRGR

SEQ ID NO: 1018827 - protein, 74 aa, Homo sapiens
MCRSRGKPKAIVALEHTLLTVVWIMLTDNVVYDEPGADYYQHRHPERTKNRAIYDLHKLGYEVTITPHGAAHPL

SEQ ID NO: 1018828 - protein, 167 aa, Homo sapiens
AGEHRQPGPSRLQVPGFRAVAGSAQRSRARRRGEERQGRGVNAAAVSSPGPASSPTSRRHLTASGGLGSRETAGHLADEHRQWRAVETPGTTALRAITHPPAPPREPRPASPAAASPAPRAPPREPRPASPAPPSPAPPAPHRQPREPRPAPRAPRIGRVPAATPPT

SEQ ID NO: 1018829 - protein, 155 aa, Homo sapiens
AGEHRQPGPSRLQVPGFRAVAGSAQRSRARRRGKKGRVAAQRGGRLESRARVLPDLPTPPHGLRGTGLPGNRRPPGGRTQAVAGSGDARDHRAESDHSSASPAPRAPPREPRPAPRAPPRRAPHRRPRTASPASPAPPRALLALAESPRPHPLPD

SEQ ID NO: 1018830 - protein, 190 aa, Homo sapiens
PCGNVTGWSHRVCSLSRLAFHFVICISGFSMSFHGWKAHSFLALNSISWSAWTCHSSFLQSSAKGHLGCFQVVVIVNDAAIIIQCILSLPSTLAILRIPLHADITKTGPFYVHFSQHPWVTSLRGTGSSGRCFCWIQEGREVLSFGAGSEEPQLSAPFCLLWAAWSSHQPSHPTNACRTDRHMARARRLV

SEQ ID NO: 1018831 - protein, 81 aa, Homo sapiens
MEKTRHETVEKPHHQKPLPHAPSSPHLWMHGGLQAGLPPWTQEQAGKLLPHQAKGSGGGGGEARLAPAAVTVVPPHWPVRP

SEQ ID NO: 1018832 - protein, 72 aa, Homo sapiens
GCLEMKKGVGPVRKKKFKIRGVCYGATGTKVRQGPLKKGGYNVKGQKTIGVTKPCTPKTKAKAKAKKGKGKD

SEQ ID NO: 1018833 - protein, 132 aa, Homo sapiens
QEWTCGQTGGSGFSCQYFYGTYGPLSRPSSQARNRVQVGKQGTFISPTKCREALKVEEKKPYLMWGFSSDFWGEKPNLSYIIGKDTWVEPWPEEEECQDEENQKQCQDLGAFPEGMVVFGGPWPPPPFPHSR

SEQ ID NO: 1018834 - protein, 636 aa, Homo sapiens
LKGKGPLPMEAIEKMASLCMRDPDEDEEEGTDEDDLEADDDLLAELNEVLGEEQKASETPPPVAQPKPEAPHPGLETTLQERLALYQTAIESARQAGDSAKMRRYDRGLKTLENLLASIRKGNAIDEADIPPPVAIGKGPASTQTNVTQLGNITETTKFEKLAEDCKRSMDILKQAFVRGLPTPTARFEQRTFSVIKIFPDLSSNDMLLFIVKGINLPTPPGLSPGDLDVFVRFDFPYPNVEEAQKDKTSVIKNADSPEFKEQFKLCINRSHPGPLAQLQSRQRDYKLAALHAKQQGDTTAAARHFRVAKSFDAVLEALSRGEPVDLSCLPPPPDQLPPDPPSPPSQPPTPATAPSTTEVPPPPRTLLEALEQRMERYQVAAAQAKSKGDQRKARMHERIVKQYQDAIRAHKAGRAVDVAELPVPPGFPPIQGLEATKPTQQSLVGVLETAMKLANQDEGPEDEEDEVPKKQNSPVAPTAQPKAPPSRTPQSGSAPTAKAPPKATSTRAQQQLAFLEGRKKQLLQAALRAKQKNDVEGAKMHLRQAKGLEPMLEASRNGLPVDITKVPPAPVNKDDFALVQRPGPGLSQEAARRYGELTKLIRQQHEMCLNHSNQFTQLGNITETILANMVKPCFY

SEQ ID NO: 1018835 - protein, 220 aa, Homo sapiens
RSPSVYLGGSSLVTPQGSFENGHKISWLPSPLGPGFWDGFPIVLRVHSCQFGPTKGKTGHASPGGYWPMTTKRNFPRQDLSGYSMLAIGIGTLIYGPWSIIKWNRERRRLQIEDFKARIALLPLLQAKTDRRTLQMLRENLEEEAIIMKDVPHWKVGEFVFPTNPLGAPLDRGTVRAAPPKGGFPCQPRLYVVHVGPVPSGPLDPCPSPLGRNKCFAGLE

SEQ ID NO: 1018836 - protein, 154 aa, Homo sapiens
QPAPTSELTSATNIVKWITKQNAQGGFSSTQDTVVALHALSKYGATFTRTGKAAQVTIQSSGTFSSKFQVDNNNRLLLQQVSLPELPGEYNMKTEEGCLSTSFKILPEEQFPFAFRSADFASNLVINPSPPPASKFPLSVSSQGPALPSNMADR

SEQ ID NO: 1018837 - protein, 87 aa, Homo sapiens
DQLSGRVRLWMRFWRCFLTEMYRNTKLVDERDAFQDNLRVSDEDFAVRQPGLGSTWMKKGCYVIQEDFPTLTPGNVVSIFYVPWSYD

SEQ ID NO: 1018838 - protein, 100 aa, Homo sapiens
MGSVSISSTLLLEAMYSAMHSTLAEVVTPPHLQVFATGPTFIQGSVQDQPWEASLASTESTAPSSVPLSPWALPPFSPDHLVVFLSKSPVKSDIPETGDQ

SEQ ID NO: 1018839 - protein, 104 aa, Homo sapiens
GPGVFAQGSPGPGRQVGQGTSVVLPPAIFRDEWVNNLNAGLLGPEVAVVLITLVVSVAFSSSLGVDQEPVKDGPGQMFGPPPISEVTSTLPPISCLPVKPSINA

SEQ ID NO: 1018840 - protein, 85 aa, Homo sapiens
DRFQDFALIDAPTLEDEPQEGQQWEIALPNNWQRYPRTKVEEKEASDTGGEEPEKEEEDLYYGLPDGAGDLLPDKELGFEPDTQG

SEQ ID NO: 1018841 - protein, 87 aa, Homo sapiens
PPPFSPKTKGPLVPFLGLWVPGVWTSTGGGAPKATHFLFQNQFPCPPTLVIWGVASPDLCRTVCLTPALPLGPGGWAVKKLLGKEGA

SEQ ID NO: 1018842 - protein, 59 aa, Homo sapiens
FPADLLKTLRYSAAAVNTLLTGFGFFVVIYNIPVRLQGVNGQSPVQAGIALLPLLGSSA

SEQ ID NO: 1018843 - protein, 121 aa, Homo sapiens
VLLVFISITQKRKRRARARGIPLARFEGFQPSRVGLEGNLGAAPKETRAGLSVPSIEQLKIKIVPSGCCSERLQESAKQTRLENAALENQSEGLKDAFNTDSSRNPASFGTGRFTKPKNTK

SEQ ID NO: 1018844 - protein, 121 aa, Homo sapiens; identical to SEQ ID NO: 1018843

SEQ ID NO: 1018845 - protein, 71 aa, Homo sapiens
SVDLPLIRVGEEPEEDPEEHRKPPPEGQGRRRLRNGCGAQMKKKNPPRVFPLKKMNCKLFSPPLGPVGEGM

SEQ ID NO: 1018846 - protein, 119 aa, Homo sapiens
ILTSHLHLAFIDFVHAQPIEKPAGPNVADSLRLMEEDEDASKKPFSPYIKNRGTPALMGGMDKKGPAAIRENPVFEKKPQKEVKKKGGARPQMSLAQKKGGGAPKKASFLRGQGGGGEG

SEQ ID NO: 1018847 - protein, 155 aa, Homo sapiens
YPAFVAISLQCIKEEDTPPDNDSGICMSPESYLGFPQHSPFTRGFPKRSLPSPGVFCGFARPKPYDPPGKKMVAAKVKGEKLDKKLKKMEPNKPAAPRFPQKKRAEQEAFSGECKKLEKKNEALKKRGDSLAKEIQYLKNFIKKVPKARGKKRVP

SEQ ID NO: 1018848 - protein, 77 aa, Homo sapiens
GKASCKVGVDIKVHAFAIKKKEIMCFTAIQMELEAMILSKLTQVQKTKYHMFSLIKWELNIAYTWTPRRHGYTFGPT

SEQ ID NO: 1018849 - protein, 226 aa, Homo sapiens
MEAERRRQAEKPKKGRVGSSLLPERHPATGTPTTTVDSSAPPCRRLPGAGGGRSRFSPQGGQRGRPHSRRRHRTTFSPVQLEQLESAFGRNQYPDIWARESLARDTGLSEARIQVWFQNRRAKQRKQERSLLQPLAHLSPAAFSSFLPESTACPYSYAAPPPPVTCFPHPYSHALPSQPSTGGAFALSHQSEDWYPTLHPAPAGHLPCPPPPPMLPLSLEPSKSWN

SEQ ID NO: 1018850 - protein, 131 aa, Homo sapiens
PLWADLPATPLDNILDELPLHASPTSQLTAIIQSPEERAAKTGLDFCRGLLSWLSSGAGLWREAQTCSSTSSSPMCPQEGHNKPLYLTSSVCPSRRWQERKSSDSFSGTWGRKTCLQKPTYLEGIFIPILL

SEQ ID NO: 1018851 - protein, 214 aa, Homo sapiens
GTTLLVGAVQGLVGASPNIRGPRISPTRGGSRLDIPLGMTPRRGLHWPRSTRGNAPQQVYAKDRCPLPSLFLESTDSHFVPPHRPEETKEFMLSRLFNQFPGFKEVRLVPGGHNIPFVEFHNKVQAGAAPNPLQGFKFPQNNPMKFSFAKKKPLFPPGRPLPLFGGPPFPPGVSPLKVSPPLGAFLDPGVSEGSPPSIVPKVCPQPLPRGLLGR

SEQ ID NO: 1018852 - protein, 225 aa, Homo sapiens
MTQPFTFLHQLPLLPNPHDRKCGQIFMSLSSNNISHSWKFYNSITSMDQWSLFGPVCLGPQEQDHLEPGSTLCSHTGEVRISRRIAVLGSQNHRCPCQKLTATSLPSVHLYLARPKTDKSKREPLKPTLSQLFFSLHFTPFAPAITSTHRTHRLCTQMSTVTGQGMKLTKQGEPQATGPGGDCSELCLHPSEEVAAAQLQPWGNDDQMLLDLHTFQEKLEVLLFT

SEQ ID NO: 1018853 - protein, 104 aa, Homo sapiens
MTQPFTFLHQLPLLPNPHDRKCGQIFMSLSSNNISHSWKFYNSITSMDQWSLFGPVCLGPQEQDHLEPGSTLCSHTGEVRISRRIAVLGSQNHRCPCPAPALGE

SEQ ID NO: 1018854 - protein, 99 aa, Homo sapiens
MGSWLSYLLFEGGPDTSTLLTALPIKRDSLGQSGPPPYPRGRHPPGRGQTLAPCCQVKVLAWKQAHVEHHIPLSKVESTPPRSTQPTRVQAALGRYHAA

SEQ ID NO: 1018855 - protein, 115 aa, Homo sapiens
MAHLPALQKDKAITLRGVFGHHIHLSEGGPDTSTLLTALPIKRDSLGQSGPPPYPRGRHPPGRGQTLAPCCQVKVLAWKQAHVEHHIPLSKVESTPPRSTQPTRVQAALGRYHAA

SEQ ID NO: 1018856 - protein, 163 aa, Homo sapiens
WMPLKTQQCQLGGNTCKCGKVLHKAGYALNQCPACGVVSPIARIHKSRNQGMEMRATLLTITPSDPLANFLLLVSMSLCYAGLEVLVPKGGMFLPGDTTMIPLNWKLKLPTSHFGFLMSLNQQANKGVSVLAEGDLILTTKGETGLLLHNGGLIQSVEDLGSK

SEQ ID NO: 1018857 - protein, 54 aa, Homo sapiens
MCRSDKNKGNASRMSFGFGKLVVSLGMLSTVVGTSLPAAAQSGAASWYGSGTCV

SEQ ID NO: 1018858 - protein, 65 aa, Homo sapiens
HGMEDPDVILVGELRDLETIRLALTAAETGHLVFGTLHTTSAAKTVDRVVDVFPAGEKAMVRSML

SEQ ID NO: 1018859 - protein, 78 aa, Homo sapiens
KALGTSCNPFSSHVRVHPAKPQARGYLRPWGPNPCSRVSVRQHTKSKKIIFFPQKPFFSHDPLTGFASFPSPSQADLR

SEQ ID NO: 1018860 - protein, 126 aa, Homo sapiens
MSQAQSLPSGSSWSRIEDSLNRCPLSAEDLAAPSQGAGAHRCCMLRVFYFNTHGVSRRLRFPWFHTCYLSSRCACPQPGRIGQKSFKVAVSGDLFLAPGQVLFGSVLSSLPPGESSHHIYWTPTAC

SEQ ID NO: 1018861 - protein, 93 aa, Homo sapiens
CIWSGKPRGLSFSDIPPGVVCWCDISQFGGGLPTGGKKAAGAGQGPSLARKVRRVKGFFPLNPPPPFLSGGGGRVQNWLVSLGPLGLGEKAGL

SEQ ID NO: 1018862 - protein, 94 aa, Homo sapiens
QLATNLQESLACRGMGRGVSASGEHLGLYETHTRSSAAYFCFGNDLRLKMDEWQFGSLAKMRLQMNTLPQGTRFQQSKPGIIFYLMLPNSWKLS

SEQ ID NO: 1018863 - protein, 64 aa, Homo sapiens
MRIVLDTSKSAGQITNYWTHHKLLDPSQTTGPITNYWTHHKLLAFVKLNDITISTLLGKPITNF

SEQ ID NO: 1018864 - protein, 97 aa, Homo sapiens
MGNLDHYSSLLGKPITNYWTHHKLLDPSQTTGPITNYWTHHKLLDPSQTTGPITNYWTHHKLLDPSQTTGAITNYWRLRSLNDITISTLLGKPITNF

SEQ ID NO: 1018865 - protein, 195 aa, Homo sapiens
GFSIEQGVLTMAVSARYEEGAFLFQTKENWRKKEKSVRGCLVDANLSVLHLGIVKKGEKDIPGLADTGPPRLGPQKGSRIPQLFHLSKEDDGPPDVGRKPFNKEGKKPRAQAPQIQGLGSPRVLQPQRRGIAFKKQRAQKNKEEGCRIWLTFGPKNKRGLRRRARDQLGKGAAFPLCGVLLLSLDPGRNKIFWGT

SEQ ID NO: 1018866 - protein, 89 aa, Homo sapiens
WLRKLLGISVSTNRAFVQLLWEPGHFRGKSSSLDGIVAPLGRRTGGLLNDYRGHTVEILDFAFSKNASLVVATSGDHKGKVFCVQRPDR

SEQ ID NO: 1018867 - protein, 377 aa, Homo sapiens
MAEDKHNKNPLKMLESLGKELISGLLDDFVEKNVLKLEEEEKKKIYDAKLQDKARVLVDSIRQKNQEAGQVFVQTFLNIDKNSTSIKAPEETVAGPDESVGSAATLKLCPHEEFLKLCKERAGEIYPIKERKDRTRLALIICNTEFDHMPPRNGAALDILGMKQLLEGLGYTVEVEEKLTARDMESVLWKFAAREEHKSSDSTFLVFMSHGILDGICGTMHSEEEPDVLPYDTIFRTFNNRNCLSLKDKPKVIIVQACRGANRGELWVSDSPPALADSFSQSSENLEEDAVYKTHVEKDFIAFCSSTPHNVSWRDIKKGSLFITRLITCFQKYAWCCHLEEVFRKVQQSFEKPNVKAQMPTVERLSMTRYFYLFPGN

SEQ ID NO: 1018868 - protein, 197 aa, Homo sapiens
DSTQVICKDWSNLAGKNYIILNMTENIDCEVFRQHRGPQLLALVEEVLPRHGSGHHGAWHISLSKPSEKEQHLLMTLVERAGGVPTQDVLSMLGDIRRSLEEIGIQNYSTTSSCQARASQVRSDYGTLFVVLVVIGAICIIIIALGLLYNCWQRRLPKLKHVSHGEECASWRTAATTTPRWTWPATASRRCRRSTPA

SEQ ID NO: 1018869 - protein, 360 aa, Homo sapiens
DSTQVICKDWSNLAGKNYIILNMTENIDCEVFRQHRGPQLLALVEEVLPRHGSGHHGAWHISLSKPSEKEQHLLMTLVGEQGVCPLKMSFPCWVTSAGAWRRLASRTIPQPAAARRGPARCAATTARSSWCWWSLGPSASSSLRLACSTTAGSAGCPSSSTCRTARSALRGERLPRQPHAGRGQRQPVGDAGEAPQPERRRGPQRPGELGGAHGGQAGPRGLGRVRGGHAPVSAAEAQAEWAARTKRGGPRNGRPGARTSPAPTRAAPAAWPSARAPSRFPRLHTAASDQLPHSRPRGRPQSPPWPRFPAPEPRPRGRRAALPAPRDSIKPARRPRRAQQKNNTAQLTRNQNQQRTYKNG

SEQ ID NO: 1018870 - protein, 259 aa, Homo sapiens
DSTQVICKDWSNLAGKNYIILNMTENIDCEVFRQHRGPQLLALVEEVLPRHGSGHHGAWHISLSKPSEKEQHLLMTLVGEQGVCPLKMSFPCWVTSAGAWRSPNATYPRRNHGTPGPQSEETWPLPPLRDWHPELFHNQQLPGAGQPGAQRLRHALRGAGGHWGHLHHHHCAWPALQLLAAPAAQAQARVARRGVRFVENGCHDNPTLDVASDSQSEMQEKHPSLNGGGALNGPGSWGALMGGKRDPEDSDVFEEDTHL

SEQ ID NO: 1018871 - protein, 98 aa, Homo sapiens
GSCFFPAVLGPGFCSSSASGKSRVDVQGPPNPQTLPPRVGLKWVPRRPPRPIGFDFSSTHGCAKGLWVGLHVICKSFACPHPPHFQGSDGKPQGDLAK

SEQ ID NO: 1018872 - protein, 116 aa, Homo sapiens
MWKVPFVTPVFQPKGAGACYGKKVCPCFGEKVVPPDPPLVFGLSKDPFETHILPPASEAVFYQVMERVQQAVWEHQRTLSPVPLQLGRVGNIWRPWVQPCCGPFPLWWGLREDDPP

SEQ ID NO: 1018873 - protein, 68 aa, Homo sapiens
QATAQEEGIFECADPKLAISAVWTFSRPRGSAAVRRALQAPGSTCPLTFASLDNQEKLEQFIRQFICS

SEQ ID NO: 1018874 - protein, 60 aa, Homo sapiens
QGLMLISQLPMMVAVEFELRLKIPGPEGEVQAVDLTATCLWCHEDINPQHYDSGASIPCG

SEQ ID NO: 1018875 - protein, 244 aa, Homo sapiens
SHEVSTERHICLPIESGEIKGYKIMSPRGLVDLICTKSFALVGVVETALSLSTSVRECEPPWQVPVQGPAALHLGRVTGRRLCARGLTLPSPSLEAPTDITEQPSSIPLRPISLCAPPHQGFSRSPGLIINKHCYSKKDTKITYKEKKKPLKTSPAPSSLRGQNTEGSAPTPAETNKECGAGLSRRSLHQNAALTAGYATTVGQDGAAPAYTTWRPRSSTSAKPTSVPDALQARRKANGPPAHT

SEQ ID NO: 1018876 - protein, 172 aa, Homo sapiens
MTWSVTARTEEAPAYLNTLGWWGCGKKRVCFFTSSTESAHYGFPLGSQNPQHERNGATQLKPGLLNPDTKPSSLEMNMLHFTTTALPDSGIGFWKVKLEEPDLISPTSKTPSEQERPQHPPRTGDVHLHGHPLRRTVDHQPPHHPRAELLQRDDAVPTTSLFFFFILLSLCF

SEQ ID NO: 1018877 - protein, 85 aa, Homo sapiens
MRSRPQQKKPPSKRGTDRWVRHDSGARRGRACLHNVAAAVVNCAKPTSVPDALQARRKANGPPAHTEPPTDKGQTTGTKTGGTIH

SEQ ID NO: 1018878 - protein, 187 aa, Homo sapiens
MTGRRLCARGLTLPSPSLEAPTDITEQPSSIPLRPISLCAPPHQGFSRSPGLIINKHCYSKKDTKITYKEKKKPLKTSPAPSSLRGQNTEGSAPTPAETNKECGAGLSRRSLHQNAALTAGYATTVGQDGAAPAYTTWRPRSSTSAKPTSVPDALQARRKANGPPAHTKPPTDKGQTTGTKTGGTIH

SEQ ID NO: 1018879 - protein, 62 aa, Homo sapiens
KKPNSTSDHCYTFEMVFLEEPGESGERQALYLFIQLCSDLAKKSLMFYLYPPEMEIKDGAQT

SEQ ID NO: 1018880 - protein, 58 aa, Homo sapiens
FPACRPQGPPCLATGTASIPCSAQPRPQPKVLKDFQLHRPPPQGVAAVTKTINPDGHG

SEQ ID NO: 1018881 - protein, 347 aa, Homo sapiens
LDAKENQSIRAFNSEHKIPYVRLERLKICAASSGEMPVFKLKPQKNDQDGSFLLIIECGTESSSMSIKRPPEVEGTSPEEHRLIPRTPGAKKGPPAPIENEDFCAVCLNGGELLCCDRCPKVFHLSCHVPALLSFPGGEWVCTLCRSLTQPEMEYDCENACYNQPGMRASPGLSMYDQKKCEKLVLSLCCNNLSLPFHEPVSPLARHYYQIIKRPMDLSIIRRKLQKKDPAHYTTPEEVVSDVRLMFWNCAKFNYPDSEVAEAGRCLEVFFEGWLKEIYPEKRFAQPRQEDSDSEEVSSESGCSTPQGFPWPPYMQEGIQPKRRRRHMENERAKRMSFRLANSISQV

SEQ ID NO: 1018882 - protein, 109 aa, Homo sapiens
MGPSAGPGPSTTPNKMLWPKMKVPNGIFCPEMLQLNPWTSGDIEAWKKKKKRHRLILVPPFCVQISCSPITEFHNGPEKPCSRSILCREIRFSRLVSVEHSADSLEFSH

SEQ ID NO: 1018883 - protein, 180 aa, Homo sapiens
MGQPYVTTKSLQILKVYEARNLHMILSRLDDYGKKVMQVWTEKQKSLGQKRNQCLKKMIQVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRSSG

SEQ ID NO: 1018884 - protein, 183 aa, Homo sapiens
MGQPYVTTKSLQILKVYEARNLHMILSRLDDYGKKVMQVWTEKQKSLGQKRNQCLKKMIQVFNQLKKIHELNLSQPIPLIIEEKQIPASTTFVQKPFLKLLMEEDRTSDICKKFRQQEDQTEAIWNVDLSTSSYPIAEKTSMHSLWAQLGGYPDIPRLLQLEVQSTFRKSLASLQSRVKKIPK

SEQ ID NO: 1018885 - protein, 152 aa, Homo sapiens
DCLGHALVYEYTLGEEKFTFIEKCNNPRSVTLLIKGPNKHTLTQIKDAVRDGLRAVKNAIDDGCVVPGAGAVEVAMAEALIKHKPSVKGRAQLGVQAFADALLIIPKVLAQNSVFDPQETLVKIPAHSESGAALGVDLNTSEPKVAAEGGMG

SEQ ID NO: 1018886 - protein, 131 aa, Homo sapiens
VEVVDDATEVRRTVPVLEIDLGFLRNLKASLENSLKEVEAPYALQMEQLNGVLFPPESKLAQTRAKGQRQAQEYEALFNIKVKLEGEIAPPPPLVEDGEDFNFGDALGSSNSMQTIQKTPPPRIVDGKVGF

SEQ ID NO: 1018887 - protein, 145 aa, Homo sapiens
CAGWVPPPPSFFETNGKFQGPKEASPEPQREKCFPQPWEQQQKGPCPKAPLLLLKGAPGIEKDGASVEKDPWAVAVPPEGVLIFQQDIQSQGKVNRQPPLSDASLSGMPAKRRKFRFDIQKGLQEDPNYSPQGFPNAQGAFVDDP

SEQ ID NO: 1018888 - protein, 94 aa, Homo sapiens
PPNGGNVVIFDRVIPNQEEPYQNHSGRFVCTVPGYKYFTFQVLSQWEICLSIVSSSRGQVRRSLGFCYTTNKGLFQVVSGGMVLQLQQGDQVWV

SEQ ID NO: 1018889 - protein, 172 aa, Homo sapiens
HDCSYGGQVGGSILSLSVLRGKARDVTVTRGRHEFTYALMPHKGSFQDAGVIKDAYTLNFPRVGFASPQAKGPPPPGSAFSVSSPAVVLETVKQAESSPQRRSLVLRLYEAHGSHVECWLHLSLPVQEAILCDFLERPDPAGHLTLWDNRLKLTFFPFQVLSLLVVVQPPPH

SEQ ID NO: 1018890 - protein, 310 aa, Homo sapiens
LRPCSTICHGWLGCYGLELLCLSFCAVHAVTDCDVAPCACPAVLLWNLASPVTVCRPVRCGWGKLCPQNLTTPVAMRTQNLMDENLYEKNPDSHGYDKDPVLDVWNMRLVFFFGVSIILVLGQHLYVAYLPDYRCTGCPRAWDGMKEWSRQEAERVVNYLRGQWPSHHGNQLLRAQTRSNCQRMSEQVLSGRLKKAPPSPPPACHYDLFSEPLLKGAESLKNKKKNRSHTLHRRQQQQATRQWRHGQTSTKAPHSRHTWATACAPHSGRKYQTQGTCMANSAREAEESEYGEYNMQEGGTIDWMKGVGTY

SEQ ID NO: 1018891 - protein, 173 aa, Homo sapiens
MNGQLNGFHEAFIEEGTFLFTSESVGEGHPDKICDQISDAVLDAHLQQDPDAKVACETVAKTGMILLAWGNLQSRAAVDYQKVVREAVKHIGYDDSSKGFDYKTCVLVALEQQSPDIAQGVHLDRNEEDIGAGDQGLMFGYATDDLLAYWKKKTEECPLTIVLAHLNAKLAKL

SEQ ID NO: 1018892 - protein, 209 aa, Homo sapiens
SCPGCFRLRLLILRLSERNMKVLLAAALIAGSVFFLLLPGPSAADEKKKGPKVTVKVYFDLRIGDEDVGRVIFGLFGKTVPKTVDNFVALATGEKGFGYITRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 1018893 - protein, 117 aa, Homo sapiens
MYLCGILLTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 1018894 - protein, 227 aa, Homo sapiens
SCPGCFRLRLLILRLSERNMKVLLAAALIAGSVFFLLLPGPSAADEKKKGPKVTVKVYFDLRIGDEDVGRVIFGLFGKTVPKTVDNFVALATGEKGFGYKNRKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 1018895 - protein, 111 aa, Homo sapiens
TSGPNQPSIEGKPDKYMAAMAELFSQVDEKRKNQTPPPTCVARSAFELMREPCITPSGITYDRKDIEEHLQGVGHFDPVTRSPLTQEQLIPNLAMKEVIDAFIFENGWVED

SEQ ID NO: 1018896 - protein, 405 aa, Homo sapiens
MSLYDDLGVETSDSKTEGWSKNFKLLQSQLQVKKAALTQAKSQRTKQSTVLAPVIDLKRGGSSDDRQIADTPPHVAAGLKDPVPSGFSAGEVLIPLADEYDPMFPNDYEKVVKRQREERQRQRELERQKEIEEREKRRKDRHEASGFSRRPDPDSDEDEDYERERRKRSMGGAAIAPPTSLVEKDKELPRDFPYEEDSRPRSQSSKAAIPPPVYEEPDRPRSPTGPSNSFLANMGGTVAHKIMQKYGFREGQGLGKHEQGLSTALSVEKTSKRGGKIIVGDATEKGEAQDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 1018897 - protein, 118 aa, Homo sapiens
AGLPGRGGGQAKVNKTRGGCHAPGGLIASVESAPRYSGPALLPRQPLKDSQGGTGQAGRSQNLTRCAGRGRGLGAFAPSPGNGCARKEYCRHLNGLPGIFKQKAKCCKSIADQASRFL

SEQ ID NO: 1018898 - protein, 105 aa, Homo sapiens
MLEFGGSLLMKIEVCMQPWNPGYSSEGARDQETYTCPKMIEMEQAEASLLQLGLLDSMFPGEIELHRRMSSWRCSRTEEIVVKMKTREGRSSKVYFTINMNLDVS

SEQ ID NO: 1018899 - protein, 172 aa, Homo sapiens
FAWFGENPNFGKEKGKGTGLVYRGKKAQGKPMVTIVIMGQKLEMIRFLAPRLVFKGGNLEKTLKVDKANAQAAVLYKVFDATGQMNLTKVVDSSPFALELLIFDDCFVLDNGLCGKIYIWKGRKANKKERQAPLQVAKGFIWGMQYAPNTQVEILPQGRESPIFKQFFKDWK

SEQ ID NO: 1018900 - protein, 213 aa, Homo sapiens
MEVLRRSSVFAAEIMDAFDRWPTDKELVAQAKALGREYVHARLLRAGLSWSAPERASPAPGGRLAEVCTVLLRLGDELEQIRPSVYRNVARQLHIPLQSEPVVTDAFLAVAGHIFSAGITWGKVVSLYSAAAGLAVDCVRQAQPAMVHALVDCLGEFVRKTLATWLRRRGGWTDVLKCVVSTKPGFRSHWLVATLCSFGRFLKAAFFLLLPER

SEQ ID NO: 1018901 - protein, 36 aa, Homo sapiens
MSLLKWSPSKGDRLRHGCHGQLLLHRESSPPSVVFS

SEQ ID NO: 1018902 - protein, 128 aa, Homo sapiens
RERGRRPTPCGSGLRSPKGKGILGNAIKWNFPKFLIDKNGWVVKRFGPMEEPLVIKKDLPPYFELPKCVAPPEPLPTPLEPFPGTYDGLPANLLVGQTRKFRVPPPGGRFHGLLGLGWGPPPWVPCGN

SEQ ID NO: 1018903 - protein, 30 aa, Homo sapiens
SEDGADYYCSSYTTTNSLVFGGATKVTGLG

SEQ ID NO: 1018904 - protein, 268 aa, Homo sapiens
MAGLRLTAVAWKLGLLAGCLAKRLACSKSNVPWSIYPKTVLALLSLLSRDADAAEPTNWCLGATWCGGLCCLRCMPSMDAEWFTPVERDGLSNLLFRCFAPWTTCPALAMEPREVLLRLLRRPLLSRAVDSLAASTSVMFAILAERVAGGPDAVRSLSHEGLAGTVHPKSAIENSRASRASVVSQPLPLKMAQFHGMEMPFTKEPHWLSGTMERYLKQIPGPGPNWASLRLTLLEMYSLKDEMGNLRKLLESTPSPVVFCHNDIHSSS

SEQ ID NO: 1018905 - protein, 105 aa, Homo sapiens
HYLAEAKKGETLSQEEQRKLEEDLLEMYSLKDEMGNLRKLLESTPSPVVFCHNDIHSSPDSTLPLLGFLLEPPGQDLGGRNNEQKALATGLSPQVKLRFRRPACS

SEQ ID NO: 1018906 - protein, 118 aa, Homo sapiens
MAECRSVVYRMTTWAASMMTGELVYYVVKTDLGLFDAPPVVRYHGSGKGVLKVLCVELFLARDLDCCFPNSEFWVSCVKKRACRSPRRYFYSKVAVCHWAVIFGNTFWGKGFRPLLPD

SEQ ID NO: 1018907 - protein, 118 aa, Homo sapiens; identical to SEQ ID NO: 1018906

SEQ ID NO: 1018908 - protein, 113 aa, Homo sapiens
RVDVRSSLVSSHQDQIEDAADPCPMWKAKSPPRDWVSAVRELHELEGKQTERSGHWAVSRLPAPRTEQTVTRTANKARREALKGGQSGRALWLTPVTPACKPSYSGGRGRRSA

SEQ ID NO: 1018909 - protein, 80 aa, Homo sapiens
KRPARWGGFWSRGAEHLSAWKGTFRGFIRVVLPVPDFAHANLHPRASGGTLRPVGGSGAAAGVLSSSVIPVFAYGDPPPD

SEQ ID NO: 1018910 - protein, 113 aa, Homo sapiens
VGNKTKKTPLCQVYALDTSSYRPQCPLGRRQWRTKPHGLKISPQFPKCFWGPKTLGLTFFFAQGGPGPKGRTGGLEMWAFYKPPWAFIPWPGDGKWAVFFYGYSVCKGILCIQ

SEQ ID NO: 1018911 - protein, 548 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 1018912 - protein, 144 aa, Homo sapiens
HAVEHVTLPPSPLGWSPPGVGQCSILNPEVLDITEETLHSRFLEGVPNVASVCLQIGYPTVASVPPSIINGDKRVLALSVETDYPFPLAEKVKAFLGDPSAFVAAAPVGAAPPAAPAVVAAPAKVEAKEKSEESAEDMGFGLFD

SEQ ID NO: 1018913 - protein, 1031 aa, Homo sapiens
MGRESRHYRKRSASRGRSGSRSRSRSPSDKRSKRGDDRRSRSRDRDRRRERSRSRDKRRSRSRDRKRLRRSRSRERDRSRERRRSRSRDRRRSRSRSRGRRSRSSSPGSKSKKAENRSRSKEKAEGGDSSKEKKKDKDDKEDEKEKDAGNFDQNKLEEEMRKRKERVEKWREEQRKKAMENIGELKKEIEEMKQGKKWSLEDDDDDEDDPAEAEKEGNEMEDEELDPLDAYMEEVKEEVKKFNMRSVKGGAGNEKKSGPTVTKVVTVVTTKKAVVDSDKKKGELMENDQDAMEYSSEEEEVDLQTALTGYQTKQRKLLEPVDHGKIEYEPFRKNFYVEVPELAKMSQEEVNVFRLEMEGITVKGKGCPKPIKSWVQCGISMKILNSLKKHGYEKPTPIQTQAIPAIMSGRDLIGIAKTGSGKTIAFLLPMFRHIMDQRSLEEGEGPLAVIMTPTRELALQIPKGVRSFKTLGLRVVCVYGGTGISEQIAELKRGAEIIVCTPGRMIDMLAANSGRVTNLRRVTYVVLDEADRMFDMGFEPQVMRIVDNVRPDRQTVMFSATFPRAMEALARRILSKPIEVQVGGRSVVCSDVEQQVIVIEEEKKFLKLLELLGHYQESGSVIIFVDKQEHADGLLKDLMRASYPCMSLHGGIDQYDRDSIINDFKNGTCKLLVATSVAARGLDVKHLILVVNYSCPNHYEDYVHRAGRTGRAGNKGYAYTFITEDQARYAGDIIKALELSGTAVPPDLEKLWSDFKDQQKAEGKIIKKSSGFSGKGFKFDETEQALANERKKLQKAALGLQDSDDEDAAVDIDEQIESMFNSKKRVKDMAAPGTSSVPAPTAGNAEKLEIAKRLALRINAQKNLGIESQVDVMQQATNAILRGGTILAPTVSAKTIAEQLAEKINAKLNYVPLEKQEEERQDGGQNESFKRYEEELEINDFPQTARWKVTSKEALQRISEYSEAAITIRGTYFPPGKEPKEGERKIYLAIESANELAVQKAKAEITRLIKEELIRLQNSYQPTNKGRYKVL

SEQ ID NO: 1018914 - protein, 112 aa, Homo sapiens
QWPERGWPYRPVTARDRAQSLHFSCPEIPGASEGDEGGLHEVGGGVRGGLYIVLNRKWLALASLVCDVMSLGRTVSMRSSGRDGDGCLRCSRPVRGPRSLAVPALCPGLEAD

SEQ ID NO: 1018915 - protein, 152 aa, Homo sapiens
PSTGSHASSEIENVREVQRAGILFFRIMLLELQESIQLLNSMEFVSLLLYDHTLVTEPNSPQDSKSMELEANVKLVRDILKAVILFFHPELEFSSDFGSWDKCKFYVNKYLVNNICAFDPTAKHVEVNVQLIDEYIRGKFPLNYSLNLCQQQ

SEQ ID NO: 1018916 - protein, 86 aa, Homo sapiens
MLSQKPKKKHNFLNHGLSLNLVIKPYLALEGSVAFPAENGVQDTESTQEKRETGDEENSAKFPVGRRDFDTLSCMLGRVYQSCWQV

SEQ ID NO: 1018917 - protein, 86 aa, Homo sapiens
MLSQKTKKKHNFLNHGLSLNLVIKPYLALEGSVAFPAENGVQDTESTLEKRETGDEENSAKFPIGRRDFDTLRCMLGRVYQRCWQV

SEQ ID NO: 1018918 - protein, 263 aa, Homo sapiens
SPQVQPPAWSSVAAFSHSEAKKKTQEKIMASPDWGYDDKNGPEQWSKLYPIANGNNQSPVDIKTSETKHDTSLKPISVSYNPATAKEIINVGHSFHVNFEDNDNRSVLKGGPFSDSYRLFQFHFHWGSTNEHGSEHTVDGVKYSAELHVAHWNSAKYSSLAEAASKADGLAVIGVLMKVGEANPKLQKVLDALQAIKTKGKRAPFTNFDPSTLLPSSLDFWTYPGSLTHPPLYESVTWDPSVREKHQCQLRAAGTIPQPSIKC

SEQ ID NO: 1018919 - protein, 30 aa, Homo sapiens
TVQSLLALGPWSHHPFPSTYHPFPPLLSSS

SEQ ID NO: 1018920 - protein, 71 aa, Homo sapiens
VFLQHSCFQHERRQPAWRSALARGKQVNPRRGKLRSLEDHRGRLCDSSTGKRLLDSEVLAQGLCQVHLLLS

SEQ ID NO: 1018921 - protein, 110 aa, Homo sapiens
LTNPLLLFPPPPWHGTGSTPYTAILLFLHAPPLVPGHTRYLWGTGGLITGMLVYIDPLAFSLPFPSSPRITFLGHPEAACPRVLCVPAISPEKHSQGFVTTSLIPSPSLA

SEQ ID NO: 1018922 - protein, 97 aa, Homo sapiens
EACDPAPCLASMTCWMLPPISFLSYLLFGLTYMPLGPFFFGPSNPLGSLIPVCGPACSGPGMLHLQATMHFPGERTSMRSGGRAHIHLCRKVWPGVG

SEQ ID NO: 1018923 - protein, 85 aa, Homo sapiens
PQQPYIAGQQPMYQQVSHSRGLTAAPAGHPQASRFSNGTPGPSGDCPVRLLTGGDAYPRPLLSRQNEDTSLRADTRIRKCRQEKP

SEQ ID NO: 1018924 - protein, 109 aa, Homo sapiens
RGLTLSLWGNFLVGDALSVGDALLWVTALSMGQQPMYQQVSHSRGLTAAPAGHPQASRFSNGTPGPSGDCPVRLLTGGDAYPRPLLSRQNEDTSLRADTRIRKCRQEKP

SEQ ID NO: 1018925 - protein, 193 aa, Homo sapiens
VRPTQPPHLGSLTPARCPITRLSLAPKGGGGREARPNMFPWPQGCPWSPTTATQRHPHEAFFLGSLPNPSVQGSSPRRTVPGSAARRRSIRMGTEGSAQGAAPVKKHFCSSLMHFQPFNPPRLCGSPQPPCKFMACPSQTPAPLALRPVLPFVFSFPVLPLSLSLFFSLFVCVCVCVCVCVCVSCASSDLSRF

SEQ ID NO: 1018926 - protein, 193 aa, Homo sapiens; identical to SEQ ID NO: 1018925

SEQ ID NO: 1018927 - protein, 107 aa, Homo sapiens
RYVNKILNSKFGFTSRKVPAHMPHMIDRIVMQELQDMFPEEFDKTSFHKVRYSEDMQFAFSYFYYLMSAVQPLNISQVFDEVDTDQSGVLSDREIRTLATRIQILQT

SEQ ID NO: 1018928 - protein, 128 aa, Homo sapiens
TCLLPAPLPPRLLVNGHCAQPGPCNPGRGGAWAWPPLSFCEASRFRQDKAFSFPPALPTGPRDLRWPQFNFPLLVVGPYLPQGPSFWQFWNGRVLAAPTFLRAKVEGGGRLVGTQGHACPPHFIQTPP

SEQ ID NO: 1018929 - protein, 32 aa, Homo sapiens
QFLLLLVKNSLQNPHTHIHTHTHMMPALLSSS

SEQ ID NO: 1018930 - protein, 122 aa, Homo sapiens
LVVKGGKKKNQVLKFTLDGPHPVEDGIMDAANFDQFLQERIKVTGKAGTLGGGVVPIERSKSKIPVPSEGPFSKRYLKFLPKKYLKKNNLRAWLGVVATTKKSSEFRSFQITQAQKKEEAED

SEQ ID NO: 1018931 - protein, 324 aa, Homo sapiens
WETQLRRYYIISAGKDGSEQGGGRGGRRGQVWGNFEGTANRMYCRAGCGVLGVREAAKALPENWGGPGAPFTELGNTMSCFVNSVQAPGHLKAGLYGTARGRSTDRALLGPALGSASSLTFGGPRLLPPEPAFGPGPRGLFPPCRPRASPAGSPSARRPETRGAGRGHTTHAGSLTPSAPRGRHRRKPAKPNSRETPPESRTLRGSASRRAPVCVAVAAPPCVRFPGASAAARLCSGLGRSFSSGPARRAPVSQAPCRCPQLLGGSGAGEAGPQKAQSEPSDTRPGPPPSRSFRPRRLVLTDARAAPGRPFSLGSGLLSLPALA

SEQ ID NO: 1018932 - protein, 167 aa, Homo sapiens
MSCVKLSMHAYWEMVLHGAHSPDCSANGICVAMKKKTCKEHLPLGGPGAHHTLFVDCIPLFHGTLALAPMLEVALTLIDSWCKDHSYVIAGYYQANERVKDASPNQVCREVWPPESPRASATTALILVDNTQVYEGLEVRLRTNVYQHHEKEWVSKTKQDMEMASKA

SEQ ID NO: 1018933 - protein, 198 aa, Homo sapiens
MASCLLLPMWCLLCGPSLVSCIALWVNTDHTMWPTCKDWCLPLAANVTLHLLPVNGGSVGVPEKQKPAVRSTSPWAAPAAHHTLFVDCIPLFHGTLALAPMLEVALTLIDSWCKDHSYVIAGYYQANERVKDASPNQVCREVWPPESPRASATTALILVDNTQVYEGLEVRLRTNVYQHHEKEWVSKTKQDMEMASKA

SEQ ID NO: 1018934 - protein, 142 aa, Homo sapiens
MVESLKSVSHASKGDCIPVVNLAAPQSEPQSIIGKSSNCERWWRPLSMEEARGSLSTSCVPSNSSHPAWFTPKEPSDPTSNLSTFHPGNSQKPVKRPGATSISSVCKGGVSACPFLMSLVEQVLRAGKPLICTPENRGIEFR

SEQ ID NO: 1018935 - protein, 159 aa, Homo sapiens
KEILNDAAIARPSATKQSEEEEGAVFGQDSPRNVAGVSTLAMAKNMLESFVTTQDRDATRGLWGKANPLIHLGVVFSSSENETFTKVLEHEAETLVLTLSFELLKGTHAQWSMHTSNTANTISVSHPLEEEEDTEGRPVITLISSLPPHHIILIKHDRP

SEQ ID NO: 1018936 - protein, 147 aa, Homo sapiens
MSARALGMHGLGTTLTQCAGSRGGIPLWTKVMRKEARHTQMRDRASGVHPDILEHLPPKKTRVCLLYCFVLSPLISLGAVPHHHLALSVKEFTLQLQFIKFLVFLPFNFQLSLQSGARNPPRFTNYAWAAKTHFEGGGPVTQFPISE

SEQ ID NO: 1018937 - protein, 109 aa, Homo sapiens
RWQYGSEQPEWQVITCGTAAVGVSALWLWFYEIGQLPLAMAVTLNYMSPIWIAAILLVSAWRRRQRNMDWRLMAAIIMGFGGVVLLLRPSIHADQWIGGVVVQIRYCQR

SEQ ID NO: 1018938 - protein, 128 aa, Homo sapiens
PFLEPPKEGPHPLPLLFLGMWVPSRIGGLFAHPLCTQDPSPLPFGPAASCKKTSFWSPLKTMSLVLFFACPPCALPSSLYLSPWAAPLGGPPLPGSPLVSCQAFCKEKPLGEKWKRAKKINKFPLAPG

SEQ ID NO: 1018939 - protein, 127 aa, Homo sapiens
DSPRNKVNQRSKVMEKKCKSPQKAAFQGYFLSTRPLNNHLKICSRSIFWRWHCRWDLKAKSLHMIQANRCLHDLLLLAFCHDCEASPATWNFFHPVTTKWRNYRLEGERINHLRKLDGRLKVAKGEA

SEQ ID NO: 1018940 - protein, 152 aa, Homo sapiens
LCPSADSYCVLRCISWLYTQGPGSILPPFPPVPQPRLEKGPGVPEEPICALLGQQAWHWEVGVSPLQPCPSPRVATCLPLPKREGREQGTVLSCGNAEKFSPLHAGFGLRGGFFFPWPPVPPRRIWARCTAPQSTTAFYLVGWGKCWAVVVP

SEQ ID NO: 1018941 - protein, 207 aa, Homo sapiens
PKATAVDNAIFCPLVTHFATMQVPLSPNRCLLADWFRGGEAALTRSQPGSAEYMIARRTEGQGNTTIDLFLVEKAPADYASLDAFADDYRNRGIRIDSYHGECETYFGEALTLAAGASLFVFLDPCGAVLPMASIRKILQQRGTWPRTEVLLNFNADLIRRVGGQLKMGQLELGGVAQADEVCGGVWWRDVALQAHYTSGGQTWEAA

SEQ ID NO: 1018942 - protein, 186 aa, Homo sapiens
LTQQHNGWMDDAHGTGVIGEQGGSCWLQKVKPELLVVTFGKGFGVSGAVLCSSTVADYLLQFARHLIYSTSMPPAQAQALRASLAVIRSDEGDARREKLAALITRFRAGVQDLPFTLADSCSAIQPLIVGDNSRALQLADCVTRLLGHGDSPANRTRWYCATALTLTAAHEMQDIDRLLEVLHGNG

SEQ ID NO: 1018943 - protein, 33 aa, Homo sapiens
QHQPDIYVPLCQQFPSGGRAYEQYFGPGTRLTV

SEQ ID NO: 1018944 - protein, 90 aa, Homo sapiens
ARDGLRDASPFSAVWLRLPDSPTTSLAGRPAGLCGWPKGEGEPRVLGAPSGRGGGCAGHPVWGICGLCWCLPGEGPVVWVGGKSLPCLAK

SEQ ID NO: 1018945 - protein, 1147 aa, Homo sapiens
MACPWKFLFRVKSYQGDLKEEKDINNNVEKTPGAIPSPTTQDDPKSHKHQNGFPQFLTGTAQNVPESLDKLHVTPSTRPQHVRIKNWGNGEIFHDTLHHKATSDISCKSKLCMGSIMNSKSLTRGPRDKPTPVEELLPQAIEFINQYYGSFKEAKIEEHLARLEAVTKEIETTGTYQLTLDELIFATKMAWRNAPRCIGRIQWSNLQVFDARSCSTASEMFQHICRHILYATNSGNIRSAITVFPQRSDGKHDFRIWNSQLIRYAGYQMPDGTIRGDPATLEFTQLCIDLGWKPRYGRFDVLPLVLQAHGQDPEVFEIPPDLVLEVTMEHPKYEWFQELGLKWYALPAVANMLLEVGGLEFPACPFNGWYMGTEIGVRDLCDTQRYNILEEVGRRMGLETHTLASLWKDRAVTEINAAVLHSFQKQNVTIMDHHTASESFMKHMQNEYRARGGCPADWIWLVPPVSGSITPVFHQEMLNYVLSPFYYYQIEPWKTHIWQDEKLRPRRREIRFTVLVKAVFFASVLMRKVMASRVRATVLFATETGKSEALARDLAALFTYAFNTKVVCMEQYKANTLEEEQLLLVVTSTFGNGDCPSNGQTLKKSLFMMKELGHTFRYAVFGLGSSMYPQFCAFAHDIDQKLSHLGASQLAPTGEGDELSGQEDAFRSWAVQTFRAACETFDVRSKHCIQIPKRYTSNATWEPEQYKLTQSPEPLDLNKALSSIHAKNVFTMRLKSLQNLQSEKSSRTTLLVQLTFEGSRGPSYLPGEHLGIFPGNQTALVQGILERVVDCSSPDQTVCLEVLDESGSYWVKDKRLPPCSLRQALTYFLDITTPPTQLQLHKLARFATEETHRQRLEALCQPSEYNDWKFSNNPTFLEVLEEFPSLRVPAAFLLSQLPILKPRYYSISSSQDHTPSEVHLTVAVVTYRTRDGQGPLHHGVCSTWINNLKPEDPVPCFVRSVSGFQLPEDPSQPCILIGPGTGIAPFRSFWQQRLHDSQRRGLKGGRMTFVFGCRHPEEDHLYQKEMQEMVRKGVLFQVHTGYSRLPGKPKVYVQDILQKELADEVFSVLHGEQGHIYVCGDVRMARDVATTLKKLVAAKLNLSEEQVEDYFFQLKSQKRYHEDIFGAVFSYGVKKGNALEEPKGTRL

SEQ ID NO: 1018946 - protein, 273 aa, Homo sapiens
MVKGSKQQKELTILNICASNTGAPSFIKKVLRDLQRDLDSHTIIVGDFNNPVSILDRSIRQKIDKDIQDLNSALDQADLIDIYRTLHPKSTKHTLFSAPQCTYSKTDHLIGSKALLSKCRIREIITNSLSDHSAIKLELRIKKLTQNHTTTWKLNNLLLNDYWVNNEMKAEIKMFFETNENKDRAYQNLWDTFKALCRRKFIALNAHKRRQRRSKIDTLTSQLKELEKQERTNPKASRRQEITKIRTELKERHEKPFKKSVNPELVFLKRSTK

SEQ ID NO: 1018947 - protein, 283 aa, Homo sapiens
MNGEEQYYAATQLYKDPCAFQRGPAPEFSASPPACLYMGRQPPPPPPHPFPGALGSLEQGSPPDISPYEVPPLADDPAVAHLHHHLPAQLALPHPPAGPFPEGAEPGVLEEPNRVHLPFPWMKSTKAHAWKGQWAGGAYAAEPEENKRTRTAYTRAQLLELEKEFLFNKYISRPRRVELAVMLNLTERHIKIWFQNRRMKWKKEEDKKRSSGTAVGGGGVAEPEQDCAVTSGEELLALPPPPPPGGAVPPAAPVAAREGRLPPGLSASPQPSSVAPRRPQEPR

SEQ ID NO: 1018948 - protein, 92 aa, Homo sapiens
AFPAGKPTTVKVAEKCTFVIADTGTSGSTAAAVDGVSMLRDIQPRVVDRVVEDLANLTDDVVYSLGIGDPIRVGQSMHEAHSLLAYLGVSSP

SEQ ID NO: 1018949 - protein, 154 aa, Homo sapiens
SIRLFFFWPFDSLLMPREDLLAQLPGMFALLSLFHFFEAATRPQPCGQENKKFGDKTVIRAHPKPQKAAVGAFCPADPVQTLALSGPCSGSGGSPFSLASVGTSMVMGMVDGNLGMQGFHICVLQPLYLELVLHIGPVCKKNADSNEQGKLGFI

SEQ ID NO: 1018950 - protein, 104 aa, Homo sapiens
MAQAKRWLYQRPQASHQLLRILTDALVPYLVGQVVAGAQAMQLFESHAGHLGPQLFNKFALPYIVYVAKQMKARLREAGLAPVPMIIFAKDGHFALEELAQTGY

SEQ ID NO: 1018951 - protein, 141 aa, Homo sapiens
IPWRPWLEDCRRVPGGRTANGTRLRSHAPAALRQHCPLSYECGRCEASHLLTPGDNAQQLQADFGPESNRVSLAASAASTGLFLQHWWRETRCHQAQEILPSPSYPRSLGARRVSQRREGGTLHWFKWPVLRDAAMDPREY

SEQ ID NO: 1018952 - protein, 155 aa, Homo sapiens
PNLLYQKFVKMATLTSGGEKPNKDLESCSDDDNQGSKSPKILNDEMLLQACEGRTAHKAARLGITMKAKLARLEAQEQAFLARLKGQDPGAPQLQSESKPQGPGQACSPRGPGAGLPGSSQRPGPWGPSTAVREQAPQKKEKEKEAERGGRSYSI

SEQ ID NO: 1018953 - protein, 78 aa, Homo sapiens
AGCASWVGVAMASRVLSAYVSRLPAAFAPLPRVRMLAVARPLSTALCSAGTQTRLGTLQPALVLAQVPGRVTQLCRQL

SEQ ID NO: 1018954 - protein, 118 aa, Homo sapiens
MASRVLSAYVSRLPAAFAPLPRVRMLAVARPLSTALCSAGTQTRLGTLQPALVLCCSVTRGDFACLLCAMVSVDLVPWWGVGGACGASWWLLPAASAGCDPGGAAGSLRSPRCLKVFS

SEQ ID NO: 1018955 - protein, 115 aa, Homo sapiens
SGSCFVPGRLSVQLEGVSRLQGVGPPLRFWSFWVFLQPQPHWDLLPFRGGYEFGAGGQISEPKGGNGKTWAAEENPGGWGELMMFHPTPPMAPLPNLSKFGVFKVLEASPDPASC

SEQ ID NO: 1018956 - protein, 87 aa, Homo sapiens
SIESALLRNGTTGPQRPQGSSSPAAGSKRSAMSAFRNSFEGAKEKEIKAGTERGRKGGKERKKEKKRKKQKEQAKAERVMGGGCWFQ

SEQ ID NO: 1018957 - protein, 168 aa, Homo sapiens
SLQAYRLYNSSLPGDSCPDLKLHPATTRKDVSRIELASEDGVSVSCDVPTGLCSLTLGLWQHGISAGLLGTNDNEAGNELMLPDGSMARSLEELSLAWQVGGDCRATEKPQQEQACPGQLPACWAFFEGPHSSLRDCFRVVDPTPFLSLCVQVPCGTQELQPACNLAA

SEQ ID NO: 1018958 - protein, 137 aa, Homo sapiens
ESEHPVSLRPRDLLSQWDPGEMSAPDQVQLAGDKRRWTSSHWVWWSLSGSLVIVIVCSTVGLIICVKRRKPRGDVVKVIVSVQRKRQEAEGEATVIEPCRPLRTSPRWPWRRQNPSLFLTTNLHTLHPYARDTSNGC

SEQ ID NO: 1018959 - protein, 445 aa, Homo sapiens
MEAAVAPGRDAPAPAASQPSGCGKHNSPERKVYMDYNATTPLEPEVIQAMTKAMWEAWGNPSSPYSAGRKAKDIINAARESLAKMIGGKPQDIIFTSGGTESNNLVIHSVVKHFHANQTSKGHTGGHHSPVKGAKPHFITSSVEHDSIRLPLEHLVEEQVAAVTFVPVSKVSGQTEVDDILAAVRPTTRLVTIMLANNETGIVMPVPEISQRIKALNQERVAAGLPPILVHTDAAQALGKQRVDVEDLGVDFLTIVGHKFYGPRIGALYIRGLGEFTPLYPMLFGGGQERNFRPGTENTPMIAGLGKAAELVTQNCEAYEAHMRDVRDYLEERLEAEFGQKRIHLNSQFPGTQRLPNTCNFSIRGPRLQGHVVLAQCRVLMASVGAACHSDHGDQPSPVLLSYGVPFDVARNALRLSVGRSTTRAEVDLVVQDLKQAVAQLEDQA

SEQ ID NO: 1018960 - protein, 445 aa, Homo sapiens; identical to SEQ ID NO: 1018959

SEQ ID NO: 1018961 - protein, 75 aa, Homo sapiens
MTYLLWIGHIGTETTGYDDRLIIRSLRYYYDVSIPVSHQDNELRRWSLACLPMCLIKAPVRHRSITDIGVQDLIT

SEQ ID NO: 1018962 - protein, 75 aa, Homo sapiens
RVLCHRVMLNPQHVQLHFGNEVRPDHMAMKQIWLARWFGEPAPLHERGSVKEEEEVGAEPPPHPTPLPSPDIYVK

SEQ ID NO: 1018963 - protein, 114 aa, Homo sapiens
CRGSVKEFYASVEWEDDVSQDRRDVVRGLPLYKQGASHGENAVKLSSNENPFEPLPSVVEAVTRTLPRFIRYPLMSAEEVRSTAGHFGVREPGGGGGWIDGGSSHAMPWLVPVT

SEQ ID NO: 1018964 - protein, 86 aa, Homo sapiens
GTRTESRCVHPHHQIHQMDQEANEQWSLLRSLCLCLPPVPVLAAAAPDGLLTSLPFPPPALPLLNGARWFDQGHVSIFKKSQGGEE

SEQ ID NO: 1018965 - protein, 92 aa, Homo sapiens
EDTCSNADFSFGEGDANGTCFTECRIHGVAGDNGRRLCKPISFGNDATGGVFPLFNKFHGKRHSAGESEADTFNGDLPLFRFAQYTLVNGCH

SEQ ID NO: 1018966 - protein, 82 aa, Homo sapiens
EWNCWAIGKLCETSDTSAGRLEALDPQGLDLRALSRFPVHQCTHARSALHPGNFASTAFQIPAGLVMNQPTREQSETHLNGI

SEQ ID NO: 1018967 - protein, 128 aa, Homo sapiens
RSPAKRFILALTTGAERLYNNIFQFHQLRQIAKELNIQGADFENLIGSLNDQGYLLKKGPKVYQLQTKEKDFTKLGPPGVYAELKPSQERKAGTHRQTDTHTPPPTHTHTHTHTVKYCSLKNDVPKVL

SEQ ID NO: 1018968 - protein, 32 aa, Homo sapiens
MGGSLEPKSSKAVSYDYTIALQPGPQSETLTP

SEQ ID NO: 1018969 - protein, 64 aa, Homo sapiens
ASSRGEELQDEKCLSSCWLMEANPLIVLLLIDRAEGFVFEGSIMGTCTCHTLTVTGGTEKVRLL

SEQ ID NO: 1018970 - protein, 373 aa, Homo sapiens
WDSYDVVAFILRQVIEKERHMLVECEESSIYHALAFLQGRSGMRKRTQVKIRNVTSNHRASDTVVCEGRPQVLSGRFMYGPLDVVTLTGEKVDVYIMTQPLSGKWIHFGTEVTNSSGRLTFPVPPERALGIGVYPVRMVVRGDHTYAECCLTVVARGTEAVVFSIDGSFTASVSIMGSDPKVRAGAVDVVRHWQDSGYLIVYVTGRPDMQKHRVVAWLSQHNFPHGVVSFCDGLTHDPLRQKATVFWQSPGGSEVETGYIRGPGYGVSPHNVGRDIRPAAWRRDHGGKNLTYVARPRRKAKGSSASHVVQRANVGPAASWNSGTNTACSSEPRHVSWHTHHAVGAPGHVAQNNVRHDDQQDRSGATHTRRTER

SEQ ID NO: 1018971 - protein, 120 aa, Homo sapiens
ILGCGEELAVVGVEILEDQRGQLRRGGVRLATGVPDMIHLQIDQDRGQHHGDHHGDDDDHEGGLGHQATVIAPETGQAVTDSRHHRCVHPVQLVTVRGWNTAATPWWSCASAVGRTVTAS

SEQ ID NO: 1018972 - protein, 96 aa, Homo sapiens
PEALSKTVNFKGNRIDIGGHRFFSKIDTVMERWLNILPPEKTGGETFTLKHQGKSRPFEGDADGVDPETTDDVMLEYCSNPVVELCISSWTYSDCV

SEQ ID NO: 1018973 - protein, 85 aa, Homo sapiens
ALPPGSRSTLAMDPTGLPAPGMPFCHLWGPVTLVAAGAAQPAASMVMFPHFPALPPHCPPSPRTSQYMPANDGPQGYPDYPDQSP

SEQ ID NO: 1018974 - protein, 103 aa, Homo sapiens
QALPPGRLTTTLPRGPRLRRTRRRWRRGRGRPRRMEERKEEGEAEIQEHGPEHWFSKWERQCLAEAEQDEQLPPELQEDGWLCLPAACPDAQCSMNACGTFFP

SEQ ID NO: 1018975 - protein, 44 aa, Homo sapiens
EIRLFKGAGDRNCGFGSAGGRVATGAITNARVDGLRWLWSFLLC

SEQ ID NO: 1018976 - protein, 117 aa, Homo sapiens
MGRRPAAFLMQRKPSGWDGSGARPLRMAPPSTWLEALPIAGAGLRGGRFGGRQAHNGGGMAQADALGAGVRLAPMVRGAAGYGGGCRSGRCCARGEFEHGHGLHQVLGLLVQAGGGR

SEQ ID NO: 1018977 - protein, 95 aa, Homo sapiens
MFDVDSKDPTLGMSCPPPAFVEQSFLQKVKSILTPEGVFILNLVCRDLGLKDSVLAGLKAVFPLLYVRRIEGEENEILFCQLHPEQKLATFGDNN

SEQ ID NO: 1018978 - protein, 95 aa, Homo sapiens; identical to SEQ ID NO: 1018977

SEQ ID NO: 1018979 - protein, 262 aa, Homo sapiens
KAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 1018980 - protein, 275 aa, Homo sapiens
KAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPRPPKKGEKFGGGPEDKNGTRAEPPLNASASDQGEKVIPPAGQTEDAEPISEPEKVETGSEPGDTEPLELGGPGAEPEQKEQSTGQKRPLKNDEL

SEQ ID NO: 1018981 - protein, 98 aa, Homo sapiens
GRVPPMRLPLGRKKGAKLSLEEKRVFNQKRVSKKFQKKYDERKKNAKITSFLEEQFQQGKLFGCIASRPGQCGRANGYVLKGKKLEFYFRKIKAPKGK

SEQ ID NO: 1018982 - protein, 484 aa, Homo sapiens
EDELEGVRGGLWRWSRSFVPASSSQVMTFTGDLRLMFAFQVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIWDGHSKKNYLSEIHSYLPSLQRIFFKFKRSDCNSRRHSRKYRNCICVHQGL

SEQ ID NO: 1018983 - protein, 283 aa, Homo sapiens
ARAGPLSSHPLFSSGTAQTCAPKMRAQEDLEGRTQHETTRDPSTPLPTEPKFDMLYKIEDVPPWYLCILLGFQHYLTCFSGTIAVPFLLAEALCVGHDQHMVSQLIGTIFTCVGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIWDGHSKKNYLSEIHSYLPSLQRIFFKFKRSDCNSRRHSRKYRNCICVHQGL

SEQ ID NO: 1018984 - protein, 598 aa, Homo sapiens
MRAQEDLEGRTQHETTRDPSTPLPTEPKFDMLYKIEDVPPWYLCILLGFQHYLTCFSGTIAVPFLLAEALCVGHDQHMVSQLIGTIFTCVGITTLIQTTVGIRLPLFQASAFAFLVPAKAILALERWKCPPEEEIYGNWSLPLNTSHIWHPRIREVQGAIMVSSVVEVVIGLLGLPGALLNYIGPLTVTPTVSLIGLSVFQAAGDRAGSHWGISACSILLIILFSQYLRNLTFLLPVYRWGKGLTLLRIQIFKMFPIMLAIMTVWLLCYVLTLTDVLPTDPKAYGFQARTDARGDIMAIAPWIRIPYPCQWGLPTVTAAAVLGMFSATLAGIIESIGDYYACARLAGAPPPPVHAINRGIFTEGICCIIAGLLGTGNGSTSSSPNIGVLGITKVGSRRVVQYGAAIMLVLGTIGKFTALFASLPDPILGGMFCTLFGMITAVGLSNLQFVDMNSSRNLFVLGFSMFFGLTLPNYLESNPGAINTGILEVDQILIVLLTTEMFVGGCLAFILDNTVPGSPEERGLIQWKAGAHANSDMSSSLKSYDFPIGMGIVKRITFLKYIPICPVFKGFSSSSKDQIAIPEDTPENTETASVCTKV

SEQ ID NO: 1018985 - protein, 84 aa, Homo sapiens
GGMGTKSKDKKLFGTNLEQEDEFEDPNIDGEEEKLQPPPQGSTPFAHFKSPPKPFLPFAFNLPLPPGPPGPSAPDEKEEKDFDS

SEQ ID NO: 1018986 - protein, 137 aa, Homo sapiens
MPSLTVHSCRTILVSLSIWTKWEIHCPWAKCSWQGQNIGVGIPRSPGWTVPDILNDGKPRPQFIGGPPHQVWLSDPGAWGTNITLNPQASQSLEQYISVREPRSCRKMTECKSNVRGKKHPADSETNRTHLSMPLNK

SEQ ID NO: 1018987 - protein, 137 aa, Homo sapiens; identical to SEQ ID NO: 1018986

SEQ ID NO: 1018988 - protein, 196 aa, Homo sapiens
LSESEGPSACVCPGHRGGRWAGPLYRWKTGASGRPWWPRRAVMAAPAAPSPPPRGSRAGPVVVVAPGPPVTTATSAPVTLVAPGEARPAWVPGSAETSAPAPAPAPAPAPAVTGSTVVVLTLEASPEAPKPQLPSGPESPEPAAVAGVETSRALAAGADSPKTRGGSTLPKTRPHRDPYQDPFQNGSWAALTAKPA

SEQ ID NO: 1018989 - protein, 197 aa, Homo sapiens
GWPRREARGAAPSAASPAGGCEGLARWAMETGTAPLVAPPRRHGAPAAPSPPPRGSRAGPVVVVAPGPPVTTATSAPVTLVAPGEARPAWVPGSAETSAPAPAPAPAPAPAVTGSTVVVLTLEASPEAPKPQLPSGPESPEPAAVAGVETSRALAAGADSPKTRGGSTLPKTRPHRDPYQDPFQNGSWAALTAKPAC

SEQ ID NO: 1018990 - protein, 135 aa, Homo sapiens
EGLLCVGGCLRVFSLLLAARGFRGGLCPCPMLCRACACVVPPPCLFPWFLAPSRCGPGAPPCGEFRGFTPPSPVATGLWGVTSRVVPPVFPGCAWNLGRRCQTDVGPQLDAPRGGSTAIGGPHTRCQLFCAALEG

SEQ ID NO: 1018991 - protein, 33 aa, Homo sapiens
MGKRWRAGSERFGHPAGRLSSRAIPASSSASTP

SEQ ID NO: 1018992 - protein, 51 aa, Homo sapiens
GVRSVCIAKPEYSYNDKVPKAFIINDLMICARWSPPRSLKTSYTARPFCRL

SEQ ID NO: 1018993 - protein, 112 aa, Homo sapiens
MCKLCCTLTYAMTPGMPGKVGGSLLPGPVRGLTPSYPKGNLPAGFYALSKRKPFWNFFLGQFSCGLPGLYFHVGSPPDVGEQLASLLSSMPIRTLAFDLAVDFEIRIWKFLN

SEQ ID NO: 1018994 - protein, 129 aa, Homo sapiens
TKQETTGERGARQTLKRRTGWGRAHWGSPADGDTNRQALAEGSCAGLFINRITLECSSPGRAAQVGGRIQPEGRDGEAEFQSNDQGRGGAWSAHPGRTNPPPWVMNHEPKIVKRLGCWRWGQAGRLLLK

SEQ ID NO: 1018995 - protein, 128 aa, Homo sapiens
TKQETTGERGARQTLKRRTGWGRAHWGSPADGDTNRQALAEGSCAGLFINRITLECSSPGRAAQVGGRIQPEGRDGEAEFQSNDQGRGGAWSAHPGRTNPTIQQPSLFTAFCSLLTTQGGGARPAACY

SEQ ID NO: 1018996 - protein, 110 aa, Homo sapiens
VGIKRLGGPHPFSSSPHLMTGEIWNASWGGPAEKFYPTKGKGTWKVDNAPPIGVPPGKCPKAGQQGQPLQPQQPPGEQSRFRETQSFRLGSPPSGPEFGRSKKLPPGERV

SEQ ID NO: 1018997 - protein, 33 aa, Homo sapiens
ETPVFICATAGVSPGTKKPSAWCSLPDPPSITI

SEQ ID NO: 1018998 - protein, 248 aa, Homo sapiens
ECKEIQGSWRGTSESQPKRKKQRQKRHQERQRCEGGKEQESRKETQEEGAASPVNTEEHLFAVKIDLPRHPETMDIIFGRNRKEQLEPVRAKVTGKIPAWLQGTLLRNGPGMHTVGESRYNHWFDGLALLHSFTIRDGEVYYRSKYLRSDTYNSNIEANRIVVSEFGTMAYPDPCKNIFSKAFSYLSHTIPDFTDNCLINIMKCGEDFYATSETNYIRKINPQTLETLEKVDYRKYVAVNLGNVTSPL

SEQ ID NO: 1018999 - protein, 132 aa, Homo sapiens
MPILKGRSEVGLNSAFLFFFFLIFFQFYLYTYTMEYYSAIKNEIMYFAATCMELEATILSEVTQDWKTKCWHILAYKWKLCCGYTGPPEWYNGHWRLRRSEGGSGVRNEKLPIGYSVHCLGDGYTKSPDFTI

SEQ ID NO: 1019000 - protein, 91 aa, Homo sapiens
AQTPTTSKVPPLLESPIATGSFMFKLSVSSSVVGCCCWGILHAKDLYPTLPLLQSKLSAVSLRGMGSPSTDASASDVHGNFAFEGIGNEDL

SEQ ID NO: 1019001 - protein, 80 aa, Homo sapiens
GTQAQGSVRVAAALDTAWALGRFKRMLAAQGGGFRFGPSPVLGKSRRTPAAVALRPGAGGNFGAPKWDPLGPGAPGGPRA

SEQ ID NO: 1019002 - protein, 105 aa, Homo sapiens
GTQAQGSVRVAAALDTAWALGRFKRMLAAQGGGFRFGPSPVLGKSRRTPAAVALRPGAGGAAGARKWHRGAGPGASAGAGSARARGRAQPRWGTAPPGGGRKTAG

SEQ ID NO: 1019003 - protein, 162 aa, Homo sapiens
GLKFKALSGWPRRWTRLGPLAALNGFWRRRGVDSGLARALCLGSPAERRQLLPCAREQEELLAPANGTVELVRALPLALVLHELGAGRNRAGEPLRLGVGAKLLVNVGQRLPRGTPWLRVHRDGPALNGPQNRALQEGLVLSDRGPFAAPSPFAELVFAAAV

SEQ ID NO: 1019004 - protein, 347 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQCKREREAWAGALFMVPAGTGSEMLPHPAASLLLVLASRGPGPKKENPGGTGLEKKARTGRIERRPETRSGGDSGSRDGSPEALRF

SEQ ID NO: 1019005 - protein, 126 aa, Homo sapiens
MAALGAGANPAPAAGPGQVLTSPARATHAEDGNTCPAMSLGRLLRRASSKASDLLTLTPGGSGSGSPSVLDGEIIYSKNNVCVHPPEGLQGLGEHHPGEPGQARLQGRTAQVIFRARALKALGHST

SEQ ID NO: 1019006 - protein, 247 aa, Homo sapiens
MSLGRLLRRASSKASDLLTLTPGGSGSGSPSVLDGEIIYSKNNVCVHPPEGLQGLGEHHPGYLCLYMEKDEMLGATLILAWVPNSRIQRQDEEALRYITPESSPVRKAPRPRGRRTRSSGASHQPPRRSCGYPDPKDEDILVVAQSVPDRCSPALRQRMREKLAQGLGVDGAQPARKPACSPSGDLVDRQPEDVTEEGGTEGLSRGQKMVLEVNDGGDRDYYEKTKHYLACFDIKGGAKTAVERTDR

SEQ ID NO: 1019007 - protein, 74 aa, Homo sapiens
FPGPRWFIPILRVLLKARESKSPSGAPPERSFPESLKRTPWKTLGSCFSVNPFAKALGRDPLFFPARDSQPRGG

SEQ ID NO: 1019008 - protein, 124 aa, Homo sapiens
FRARLAPVGDLEEIQRGHPKYLHKAVFRGLLPEKAGPVIKVIPSIFNLVVKFRSQVISQAWGPPGGPRGAKPPNFALMQQSYNTFKDYSPFFFKMVAKLVNPGYQPPLEDFFLGINFNNYYQDP

SEQ ID NO: 1019009 - protein, 155 aa, Homo sapiens
TVTAEAVSQASSHPENSEEEECRPFTIPQVLRTKVPREGQEEDAQDQEDDADEEAAKPDHYVQAACSAREGSQAHGLSRKKGYRHDSSQQWPAAPEAMGRAVDNPTEECTNVQDQPHRRTMADRKRSGISHPETCQGQWGGPDSQAGSIAGASWG

SEQ ID NO: 1019010 - protein, 177 aa, Homo sapiens
KVPLHPGESLPYHSVYSKDEYDDTYDGTKVGANDADSDDELISRRPFTIPQVLRTKVPREGQEEDAQDQEGDADEEAAKPDHFVQAACSAREGSQAHGLSRKKGYRHDSSQQWPAAPEAMGRAVDNPTEEGTNVQDQPHRRTMADRKRSGISHPETCQGQWGGPDSQAGSIAGASWG

SEQ ID NO: 1019011 - protein, 84 aa, Homo sapiens
KFLPSSDPPASASQSDGITGVASAPAFSSIFACILRHTFARHLINYIILPHVPFRQGIQMVRVLPASRGGSKGASALTGAGRGG

SEQ ID NO: 1019012 - protein, 126 aa, Homo sapiens
GECESGLVNNFFWVACLEDFIENARLFFETFCRPQCFINMLADKLDITPEAEVNLIRNAKLDAKIDSKLGHVVMGNNAVSPYQQVIEKTKSLSFRSQMLAMNIEKKLNQNSRSEAPKWATQDSGFY

SEQ ID NO: 1019013 - protein, 73 aa, Homo sapiens
WQEDIGLGASQAPPPQEAIAFGPPGPVPIGLPARPRGWNPAPSGTLQTRAPPSDSVLVFPLTFPEVPVPPTRI

SEQ ID NO: 1019014 - protein, 103 aa, Homo sapiens
WQEDIGLGASQAPPPQEAIAFRPPGPVPIGLPARPRGWNPAPSGTLQVRGPLGMGGRGDLPGEKGPFIFFFWLPPIQTRAPPSDSVLVFPLTFPEVPVPPTRI

SEQ ID NO: 1019015 - protein, 75 aa, Homo sapiens
YFKFHMSQRRTHVAKTILSKKNKAGDITIPDFKLCYFQAYSNQNSMVLIPKQTYRPMEQNRDFRNNTTHLQPSDL

SEQ ID NO: 1019016 - protein, 112 aa, Homo sapiens
LEQTRLGTVALLQLMETPKLAGQEDPVRMQQLKMKVIKTMEAISEVFQDLRFDAELPSDGGSPGMPPAKWKTGGMENNPALTASWLGLGPPGLLTFLQFQTPPPIKSSSSVK

SEQ ID NO: 1019017 - protein, 86 aa, Homo sapiens
MHERTSSREEVGRERLNYGHTLAHAIEAHKHFTWRHGEADAVGMVFAAELSHRYLGLSDEVVARTRTILSEIGLPVTCDEIKWADP

SEQ ID NO: 1019018 - protein, 108 aa, Homo sapiens
WLAHGWNEFLLLTTANLCGRNTWIKFKNPLMPAAAWALTLVSVLTKEYEDAISIATASALSVVTVAFIQEYRSEKSLEELTKLVPPECNCLREGNSSTCCSRTVRDPL

SEQ ID NO: 1019019 - protein, 112 aa, Homo sapiens
MESSRGPKTLFHHPFIGMKFAGIHDPPPPAIMKCDIHIRKDLYAPNVLSGGPPMYPGIAARMQKEIPALAPSPMKIKIIAPPERKYFVWIGGPILASLSPFPADVDQQTGIQ

SEQ ID NO: 1019020 - protein, 70 aa, Homo sapiens
TPETESCQPAGIPHQTTGTPQGNRSSSTLSANPPEELVDFVVLATSTQDPATGRTAQRWGGGSLKKSHWF

SEQ ID NO: 1019021 - protein, 110 aa, Homo sapiens
TAAGIRLNEMELFLFGLQNSLKIEGLCLRGPSPWGSPRGWGRVFNAQPGAGGPWPPPVAHTLFGSLCPQYLSVLDREPGLRPALGRLWQEVLSPIPPFGAPPTFAQLSRC

SEQ ID NO: 1019022 - protein, 179 aa, Homo sapiens
AFYFIFILRQCLTLSPRLWSAMAGGTAASTSASSCAPISASQVAETTEKHHHAQLIFIFFVEMGFCHVAQAGLELLSSSSPSASASQSARIIGMSHCACPHCSFDLHFRNDSDGEHLFRCLLATCTPSLGKHLKAFATLIFLEMGFCCVAQASPKLLGSSDPPASASHIAGTTGAHHHS

SEQ ID NO: 1019023 - protein, 305 aa, Homo sapiens
MSVDPACPQSLPCFEASDCKESSPMPVICGPEENYPSLQMSSAEMPHTETVSPLPSSMDLLIQDSPDSSTSPKGKQPTSAENSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 1019024 - protein, 65 aa, Homo sapiens
AARHVCEKTTEGSQEGQAPTIETVVLYTEETRSDRSGQRIIDRDRKRHPGSPRIDTKDVKRITSQ

SEQ ID NO: 1019025 - protein, 157 aa, Homo sapiens
MDEQALLGLNPNADSDFRQRALAYFEQLKISPDAWQVCAEALAQRTYSDDHVKFLCFQVLEHQVKYKYSELTTVQQQLIRETLISWLQAQMLNPQPEKTFIRNKSRPSLRLGFLVQKYLTKWPKFYFDILSVVDLNPRGVDLYLGILMAIDSEFGGS

SEQ ID NO: 1019026 - protein, 188 aa, Homo sapiens
LCCDFMCYVRLPYMHVLLCVSVVYSVFPLVYLCLWLVCTVLLFVVCLCPVHAVVCSDLCRNNMRCALCVVYLHYTCAVSLCRTPVLLVQGVVWPVWASWVCVCAKGPRRPAVCLCQGPPVPARRAVFPQQVCELVVCAMSAAWRLRVRRGVAAPRRGARVLASGRGGCAPAGRAGAGGGWRRCGARRP

SEQ ID NO: 1019027 - protein, 122 aa, Homo sapiens
VSLGLYFPDSLLSYLSFSSSLQELRTAPFLFEAGLSMRTLGLTSMEDHPSLPRARNPMAVFHKPAGLLLFSLFNYTSLGVAYMLHLHFLTPSTPQSTILLLRLLTWPLSSTLFSTPTCPGAH

SEQ ID NO: 1019028 - protein, 174 aa, Homo sapiens
MKVGEIEHFPVPIQGLVTSVAPSLVALGFGRLVSGLTDGYRLDSPPPSLSSPTLSPAPWLIPSILYKPAPTRVQGRRLSTVGHPGSLRLHRLLTLDCKGWVRRQKVGILRQCSRPARDSGEEQQGSLNCHLQVAASSYHGAPRTQLRLAPGFFLVEPVAKQGGDLVYSLLGSLC

SEQ ID NO: 1019029 - protein, 141 aa, Homo sapiens
NDHWKLLHTISYWRSVYIFVCILEYLEYSLPCKKHFTCCFLRWGFTLSPRLEGTGEILAHSDLHFLGSGDPHTSAIQVVETIELCHHRPVSPCWAEFCGDRVLPCCPGSSLTVGLRCSARLGLSKCWGYRHETFSLNSCLI

SEQ ID NO: 1019030 - protein, 46 aa, Homo sapiens
MAEEREAPPVGRGRPRLSASAGLGTPRDALFPDAAPPPASPLDSAA

SEQ ID NO: 1019031 - protein, 92 aa, Homo sapiens
LEDPVYTNRIEFDTYSTDDDIVFEFRLRLKGMKDYDDQLCWNRGKKGGDGVGRGEGRIKIPTNGGLSQPIPSNLEASSKPTLPPPDTHWTLS

SEQ ID NO: 1019032 - protein, 112 aa, Homo sapiens
RLDQVRLYGAVHHRGVVELIIARWAEMHLEMCLKDREEEGACMCLNIYDPVVSVEEESVKSKEVVRISYSQPHTNTSHYHSLCPHSFKRRPFGDKAVSLFLSIKKKSKSFSK

SEQ ID NO: 1019033 - protein, 253 aa, Homo sapiens
KAESWAPEGLPTTAPGCAIATSSQPPAQTRDSPSMAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRMLADGRLVVSTLWLS

SEQ ID NO: 1019034 - protein, 292 aa, Homo sapiens [sequence omitted]

SEQ ID NO: 1019035 - protein, 35 aa, Homo sapiens
RRRQKGGPWTAKAKPREGKKHEKERKNEERNEGKK

SEQ ID NO: 1019036 - protein, 431 aa, Homo sapiens
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQTQSRSVTQAGVQWCISACYNLRLPGSSDSPASASQVAGITGTRHHAWLIFVLSVETGFLHVGQAGLELATSGDPPASASQSVGFTGVSHCVRPRGSILEVSETVNPPEGKLWTDRCLCRDTNASQTKAVQIYFNFQPGHPSDGVSPPSVFMEIMESEKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL

SEQ ID NO: 1019037 - protein, 371 aa, Homo sapiens
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWRVKKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL

SEQ ID NO: 1019038 - protein, 46 aa, Homo sapiens
MRGIYGLAGYIGELSMRFRRLCARSELRSMRMLGSRRAREKRLVKK

SEQ ID NO: 1019039 - protein, 266 aa, Homo sapiens
MAQAGNRVESSVGRLKLLLAVATAAHVALVFAVAVLLVSEVAPVGALLVVKHPFVVLHQAAQLLGQLQSQVLLGSGLTAVHHHCLCWLVQGGHQLLINEHFADDGVHRGQIQLKHVLQRLHADGVIDTAVGEEGGPQGLFLDLPNQHGADFVSLGEKAPHFPIHFFIEEKPVTGLSDTHLYGLGGTNHIARWTQGDPAGAVARSRAVVELLAEHALAGIALMGGHVGDLQEHGRNQGDTLQQPQVDVQVEGDLTAPLHLLLLLVAL

SEQ ID NO: 1019040 - protein, 252 aa, Homo sapiens
GRGHGGKVAGGKAAVQKLQKGLSPRFHKWDIDDSQSIRARDSGRKEYGGLNVLVNNAAVTSDDPTPFDIKAEMTLKTNFFATINMCDELLPIMKPHGRVVNISSLQCLRAFENCSEDLQERFPSETTLQKETWWISMKKFVEDTKNEVHEREGWPNSPYGVSKLGVTVHSRIPPRRPDEQRKPDSTPVNACCPGPVKDMDGTDSRTVEEGAETPVYLALEKNEKSEKLVNDKVVQTPVNVCLGGCWLIKDGG

SEQ ID NO: 1019041 - protein, 278 aa, Homo sapiens
MYTRTYGAYLDKAPPPGLPVETIKDLMRHSSNRPRFPSCHIASVSPSICKPRGTFLVTSWWYLVNAGVTFGLGQVSLQAYQTGSLQHRELVSTCWIRDASPKFFCSPHMQHLCAHVECGCIFAQMYRRKPLFCGNSEADQLGKIFDLIGLPPEDDWPRDVSLPRGAFPPRGPRPVQSVVPENGGVGQHSCCWQMLTFNPHKRISAFRALQHSYLHKDEGNPGVSNGVAAMEGRKAAISLLDTERAIIAFISEAMEGPPPSFYRDYFAALMTFPSHLSF

SEQ ID NO: 1019042 - protein, 130 aa, Homo sapiens
GTPRPSRADPQRLSPQKPIETHGPPRQDPQGRANQKPMETPGPRPAGPEGDEPTESPLETPGPGRQDFKGISQPRRGRQQSCRTQRWSLLPSGTLKERSARRGFGPPVPAAGAGASGAAAGSPQGLVCDP

SEQ ID NO: 1019043 - protein, 123 aa, Homo sapiens
VVVRAPPHSFKKCKVTGGGAHLFFAFLREALPAPKEEPPRFMTTPSSSPGFRCVATMLPGTFKSSWWALTVCPYAGTTPASRPLTLSLTLKPCCFKGPVVLGGPSYPGCLAVAVLLSRGGFHL

SEQ ID NO: 1019044 - protein, 66 aa, Homo sapiens
EEPLAGRTWRCQRLNSSIEPAGFQSPRKNLALKQSASRWRVVPGEKDLAIPFQYLLPVSLTHDLAS

SEQ ID NO: 1019045 - protein, 151 aa, Homo sapiens
MRDLQRQGSDGWLHDAAKRCPQFCCCAQGTMFSPSHRPACAYQTCTKGPGVGTEPGVGLGGDEDREGTWGLRQGGRGRGGTQSPPGTRGPRRDPAFGMGHQGGCHAGSASPGTSVASHTFLCELGKQVAGVRLGKVGAWDDVQCLWLSDRD

SEQ ID NO: 1019046 - protein, 135 aa, Homo sapiens
EKQARKCVPNLGRCSPSGPKALGYSFFPPKEKPLWDMGWRAGPKGPQGRPPSGAVPPGGKEGALCAPQEEKALSSGIKHPFTCIPPQKQAPQGPLSVPFPTPWPAPAAHPPKARPPPWECAQELRAGWTFVPKGA

SEQ ID NO: 1019047 - protein, 113 aa, Homo sapiens
PQLILLTSLGLRHASLFICNSHRHKNEFRIYFTNYLAGIWISLTCLIQLQYLCTNRGLRKEAKFAFHPNSNKRQLKPSSLLVAFKPLCYYDIYSLLSTEVLRDTYLLLFSAYF

SEQ ID NO: 1019048 - protein, 120 aa, Homo sapiens
MRGGCLGSGICAPSAHSSLSGPTGPCVFVFRQALLCRGLSFLPPTWAQCPEAGRWRSAADVPSSPRGGKLLLFPSEVWANMPRILPIPFLLSSSDHFQNVTSIILIFMLPEEVRKIFFLV

SEQ ID NO: 1019049 - protein, 184 aa, Homo sapiens
MDAPRRDMELLSNSLVPTRTSGQPESFGLYFVLGVCFGLCHPLPARHQTSRGAPDPRPGAGSAPGPRSSSLEPEEDDEERGGHGDSAGPDETLRARAVQKSGRVPSTSGLQVGGGSWSCAQRPGEARTDPAEILADGQRLVGTSELGQPRQGAGALTIMWARPVKGRVRTTMSKTQLGGSPKPG

SEQ ID NO: 1019050 - protein, 79 aa, Homo sapiens
STQAATRGQRLKGFRGSGTRPHTRAPWVGLALLFTPMLCQLHVLPKTVDVNYFKGKPVLFILKNPDNPPAVGHSFAPSL

SEQ ID NO: 1019051 - protein, 106 aa, Homo sapiens
MIIPLHSILGDRVGPCLKIQIQMKSQVRPDPFEAKQALQPHSCMIGFVWLWMRRPLSNCWLCNQFIFQYSNQIYFIILDGLRYVWILEFPLEQVVTSYWLHNSIIF

SEQ ID NO: 1019052 - protein, 106 aa, Homo sapiens; identical to SEQ ID NO: 1019051

SEQ ID NO: 1019053 - protein, 149 aa, Homo sapiens
LCPSGDHLSAWAPVSPACLPGITGVQVFRVVFSCTFGALPSRLCTLHAFSRLCNGHRVVLGVCQAFSVVVCRSLLLGTSRFRTLCIHWEFISTTSFFATQNSEGTLPIFLSSEHKKECLIPITCLGPVGVLGMLGPLGPQAWGTEPLVW

SEQ ID NO: 1019054 - protein, 99 aa, Homo sapiens
DRDPEEGDAGIYGFSTEGLTGPLNTNQNGRLNTTETHVLTVLEARTQNQGASRATLPPRSLGEQKVLRRDLLPQPFPSCSCLSAISASMATRHLLPGMG

SEQ ID NO: 1019055 - protein, 99 aa, Homo sapiens; identical to SEQ ID NO: 1019054

SEQ ID NO: 1019056 - protein, 287 aa, Homo sapiens
VAARPPVSRMEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLSLSYGAKVNPPLYTASPLHEACMSGSSECVRLLIDVGANLEAHDCHFGTPLHVACAREHLDCVKVLLNAGANVNAAKLHETALHHAAKVKNVDLIEMLIEFGGNIYARDNRGKKPSDYTWSSSAPAKCFEYYEKTPLTLSQLCRVNLRKATGVRGLEKIAKLNIPPRLIDYLSYN

SEQ ID NO: 1019057 - protein, 173 aa, Homo sapiens
MEPRAADGCFLGDVGFWVERTPVHEAAQRGESLQLQQLIESGACVNQVTVDSITPLHAASLQGQARCVQLLLAAGAQVDARNIDGSTPLCDACASGSIECVKLLLSYGAKVNPPLYTASPLHEACMSGSSECVRLLIDVGANLEAHDCHFGTPLHVACAREHLDCVKVLLNAA

SEQ ID NO: 1019058 - protein, 152 aa, Homo sapiens
SASRIAPRSMFERSTFSSRLRRTVRPTRLCSSQKRLIASACMRLSSRTSTLLTGWSSVISRIPDGRSDQFELAAGIHRRRFRHMEIDRRVRAHAQRRTDPHVAIERQVVCRHVIGGERGHVVDARTAQQVRRRHPEIGKRRGQRLVDRAAAQ

SEQ ID NO: 1019059 - protein, 85 aa, Homo sapiens
MGHRAQCPQGTLRKARSNAQCQETFGVTKPCPPKAKAKAKAKKGKGKVYPPSLDAKEPLVSNGAWPTPSLSQARDVTHQGLWFAG

SEQ ID NO: 1019060 - protein, 154 aa, Homo sapiens
IASLRVQSARLDHEHARAGACALAHLPLPGARRSRRDHLGVALLLQQVHARHGLSQHVYEQFLLQLQVVVLLQQHLAFGPLHLRLPAPGGPREQRRPRPRQLALSGPPPAAEHEGLVAEAHARRAVGEAQLGLARVVVQQVEGGQGGHAAQWRP

SEQ ID NO: 1019061 - protein, 103 aa, Homo sapiens
MTSFRWMGAKNLKKGLSQPLQCRPPAPLGLPVVLLPSFVGAGPLWGFVPCFGGQGGGGPQFPGPNSLQKWVKELAPPWAPHPGVLPPPPPALSLPPLLVGTSE

SEQ ID NO: 1019062 - protein, 134 aa, Homo sapiens
QELGIEPAGGLNPGPQEAILKELSRHEPRNQQAISMELSSDESCCSTGNNQARDQAGITQLQLAIVKQMSRQKSRSSAGPDQVTLQALITWLISPDHVTEHALSTWLSCTDDVTAACPDDVADQALTWLILVPN

SEQ ID NO: 1019063 - protein, 149 aa, Homo sapiens
WAGIGHEPAGGLNQGEQEAILKELSRHEPRNQQAISMELSSDESCCSTGNNQARDQAGITQLSWQLSSRGDDRIHAAQMAIVMQMSRQDFTSAGPDQVTLQALITWLISPDHVTEHALSTWLSCTDDVTAACPDDVADQALTWLILVPN

SEQ ID NO: 1019064 - protein, 218 aa, Homo sapiens
MPRGRKSRRRRNAKAAEENRNNRKSQASEASETPMAASVAPSTPEEYLSGPEEDTSTLEKASSTPSEASSTALVQKPVTRSNFQGTKKSLLMSILALIFIMGNSAKEALVWKVLGKLGMQPGRQHSIFGDPKKVVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 1019065 - protein, 42 aa, Homo sapiens
HVSGKITTGWQFTHAERDPLRGEWVQSAGNQGRHIGGDKPGM

SEQ ID NO: 1019066 - protein, 139 aa, Homo sapiens
EFGTSRIEAMTGCRRAPGPLWVGTSSQHRSLLPGTLGPAGSSANPVPRARARARDGDPQPLSVGHGQGFSRLPPPHRSPGVCGRLSPAFCVPSWAPSLPGRRAGPRPPFPLLPRAGASGGPFHLEKHSHSPLPPLYSEL

SEQ ID NO: 1019067 - protein, 134 aa, Homo sapiens
TSTHRTTVPSTMTPMLVTDTEAFWQPQPWFVVVLTATGALLLLALGWLLGRLLQGLAQLLQAPSKPAQALLLNSIQEIKGSIEGFLEAPKMEMSQAPSSVMNVQHFDDRAQDSRPEETTCLTHTQEPGAGSEAK

SEQ ID NO: 1019068 - protein, 86 aa, Homo sapiens
FLKSRVVRKSLARVFPVFNPTPKKNLRKFFKGKKFKPLDLRPKKTRAMGPRVNKPEENLKTQKPQRKERLFPLRKYPVKALGEALS

SEQ ID NO: 1019069 - protein, 158 aa, Homo sapiens
FFSAADPFFFLLSFWLHFSLFFLLLLQLFLLFLLSLSVFFPLLLSLLFLFFFKFFLTLPVSFSRSLPLISSGDGCFFQDAKLSHPIVSGFSAQSCPPLVFPFFFFLFLSSYQHVYCCRNSEWLRFAIFIFISTLLWKGGGLSRTAGNWKVDASVRHFW

SEQ ID NO: 1019070 - protein, 54 aa, Homo sapiens
MPGHLSELQPVNEVNTKGQLLARASSGKDPQVPNTAGQVGLLSPGNNLEGWARY

SEQ ID NO: 1019071 - protein, 50 aa, Homo sapiens [sequence omitted]

SEQ ID NO: 1019072 - protein, 205 aa, Homo sapiens
MPGPCPVEGSVGVSGMSTCLGGLKEAHGRPWPKKLIALGPEESAHQMVLWRIQELSDRVWREDQQDPFILADLDILASRHQAFCQALPQVSPFYAVKCNSSPWVLRVLAALGTGFDCASQVELEQVLGLRVAPSRIVYANPWKPASHIRYAAQHGVQLLTFDSEEGAHQGGPAPPQAQDSQSTFPLSTSSGPGWKLLGPGHVCKN

SEQ ID NO: 1019073 - protein, 100 aa, Homo sapiens
MVTISPGKRLGPDAEMGVGDELVVSRVLLRWVRLRVHISALLTGHPGERDEEGGEFFHIASLSPSSPGAPSRLRPPQLCGAGPDPEAEKTGDTPITAICG

SEQ ID NO: 1019074 - protein, 118 aa, Homo sapiens
VLKKIFGKGSKQRQNSIRTNAIPLAVPRLDRSLALGKKGPVASAFDLGQPPLPPLGFWGPLAPLQPQGLSLPFGSKNQTVPCSQPPQGFKVFMPFPKNLFFLAPPPRVGPPNKAVLFP

SEQ ID NO: 1019075 - protein, 359 aa, Homo sapiens
LEERAMRQFAMDAAATAAAQRDTTLIRHSPQPSPSSSFNEGLLAGNHRHQEMESRLKVLHAQILEKDAVIKVLQQLSRKDPGKATQGTLRPAKSVPSIFAAAVGTQGWQGFSTSERQTDAPARQTVDRGPAEEPPATPPLPAHTKHGSRDGSTQTDGPADSTSACLASEPDSLLGCNGSQGNLSGLYSCNQSPGSVRHGGNTDLKEGGLGDPEAWLPHGIPAIVFKCCTSLPPTSNGFVQELREEHSRGARKGCTPRRLLFFDLYFSHDNEEGRGLLLEQEGAEPPPSCQFVFGHEGKGDWILIPKNGWTPAKWSAGIIRPNHGVLWLSMAPASPNCSQSLTAFFRSLRLESFGEPLGV

SEQ ID NO: 1019076 - protein, 66 aa, Homo sapiens
AHPNSYQATLQAEPSTDRAPPTGPRPPQATSHPSEVKAQGLFFPPNLPQQTRERRMSLVLRKSIVP

SEQ ID NO: 1019077 - protein, 126 aa, Homo sapiens
ALAVTDLNNQDQAEHAEKSAAQTERVVRTIANNLQKLAEASQEAMTKIGTLDERAQQISGIVNLIREIADQTNLLALNAAIEAARAGEQGRGFAVVADEVRKLAERTAVGPLPISHDWLFQIRYCQ

SEQ ID NO: 1019078 - protein, 192 aa, Homo sapiens
ALPVGSLHGPSSCLSPSSPGPVLFPAGLSRPNSPSQLCLPAQLLPRKSHVRPSSCPAPGSLCKPQDPLSQAFQALPLAPRWHGEAQLLPDSGLSRPSSCLTLASLGHVSACLAAAPDNPGSCLPMASFRLISCLTTATRPHSCLSVASAGLTPASQWPLQARLVPRRGLLRPTFALLAQAQDFLKSFASPVG

SEQ ID NO: 1019079 - protein, 190 aa, Homo sapiens
RASRCSVDHSGARGPREGGKSSLQVPAIPPESETAEVLRGHPRSDTTPGRAGPRGSERESAVVAERSVRTPFRHENARDAAGPCAVGRGRLAGPAKPDEPGAGWLQLALPPWPGPEAPASRDPRTPGPNRLSRASDGVDPGRPQFGRFPGSPPVGSGRSGPRASGSLVPWAAPGRWRFSGARGGPPQTFP

SEQ ID NO: 1019080 - protein, 165 aa, Homo sapiens
EPDSVVFCFLVIEMKKKYDIALQFFTLIQSFCCDNDINIVRVSGMQRLAQLLGRRPRPRAPPRPETCIVFWSRPFIWTLGKAHGLVEVASYCEESCGNNQWVPYISLQLPSNLFVFSTNKKYNKYLNPLPPQHNPPKQPNPRGPSGAESLETEEEEEEEKGSERP

SEQ ID NO: 1019081 - protein, 143 aa, Homo sapiens
PPLSPAHSPSGYSASGASVVGSPRLLDRPTGPLYISLDCFIEGPLWAPVLFFFLLKDRFLSVLTLGVCGPGHECFLVVDWREALWTLYLGLPSLNWARPITVHRHRSCQGPSPPGSLSAEPSWCCPNLPVAFASEPPPVTCEQ

SEQ ID NO: 1019082 - protein, 236 aa, Homo sapiens
MASDEGKLFVGGLFDTNDSRWTGFQSTDRFECGVRQETKIRDWVVTFENIDDAKDAVMHEWEVCNGRQIRVTSRQVVRQRSRGTVVALRAGASSVGAEDGPWVLYGEGPSYGGNRFESRSGGYGAPNYYSSRSQVVATVTDSGGSYRDSYDSYGKSHSEGATLLWPAVGARYTLVPSPSTLGWTLRPCPLVLAQKRRICPLRSHFYRQDAKKPNENEQKRQGKARTRWDSQLGAIV

SEQ ID NO: 1019083 - protein, 32 aa, Homo sapiens
QCVRSTLIAQTQSHRAPNSKEIPKRGNFCRLL

SEQ ID NO: 1019084 - protein, 137 aa, Homo sapiens
SFLEWRLPPEEGSGKNPISTFGQRKQPGSGRCRESRSFNSRLIRGEPGGNPKIFQKAQLHPHNSSFPYQSFKVNFYPTRGSVVVRDKITTCQKAGGSRGVKTPPRPRSTLEPTPMGTACRLHVGCLHRSDVKIQSRR

SEQ ID NO: 1019085 - protein, 159 aa, Homo sapiens
EGWGWEIPAGAPAEQSPVSPRNSDALGLALRGWDHRGRAAAFATRSAAGLRLPQTARQGPFPPLPHPAKPPSQLPRRRRRDVTFRSPARTWEEVLVPSAAAPVSLVTLVSRWLSRKYPSIIVNCVEEKVRRRQPCAAMGVPAFFRWLSRKYPSIIVNSV

SEQ ID NO: 1019086 - protein, 244 aa, Homo sapiens
VFKLQTSLPINSMVLFDTVGGLKKYDPVWDFSEPFFDLSLKYYGLRKEWLLGMLGAESAKLNNQARFFLEKIDGKIILENKPKKELIKVLIQRGYDSDPVKAWKKAQQKVPDEEENEESAPEKETEKSDSVTDFGPPFNYFLDMPLWYLTKEKKDELCRLRNEKDQELAPLKKKSPSDLWKKDLAPFIEKLEAVEAKEKQNEQVGLPGKGGKAKGKKTQMAEVLPSPGGQKVLPRITIKMKAEA

SEQ ID NO: 1019087 - protein, 72 aa, Homo sapiens
PSCCLLCAVPPLCCPDSRKYVNGSTYQRWQFTLPMMSTLYRLANTVKPRLYEKYKNESCVVARVYNPSYWGG

SEQ ID NO: 1019088 - protein, 176 aa, Homo sapiens
QLALHMQRNSTHAAYATQLTLYATQLALHMQFNSHCVCKSTYCICNSTHCVCNSTRTAYATQLALRMQLNSHCVCNSARTAYATQLLQVLISGHFLFLTTTPSQYFSSLKSAQDEALDSRTCCMPLGLLEVCRLASPRLHPALSCLSCENPVASASPGSDFCLLPSSAAPLGPCLE

SEQ ID NO: 1019089 - protein, 297 aa, Homo sapiens
FSQAMEMIKTRDTVTGKTVLLLNYLQTVTFNGLKNNNNISVVYYWLNPTNPIEPRYLRNEDTTCAVCLNFWGRTVHALSHFPSLFFRFVADVFGVGGTSATGVFRLEVTCNNQNFCVARNTGDHNGLVIDPEPQAPGAHTDAVLRIERGGLKSPEASEGEIAPRLLLDGEPLALSGDKWRISPWLLVTDDTATITAFLQMIQEGKGNHLTLNGDQTISLSGLKQRCCLFDAQQKRGLGSENRVDPERGTEPPLRYRTGAALKEVAGLPKGRRHSQIRKREHLLDYGNWGIKWSGMAR

SEQ ID NO: 1019090 - protein, 177 aa, Homo sapiens
LAKITMKDYSKLGVHDMNDRKRLFQLIKIIKIMQEEDKAVSIPERHLQTSSLRIKSQELRSGPRRQLNFDSPADNKDRNASNDGFEMCSLSDFSANEQKSTYLKVLEHMLPDDSQYHTKTGILNATAGDSYVQTEISTSLFSPNYLSAILGDCDIPIIQRISHVSGYNYGIPHSCIR

SEQ ID NO: 1019091 - protein, 68 aa, Homo sapiens
SQDDPLGPQRISWKSPFTLGSELFGSLRPSLKRMTETLWATRCVSALGEAVIIDQLERYLFIQKLGEG

SEQ ID NO: 1019092 - protein, 122 aa, Homo sapiens
MLHEGILPRRALQDHSCQRGYATLENVVKSHSDILSWQMKGQPDSKWTRGIHGITACRVHVERHRRPVILDHCRTWGQFQAVSPILLKRSPQKAHSLVAQVNCAHPIERNCWLGTISCVLYA

SEQ ID NO: 1019093 - protein, 102 aa, Homo sapiens
MPPRPDSLSIPIFFLVHTLPPGLFPSGKEALFLIFYSFTWGQLRDLKGPIPNSPRFFFPRETKNDLENGGEGPSGTRAKTGLKVCGAGTVFGIFIPKKFGKG

SEQ ID NO: 1019094 - protein, 143 aa, Homo sapiens
QIDSPTIVSYIKPLVEISYDPAKRATTLALRGLDFADAARIFEGPIYETEDDRFDYPEPRYSTIGLLEGRMVVIIWTETEKGRRIISMRKANEENKPNTDPGWLDPADDAPEWTDEMFDMAAYIVGGKVIREATGYLGPNGMV

SEQ ID NO: 1019095 - protein, 63 aa, Homo sapiens
TGLGEIPERDCSKMALFNPRVAGCAITDEPEEVPPFGLRSQTSIFLGIEKKYVLSLIRYFDIY

SEQ ID NO: 1019096 - protein, 120 aa, Homo sapiens
RIARATRRSGSLESTARFMISAEIIDERDRSCARDVVRPIPDRAESCQDQLRALLQAVGDLDLLGQRIDDGAVMGDDPDGVHDAGVHRHPEDLDECGDGALIEGTEGLIEEQCRHSPTKD

SEQ ID NO: 1019097 - protein, 69 aa, Homo sapiens [sequence omitted]

SEQ ID NO: 1019098 - protein, 273 aa, Homo sapiens
WNTLELKYLLPNGGAAVGLLPPEGDAGGFRVGRAAGLAPGLCPGFMVLTALGQPQALGAYCSTSLSKSFSLAWYSLMKGWDLWASFSWDRYRFVTSGGFAQVLGQDDEVDQRLRVATILVYRLLQQALSGLPAALGHVAGRLPIEQQQGGRALVSHLLEDVVGILQLLTTRGQADPGSGELGEGGILVQVLLLFSSFRAMFQAVQFSRMWLCPGCPPGAAPGGLRVLVVALAGGGPAPARGVGPVAPALSVLGDAVPPTLVGEVVSHAHGPGA

SEQ ID NO: 1019099 - protein, 122 aa, Homo sapiens
GRSRSASRTLRTAGVHIIREQDEAGPVEISAWAASGSPERRPRSAASGPGESWGWEARARRAGDEGRSRGGAGVSGVNVYELRRRRRVRGGGSVDMVKPGRICFRFTGCVLTWYRLCPLRTT

SEQ ID NO: 1019100 - protein, 256 aa, Homo sapiens
FLGEVKLCEKMAQFACYKSLQRPNLKRTHHRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKLVKFPSLAFPCPPASSVHAGVCH

SEQ ID NO: 1019101 - protein, 236 aa, Homo sapiens
FLGEVKLCEKMAQFACYKSLQRPNLKRTHHRKEKGSREEKQKPQAERKEEKKAAAPAPEEEMDECEQALAAEPKAKDPFAHLPKSTFVLDEFKRKYSNEDTLSVALPYFWEHFDKDGWSLWYSEYRFPEELTQTFMSCNLITGMFQRLDKLRKNAFASVILFGTNNSSSISGVWVFRGQELAFPLSPDWQVDYESYTWRKLDPGSEETQTLVREYFSWEGAFQHVGKAFNQGKIFK

SEQ ID NO: 1019102 - protein, 142 aa, Homo sapiens
QELFKGKKGVLFGVPGAFSPWMFQDTLPGFVEQKALKAKGVQVVACFSVNNAFVTGEWGRAPKEEAKVWFLAVPPGAFGKETNLLLNDSLVSIFGNRRLKRFSMVVQDGKVKALNVEPNGPGLPCSWAKFLPPPLPISPAQP

SEQ ID NO: 1019103 - protein, 167 aa, Homo sapiens
QELFKGKKGVLFGVPGAFSPWMFQDTLPGFVEQKALKAKGVQVVACFSVNNAFVTGEWGRAPKEEAKVWFLAVPPGAFGKETNLLLNDSLVSIFGNRRLKRFSMVVQDGKVKALNVEPNGPGLPCSLAPNFFSQVWGPWAKFLPPPLPISPAQPCVGALQLECWPNF

SEQ ID NO: 1019104 - protein, 126 aa, Homo sapiens
SDSLTLSPRLECNGMVSTHCNLHLPGPSYFPASAFQVAGTTGTCHHAQLIFVFLVEMGFHYVGQAGLKLLTSGDPPASASQSAGITGVSHRTWLDMILLTFVMCSILGVCLHPTRHLGGIMRRAGS

SEQ ID NO: 1019105 - protein, 105 aa, Homo sapiens
KHFKNPSAPEWLGLEPSLQPQGGKLLVFGWWGMVPHPNYLGDLIMALGWSLPCGVSHLPYFYLLYFPALVVPRKARDKRQCLQKYGLAWQEYCRGVPYRIMPYIY

SEQ ID NO: 1019106 - protein, 160 aa, Homo sapiens
SGGTSRRALGAGTRPPSVGSGLYSELRTEPQLRLSALGITGRGDPGATRRAPSDDPLPQTGRGTPAPGGRSGAGRTKRLREDSVFPARLRSPGRGFSDRPARYRGNRKLAGCAPAPAAVPRSLGHRSHPALVKGLPHRPVLPICLALCAELESMAVINEF

SEQ ID NO: 1019107 - protein, 63 aa, Homo sapiens
DQTVTAASADPKLSHGKGMINGVLRRFLREQPALVADMQADPSAATNYPMWWIDAVRSAYPDA

SEQ ID NO: 1019108 - protein, 421 aa, Homo sapiens
MGSERLRLPPHASQVAWDYSAFSTDALANSRKTLHERYGSLYVALSSSQTPGLKVILLLWTFPKRWDYRLLEPWASGPEDTGLPVAMTTGDCCHLPGSLCDCSGSPAFSKVVEATGLGPPQYVAQVTSRDGRLLSTVIRALDTPSDGPFCRIWPWKEANEGVIADPGVDDNGTLGAVHKTLSGEVASLNLTPATASCATRSLQWRNGLEPLTEWLKDPGPRTEKRTLELLTVRVLSVVSIDNTDVPVHLRGWVVPAAGPKDHLTGPQPSLAGRWVIIALSNLPVFTIYVLWTLVSFLLYTASCNSEWRKNQAESSLTIREAGQTRGPPGCSMAAGLLKKVAEGETDLNAGSPGTMQQIGQKVAGDTLSLWKDFHFQERFRLKQGLRHVTVNRLSKAEGTLPWRKAKIRGNSFVEGYLCKGD

SEQ ID NO: 1019109 - protein, 90 aa, Homo sapiens
LEYLSWALNELQCVQKGEKEGRGWTQWIEGDELHLEMRVEGVVCKAKYSRRCSEAQADNLCPKESAGCVGQDPPFCPALGKNVQPPPGIC

SEQ ID NO: 1019110 - protein, 159 aa, Homo sapiens
FLEPRAGTRFVQENQSGQPATEAAERTPWSSADQPQFQNMRQVIQKNPGLLPALLQQLGQENPQLLQQISRHQEQFIQMLNEPPGELADISVVEGEVGAIGEEAPQMNYIQVTPQEKEAIERLKALGFPESLVIQAYFACEKNENLAANFLLSQNFDDE

SEQ ID NO: 1019111 - protein, 69 aa, Homo sapiens
TLKEPASQGRIPPGGNCRKELQKSAQGSLESVLRTRLYMYRRKLHKPGKEEKGACKVNNFQTSHTVMTY

SEQ ID NO: 1019112 - protein, 93 aa, Homo sapiens
RERMVVPGEGPLAPGNLSPSKQGVPGPRESVGTGQPVFCSFLGWEAQGQNNTPGKVGGGVGALSRPPMLGKAAKAWGLQPGTAVMGYPGDGPL

SEQ ID NO: 1019113 - protein, 207 aa, Homo sapiens
RSQAGLESLLPAPDWAGSPGLVSKSGYREQPDRGEGLREAEHRPQRPACSRNMSTNASASFPGGTGTGTSTRTSTGTGTSTRTSTGTGTSTRTSTGTGTSTRTSTGTGTERKAEGPPEAGGTTAQVPNPDSSLDDTSYSLSEWSVRSEWRSVSDPLASSQVEHVLNCRGRLPGAPAYTPQSALPVLARVLTSDFKWASGVLSGFTNP

SEQ ID NO: 1019114 - protein, 99 aa, Homo sapiens
WVVENCARLRRDGVRNAPDSAWAVVLEPQQVGVRPCQPFPASIPGHLQSLPPGVCFETSLPGPPAGGQSALGHPPSCPGDVALSVFGGCCPLALGPHGP

SEQ ID NO: 1019115 - protein, 345 aa, Homo sapiens
MTLGGLAPASKMNKNGKKSFYYTISDFFGWGSPHVVLIFRGVNIYITKTVKTRKKNRNLAVAETGEATLLSSVQEFPGSQLAGKNLLTFSFGSCFLKNNQKHSNVQILVSLPLNGLDVPLVLVKVVASLYAKFLEWSLILKVTCRWLQVPEEPGVTQNCSAGWLDQGSPVGASPALASWPSCEGAYGGRGLNAGHRRHRRYPRRTPDGSVGTTGVDLQIPSNLQPLQLLRQLVDQEVPVTDSERIRWNTQEPRSQKDVHTTEGLPTHNLCATITSRNIRQRNGEHTTVNPQPQRPSHDENGRTPHPEYSTNTERRTRHAPNKILTAHTQNYTTTPQSTHPKNRTT

SEQ ID NO: 1019116 - protein, 547 aa, Homo sapiens
FFYIFLMIKTKHLKPQFLEEPLVLACFVSLFRLSWLDATTGPQSTSSLATNTTTDRHHSSIAPHRTRQHERAGQPDTLAPRQTEDKTRHSGAQREKAIPTKTDTNSTRKHYKTNSRYYNLTHKQHYQTHSTGKLLKDKYTTMRTKTQRTTKKPEQTLTDRGLPDTNHNDTENPTEHKRNGTNDKAEKQRKAQEQETQQNNRGEQRAKKSTERDKHERDRANHSAERKANQNSTGQQKQKKQDTTEDRTTQTQERKRAGQAHRAERERGQERENEKRKSRERKHGQKRREPTRSADEKRERTRREEGRERAATPTAKDASREDPQRGEKQERTDTERTARKNRQKEDSKQDNKPQERTRNSTAHRKPETQKTEEQTTEQGADDSTASNAAHSSRDRNAQMNRRSERKEEHEKRSKKKREEKARRGQWRRPEEEKGERGEERQTTGARRGAGRQEQQTSRARGSRREQAGGGDRREEEGKERERARGNEERAGKGEGRRRARREKKQGEKQSGARSTIRQRQRRAKAEEEGRRELAAGARGQRPQERES

SEQ ID NO: 1019117 - protein, 73 aa, Homo sapiens
VGFISCPKKLDEAVAEAHLGKLNVKLTKLTEKQASTWACPVMAPSSRITTATESQVCVSPSSCCPCPGPTSPP

SEQ ID NO: 1019118 - protein, 97 aa, Homo sapiens
AGPLLSPWAWQNIAESTKGNDPTLALTVAKSYRSFSNLWKHGKTHQQQHQAAVRQQLAEAEAAVGLAVMETAVEALPLVEAIEIYPLAEVEGVQISG

SEQ ID NO: 1019119 - protein, 100 aa, Homo sapiens
MGMRFYHSGKFMPAGLIAGATFADGHTRWSVCSTDPLAEVMFQLRLMKNSKSASSTIFNILREISAAFWLLTFYLKKKTPNLAERWKISHDYKPTEVASM

SEQ ID NO: 1019120 - protein, 112 aa, Homo sapiens
GHLHNYLVVVPPLNTAGLFDNPGIGPGGFSSLCGAREKDKYARNPALNMAPLSTCGLPFWANHQRPGWPFLGGEYIGPTLKNHGAKRSRFPWVLTRARSFWATFKPGPWGCL

SEQ ID NO: 1019121 - protein, 100 aa, Homo sapiens; identical to SEQ ID NO: 1019119

SEQ ID NO: 1019122 - protein, 101 aa, Homo sapiens
LMVQKQQEALEEQAALEPKLDLLLEKTKELQKLIEADISKRYSGGPVNLDGNLFVTPPVFLPAHFFRFWDENENQGCCFGALQGKRPGCLENGKPQEGSGP

SEQ ID NO: 1019123 - protein, 106 aa, Homo sapiens
FYPWHTGRDYQQLCSQQDLAILPWVREFNKFDLYTKCPDLPDVDKLRPYYQGVIYKYCPGILEVVTLLPPKLLLDLGLALRLPGKAWPWANNRHQGLPRWGTPLPP

SEQ ID NO: 1019124 - protein, 116 aa, Homo sapiens
SWGAQVLLIEAQPAQRICRRGAKCTRRAARSCSPATAPRPAPPRGDSEPLPPPPGAERRALGWESGTRSRQLFISRKPPQPERKGTFCHQRGISQRRAWIYEDTHARSGQDLDKLF

SEQ ID NO: 1019125 - protein, 80 aa, Homo sapiens
QTPLQPSSKRCVSYSTSLRERITRLWIQYMSNSYEQLSKLDNTVQDAGLYQGQVLVIEPQNEDGTWPRQTLQSKICHYVR

SEQ ID NO: 1019126 - protein, 103 aa, Homo sapiens
IQQRGAVLLAGAGPVDMQVTTARGVWSGRPGSSTLTATGSDAAGRCGTALETGCELCDPGPKRRASCRGDPLGGFVKTTSQTSCLEAGCPLPASAAWCPLPGA

SEQ ID NO: 1019127 - protein, 114 aa, Homo sapiens
MKSSTLLILVLQALLVSTAVPKGPAGPKKQCWCGECTSWSGVWTCDDLLTKCAATCKNCVPVSTDKGATKYRCRDFLPRKLRLQDPLDSSTAAQPMDPSMLLRPSALLQAGSHQ

SEQ ID NO: 1019128 - protein, 151 aa, Homo sapiens
MGLDYKEGGSPFLPYKMCDFLPKEGVGILAPRPPPPIPRGAANDLGPTLHHGVLCGPLTLNPFAKPALPLCLFRGPGPRPGSWGMGLFVSPLPEFMFRGPELNMSPCSQNPALSGSSRSPPLFPPPPGVCGPRAFGDSPRDKLLMFPSLPL

SEQ ID NO: 1019129 - protein, 108 aa, Homo sapiens
MVGYTKELAPVRAIWSHGKNMIQGGTLGLRYKIRAVYAPFPPNGVIQEKGFLVENPNFLGEKNNPRGRIKPGVACSVFPAPKNEFIPEGKDLEAGSNSTAFIQPAPPV

SEQ ID NO: 1019130 - protein, 44 aa, Homo sapiens
MTLNSGGLTVPKWVQVAVTSTYGSIAPNAAWVASDESLGFQGVV

SEQ ID NO: 1019131 - protein, 156 aa, Homo sapiens
MGLPSYIPTPIYFGAVIDTTCMLWQQECGVQGSCWEYNVTSFRFVYFGLAAGLKFVGFIFIFLAWYSIKYKEDGLQRRRQREFPLSTVSERVGHPDNARTRSCPAFSTQGEFHEETGLQKGIQCAAQTYPGPFPEAISSSADPGLEESPAALEPPS

SEQ ID NO: 1019132 - protein, 112 aa, Homo sapiens
DKVRFNYMFWIMCWVFTLYGFLLVMFVEKNYQVLFLEYEGKLVKHISELDRTPTNIVLPISKSFTVFSHNGRYQLFCNMLAVLHVDRIFKITSVILISLLGIRIIFPHFYSL

SEQ ID NO: 1019133 - protein, 103 aa, Homo sapiens
MQRKTLAQQSKRSHSSKTRTVNHFPRKKENSPLGKKEEEHWILTFWILTLGCKTYLPLSRLPSPSTLNVLLSFSVSAPSSPFTLPPPHTLHPLCTRRSEGHLE

SEQ ID NO: 1019134 - protein, 140 aa, Homo sapiens
SPSAFSAAAPPWLEETPPQSVPLLPKATPISSGALGGLFGPPLYSPGPTLMNMPAAQQPGGSDSPVFEGEFMHHPSPWQPPGDSPFSIASLFLSAKVTARSDQLDLSGEPRLLHCGLCMDPRGCGDLGDSNQVIPFSRMH

SEQ ID NO: 1019135 - protein, 140 aa, Homo sapiens; identical to SEQ ID NO: 1019134

SEQ ID NO: 1019136 - protein, 216 aa, Homo sapiens
GKRFPSKGKLLGSFPSSWRVVVFRKKVQGYFRSMSLQKSGQGVSRAQRQFKRGAPPRRLSIRNAHSIHHGLRKRLNQDAIAATASVFCSNDAARGGRDRKAPGARLRRSGKRSAFNPAGGAPAAEGRPHPEPLQREPPAEAGVFRFRVEGSPQLAFRPFPPRACTYVFYKAWGLDAEGSPDPCPGRLPPPSINVAWSGPRLCRNAGRAGVRPRVFF

SEQ ID NO: 1019137 - protein, 94 aa, Homo sapiens
CRDRARQSPSEPVFLLSHPPFLSRAYACMHACVNSHTHGGGSGPSVTLLQSLHSSDKKLFVKTNVISENTILHAPMACHNFFFFKWNSPILLHE

SEQ ID NO: 1019138 - protein, 67 aa, Homo sapiens
VYVVDVSQGIVNAVKDPDANGKSFAFVGPSGDLFFHLGNTSLLWVTDCSSHSPCRFLPIDGEQKFFK

SEQ ID NO: 1019139 - protein, 96 aa, Homo sapiens
RPDDEPRPLNTMFLTFWVGVNGTILKMSSERFACFDEKQRHLQEDYLRELLTTMGDRFTDEEVDELYREAPIDKKGNFNYIEFTRILKHGAKDKDG

SEQ ID NO: 1019140 - protein, 96 aa, Homo sapiens; identical to SEQ ID NO: 1019139

SEQ ID NO: 1019141 - protein, 82 aa, Homo sapiens
LLPDTADHLTRLTTHTASWPGSSCASIVCQVCVWLAFLCAACRACRTPFGSQDAPPQRGTGPPEGPGKPCSNHMPHRSCYVS

SEQ ID NO: 1019142 - protein, 253 aa, Homo sapiens
RVRCILHGSHGGGLASVRMELILLLQESQQETSEPLFSSPLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEG

SEQ ID NO: 1019143 - protein, 114 aa, Homo sapiens
FPRGYGPAAFPRPPLGLPPAGPLGFVLAFTWCAVCPAPMGREGGFLGGFPFPPPFGYGGFVWPPTPGLSQICFNPPPFPHSGGVGGGGGVFLTKLFFFNPPVPRGPPPPFFFPP

SEQ ID NO: 1019144 - protein, 114 aa, Homo sapiens; identical to SEQ ID NO: 1019143

SEQ ID NO: 1019145 - protein, 114 aa, Homo sapiens; identical to SEQ ID NO: 1019143

SEQ ID NO: 1019146 - protein, 114 aa, Homo sapiens; identical to SEQ ID NO: 1019143

SEQ ID NO: 1019147 - protein, 186 aa, Homo sapiens
MANLRCRKIMSDPPMGFDPGTNAKGPQGTPGDTLRILVKAQKIPEADECGFDCNWGMICSSPPSLRPHVEKEAGTPANSTERKGKQGKKGLISLYLYITPGKTQKFVPALFVPPLPLGPPSTGMVFSPLPPSSMFFSPAPSCCFGCFPKVGFFFIWGSGHVMGRGGGFSNLRSQLFHVVYFVVPFS

SEQ ID NO: 1019148 - protein, 121 aa, Homo sapiens
QSQTASKQVAESVDQKHEYVTTTGKPMLLRAQPFCLLEGLSLGVNLKLIITLRQKLFFLKTDPAFVLSPSTLVKLHLWGNEGLQESLESLVLHDAALVILVPNLVCSPMSERDRGSGTPRE

SEQ ID NO: 1019149 - protein, 82 aa, Homo sapiens
RSVTGGMFSVYLENSKKVVGISSEHLEPIPPPKNTRVKVILGEDREPTGVLLSIFEDGIVRMDLDEQLKILNLRFLGKLLEA

SEQ ID NO: 1019150 - protein, 193 aa, Homo sapiens
GGGHGIVVELGRLHPGQRLMLTPLHEPLPAPQQIERHEEVKVLVGMAGEDEGGEAGLGRPNSQLLLQLAHQTGLRRLAGFELAAGKFPQAGELLALWSLADQHPAVHVHQGGGGHDQHLHASVPLLRPPLDLPRQGGQLMSPLLAQLYRAFAEAPALTGRRLQVYLWLLFGLNAAVALIWLGLAVMHGGLAQT

SEQ ID NO: 1019151 - protein, 109 aa, Homo sapiens
PANSVRYLLNPGGCGTGPVGKLGDEAARAEVPHLFGGDGVGGRVVGTAAGLRDEHDRLHGHRGHPLRVDGGAQLAGLAGRLHQLRQQREQGRMRDLDLSGVCHQQTRCE

SEQ ID NO: 1019152 - protein, 164 aa, Homo sapiens
RSVLVFQREAGPQGNKACVRAATVCGPGGCMCHLEGTNHSKPPHLLFPPPGPGLWPPKCLGELFSLDRPVGWGPGGLLCVNKIVRFALLTCCRHGGSINPPPHLFPAPEKGVLRWRCGVCTLAPALRLLFCPNATAARLPKGVDACRSPSKPGNSGKFPGLGRF

SEQ ID NO: 1019153 - protein, 76 aa, Homo sapiens
KSAVEASRLVAGKLKKNTAFENEKLISGKRQELVTKIATFWMPCSPWPHPPGGPGGLPFSVAGKLGGSGRLCMEAS

SEQ ID NO: 1019154 - protein, 133 aa, Homo sapiens
RGRGRGTGEWNGMECNGMESSVMEWKGMEWNRMEWNGMEWNGMEWNQLGSNRMEWKGNTPNRMEWNGMERNGTERNGMEWNGMEWNAMEWNGMEWNEMQWIQLDVKWNGIEWNGMEWNGINPNRMECNGMERN

SEQ ID NO: 1019155 - protein, 105 aa, Homo sapiens
MTDRPSPAQTGCNMDGWVGPLVRLVKGHGQEPGGLDSLPPTLFINRVDPNSGCLPLGFVQRICHRGMSSRGDDHLYRLGGSFPLHQVRHSHSGGWSWAVHLSGDA

SEQ ID NO: 1019156 - protein, 88 aa, Homo sapiens
SVSLDEVSLLSSVFDSVCSYVDSWSLEAFERLGYFFKKLFSHIASKLNILGFHSLKTDNPNMYGNFELLGYLVSMLVKMGNSCPCDRS

SEQ ID NO: 1019157 - protein, 147 aa, Homo sapiens
RAQRKNPQGQHTPKPKPKPQAEQGHDQPTRTGTNQRDGDQTQKQMEQANQQTGTDSATKRPKHPQARQPAPGHQTTPQHPEQRQPAGKTGAATTQPGPRLPFQHSQNPPPKHKVTRKKKQHHTPHPIVGEGIPCVSQANKIYLPLPK

SEQ ID NO: 1019158 - protein, 42 aa, Homo sapiens
TQPGGRRGGHPRGIVRLTPHPIVGEGIPCVSQANKIYLPLPK

SEQ ID NO: 1019159 - protein, 98 aa, Homo sapiens
LQTPLAREQLDPACLLQPRGGCLAPGAVNNGRPVSGSPFTMCTGSPARAMHLILHQLLPSPPENADVWIQWGMCSCSMLPISEQTFELSYSFLIGSPF

SEQ ID NO: 1019160 - protein, 120 aa, Homo sapiens
MKLCCFGHLGWGPLLWQLSGCLPLWGRPIPVGEAVVPVQEGERGFLSVFTSPAHVETGSGWSPSSSGEPVYSRSPLIQRSPRSRSSFLWGCPQGLFKRCPSAICPGPSALEVSRLICGGV

SEQ ID NO: 1019161 - protein, 107 aa, Homo sapiens
RKSPGTVAMTQSSGPELKGDIEKCLTAIVKCATSKPAFFAEKLHQAMKGVGTRHKALIRIMVSRFEIDMNDIKAFYQKMDGVSLCPALLDETKGDYEKILVALCGGN

SEQ ID NO: 1019162 - protein, 130 aa, Homo sapiens
PLRGAARTWAAFTWTVVLCFPPAQGPRRRLLRAPQQMAAKRLPAPASRPGHLSHFCFLTKVGTAGCVPSGRRHLTPWRGNRPSRQGRGMGGASVISTTHAPTQDAGPQTPPPQRFLIPRTAVAGRRVWKH

SEQ ID NO: 1019163 - protein, 155 aa, Homo sapiens
MLDHQEKDEKGMPVPARVVFVFGPNKKLKLSILYPATPGRNFDEILRVVISLQLTAEKRVATPVDWKDGDSVMVLPPIPEEEAKKLFPKRVFPPKSSLLAKNTSATPPTLKFFGKAGAVSQRMSAANCVFLQQFHKPILGSSHPRFLGCYTNGFF

SEQ ID NO: 1019164 - protein, 144 aa, Homo sapiens
CASSLVVTATVKSMVREPREGPPVTVSLIGAYKTGGLGLPSPPTGASLKFYGPCKQGPPMKKGVSYFLMGQVKKNKGPVLPPKRFVVFPRPNQGQILPNLNKRKGPFQPVGGAGSQDLKAGQPRPLALRPFFLSKKMFFNEGWG

SEQ ID NO: 1019165 - protein, 145 aa, Homo sapiens
GASAGPLPLVESPRVPGRGPVSCLSEANAVWLRHFCAFMFNFMRATGLCSTQPSGRFAFWHRGFICPHGGDPVTASSHSQAPSLFVHPGAALEGVCWGTGAFAGTPEPQKLPQLTLGGGRAFYSTRGQVGTPFPPPATIKFAPTS

SEQ ID NO: 1019166 - protein, 129 aa, Homo sapiens
RGRGRCTGEWNGMECNGKEWNQIDWNGMEWNGMKWNGMELTPIERNGMEWNGTEWNGMEWNGMEWNQPDCRGMEWNGMQWNGFNLNGMERMESTRVEWHGINPNRKEWNGMEWNGTEWNGMEWNGMEST

SEQ ID NO: 1019167 - protein, 67 aa, Homo sapiens
EQKLLASVTSCTKRLGTESQIFIPRTYDATTHFTTCDDIKNIYKRMTESEFDFEEMKRKKNDIYGED

SEQ ID NO: 1019168 - protein, 69 aa, Homo sapiens
AVNESPATHNEFLPQWAKGYPICIEATNSLGNRYSLHNIQSLVNTHVFIHFIPTVKPYLYGSDQYPIEH

SEQ ID NO: 1019169 - protein, 38 aa, Homo sapiens
MRLFFFPFIFLLSILGSFFFFLLSPVLLLLHHFLLSSS

SEQ ID NO: 1019170 - protein, 84 aa, Homo sapiens
LFKGKDNASSAEDLMALGSLPVTKNDGHSWEILCLLKKRQEHKRGFPESQLQEGKHVIGLQMGSNRGASQAGMTGYGRPRTIIS

SEQ ID NO: 1019171 - protein, 76 aa, Homo sapiens
NVSKKQLSMGAWPLRKKAQNVARWRKSKEISPLPGMGKSLRPRGSLADGRGGFPVPHLALEGRGAHPTVARIAEFS

SEQ ID NO: 1019172 - protein, 106 aa, Homo sapiens
MSPGTRITRFVCWDRRLQKDAIPSEESSNDELSGRISPSVTHPHHPPQATQLIRCAINQSNISTQLRNESQGVSPCIAGNSTDTAHIMTSRTPESNYSSELIDTCN

SEQ ID NO: 1019173 - protein, 240 aa, Homo sapiens
ISSSSSFGFISSSSPASFCSFFFSSSSFFISSSSFSFISCCKALMRFLLVLGVKPVPACLLVFIFTVVLFIFTFFLIGTRSKREDDISNSRERDRLGNAPFLSISTHSRISSSRSAISVDHKKLFAEEFRQAFEELVLEAAVIPRQELGQELKSICIAAEGTVALLELANGLFSHTWGDGATEFLTDFIQEAREVGMQGASFLGDRDGPVLGFASEKGDQKGHPLGAPGEMNLMVGYEGL

SEQ ID NO: 1019174 - protein, 105 aa, Homo sapiens
MWPHRERGGATHTTHITCAGPQALHGWCHTHGGRKHWSPGERGAPTHIRNIFSLRGLPRAHKVLPFLTGLEHLRIILYTNIGLASTAPLLPLVPPFSTGGVRTHV

SEQ ID NO: 1019175 - protein, 74 aa, Homo sapiens
VLRPICDRGRAPFQKFLMFDNTLGPFADPKSVGVVVIIKRIWGFQVVRAKDLRPEGLTLPIWVGVLSICPPLDL

SEQ ID NO: 1019176 - protein, 65 aa, Homo sapiens
VLRPICDRGRAPFQKFLMFDNTLGPFADPKSVGVVVIIKRIWGFQVVRAKDLRPEGLTLPIGWEC

SEQ ID NO: 1019177 - protein, 141 aa, Homo sapiens
RKPARELLTLDEKDPERLFEGNALLRRLVRIGVLDEGKMKLDYILGLKIEDFLRETLQTQVFKLGLAKSIHHARVLIRQRHIRVRKQVVNIPSFIVRLDSQKHIDFSLRSPYGGGRPGRVKRKNSKKGQGGAGAGNHKEED

SEQ ID NO: 1019178 - protein, 170 aa, Homo sapiens
PGLPGDLCGIFHFQFQYGEWVKVVIDDRLPTKNGQLLFHSEQGNEFWSALLEKAYAKLNGCYEALAGGSTVEGFEDFTGGISEFYDLKKPPANLYQIIRKALCAGSLLGCSIDVYSAAEAEAITSQKLVKSHAYSVTGVEEVNFQGHPEKLIRLRNPWGEVEWSGAWSDE

SEQ ID NO: 1019179 - protein, 186 aa, Homo sapiens
LPSGLSCFLCNACAFLCFSCVLLSSIGCFLFHCVPFSPFSIAWFVYGSFGKFLPAFSTAPWGLSRFIASLFNVWVVLLVLLVCFRCPVIRFPALWRLRWSLPFSCWFPTSRASLGLAVYQLGFLSEVLPDALVFSCPYFVLTFWLSSEFHTHSITYCGKESNSCRWAMFVATSLRCRRSGVYKATF

SEQ ID NO: 1019180 - protein, 108 aa, Homo sapiens
LDKFWIGSSLAPPKVDALKKMLLIKGLCPVFSSLLSPTGRGNLMDCSPGTTGPNYSGIILMPLTPNYYLCPPVQLANFYLAPLHYRLAVVQCVAVIWNSYLSWKAHRL

SEQ ID NO: 1019181 - protein, 113 aa, Homo sapiens
LGPPLAVNWAARPSKAEYSKGAVSLALSPPPPPLGLRPACVWGLGAFPLVVAPWFPGFGSLPSRAPSQAFGGPLDLTPSRKGLCKIVPGWGGSLCAPRPASSPMWPRSEPLGL

SEQ ID NO: 1019182 - protein, 117 aa, Homo sapiens
SLPHHTSVFPPSCFGAFPLHQPEFRFGPSTLQVGPVEQPLGSLGRGVLRLLLSHPPVCFGLKPGFEFCDQNQVGFPFLPPPGAPALEWEGWLPLPSKLPQRPVMDPRPQSPLCFGKG

SEQ ID NO: 1019183 - protein, 68 aa, Homo sapiens
LLVQGSTHQQAVCVFKKVLKTGRLPDHPLGKPRSCFGTKGELHPFSKFLGLPENHMVFPVPIDQCIDG

SEQ ID NO: 1019184 - protein, 271 aa, Homo sapiens
MGEQQNSVTFGKRHPVVDLTNIDPDVAYSSVPYEKGFALFYLEQLLGGPEIFLGFLKAYVEKFSYKITTDYWKDFLYSYFKDKVDVLNQVDWNAWLSLSWNCLPYSPIMICILTNACISLSQRWITAKEDYLNSFNATDLKDLSSHQLNEFFGQTLQRAPLPFGDIKRMQEVDYFNAINNSEIRFRWLRLCIQSKWEDAIPLALKMATEQGRMKFTRPLFKDLARSLTNPMIKLSEPTKSTKKACIPVTAKLVGKNFKKWIKRPAYVMSFR

SEQ ID NO: 1019185 - protein, 316 aa, Homo sapiens
LSILHPALTDACDRHADTREFASSRLPMSIIIVGVANADFTDMQVLYGDDGVLRSPRGEPALRIQFVPFRELKNASPAALAKCVLAEVPKQVVYYHGLPPRSLGFPAGASPGCNLDICGGRRLGARNGSVQPLSATCGSLKLPPTSQKPPVPTPHSLCPPGISAGLWPFSGAPKAEEVTKYPPCLLPEPLMDVYHEGLGVSWVVHPRDDLCPEIVSVYLWVLCFASNSFVGEGQQGSPPTLRRKPGGPMYTCPHSQSLGTQTSFPQSQPPVPAGAPTPTYPVLFAVGPLHRGSMGSAGVCGGSAWPVVSAGWGSQE

SEQ ID NO: 1019186 - protein, 115 aa, Homo sapiens
NTSPLSAPRLAHPFYKDPSQGWLWEFECAQPVKKDPALSIPQVLYASGDKRQEVPFRGFPLPQKFEPSLRRGQKPGGHQKHRVLALVPNELLKQTNQLFAIFCPQTCVIYVPGTL

SEQ ID NO: 1019187 - protein, 245 aa, Homo sapiens
VPKRKPSAPKKEQDRQTRLYETWQHMRGALYSVRDYFKDGGDGDKIPETFQATVDSRTRGLNNYSTKFWRQQPGNPSFIRRSEGGKRHSGAARAKLPDRDAKLLRLVGQIVLDAGAREVQDPDRQGLQHRIVTLERRGFVVLRPIGLEGDLRHFAVVSPFGRDQLGAFGRSAVQQHHVRVLGVDLIKLGPDQPVVVEVEPTGQRHLRARRQENLVMRALLRGQEIATVDHRRGQIAVVSLDPLRG

SEQ ID NO: 1019188 - protein, 69 aa, Homo sapiens
HEHQLYWTPPRKFGQGFRSCGVCSNRPGLIRKYGPNMCPQCFRQYRRKSVSLSWTKGSSFKGLSGAFTQ

SEQ ID NO: 1019189 - protein, 135 aa, Homo sapiens
RSTLSLYSGGQNRATSPFKVWGKSSSRSPYEEGAGRKANENKVGGMNAPKGQIGNSNGGAGSGGNIDRWKESDRKDGKKGSKTPRSAPEPKKTWGKSQLLSSVLQASMLLSLLMVKMKMREKIMPNRPLHPGVFS

SEQ ID NO: 1019190 - protein, 127 aa, Homo sapiens
MAGLPRWGLGTNSQGPWTDKTYLKPPVYGACKLLDMELEMAFFVGPGNRLGEPIPFPRPMSPFLDGPYERLECPTHSKVGVCPSRAIPWEKFWDPCEVIITGFCQGDGYALGFGQCAGKVLPAFLPS

SEQ ID NO: 1019191 - protein, 67 aa, Homo sapiens
AGATTWPKGPSLSPEEGAGAGVLPPSPPELSPGPGGPGPGGFGAPGSPGRVGGRPPPLGGGLGALVF

SEQ ID NO: 1019192 - protein, 69 aa, Homo sapiens
NTDIAQELCLPPVKCTAPCWAEDAIQAALADFNFKQEPQKGEAEKKMSPPSGKPPAGHTSCFPPGVQSP

SEQ ID NO: 1019193 - protein, 303 aa, Homo sapiens
ADEPPSLDPVQSFSQEAVDTARVLYLHSGPEAWSDAFSLDVASGLGAPLKGVLVELEVLPAAIPLEAQNFSVPEGGSLTLAPPLLRVSGPYFPTFLGLSLQVLEPPQHGALQKEDGPQARTLSAFSWRMVEEQLIRYVHDGSETLTDSFVLMANASEMDRQSHPVAFTVTVLPVNDQPPCLHDYIRPADVGGGTAPIPAEALRSTDGDSGSEDLGLHHRAASNGRVVLRGARALSAQFHASPGGTGGSVLSHTEGPRVEGRIALLKGREIPGKSLRWRAKQVAFAEASDLAVCSSEQEASQMV

SEQ ID NO: 1019194 - protein, 260 aa, Homo sapiens
GCAQAVSVRFESRGEGARRRPPGMSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKVITKFVCFLYLSVFSHDQG

SEQ ID NO: 1019195 - protein, 240 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIDNRKSKKY

SEQ ID NO: 1019196 - protein, 183 aa, Homo sapiens
MNRYAAGSDVTRHIRMGTIKPGSRIQPDHIYHKLPATPSESWSQVAGSAGCDQLFNRERAEVQSGHANFHQWEMPAGLRLNFASKEEATHSPMQCCFLNIMNSQEGGPSSQRQVQNGPSPDEMDIQRRQVMEQHQQQRQESLERRTSATGPILPPGHPSSAASAPVSCSGPSNRTLKEQNTQP

SEQ ID NO: 1019197 - protein, 123 aa, Homo sapiens
ATQQYVGPGQQLVPGEALLSQRPTSQGATLDACSFGVTGLKLQGATCNNNKLSLSNAISTALSLTQLRWVKQTNPEKKASVVTLPVYLNFTRADLIFTVDFEIATKEDPCSFYERGVAVLGTK

SEQ ID NO: 1019198 - protein, 464 aa, Homo sapiens
FGKMMDYLQGSEETPQTDVRWMSETGIIDVFLLLGPSFRQYSLTGTALPPLFSLGYHQSRWNYRDEDVLEVDQGFDDHNLPCDVIWLDIEHADGKRYFTWDPSRFPQPRTMERLASKRRKVAIVDPHIKVDSGYRVHEELRNLGLYVKTRDGSDYEGWCWPGSGYDFTPTRAWGNMFSYDNYEGSAPNLFVWNDMNEPSVFNGPEVTMLKDAQHYGGWEHRDVHNIYGLYVHMATADGLRQRSGGMERPFVLARAFFAGSQRFGAVWTGDNTAEWDHLKISIPMCLSLGLVGLSFCGADVGGFFKNPEPELLVRWYQMGAYQPFFRAHAHLDTGRREPWLLPSQHNDIIRDALGQRYSLLPFWYTLLYQAHRERHSCHEALWVQYPQDVTTFNIDDQYLLGMRCWFTCIRIWSQVVQVNCLAKRRGGFELSGYQKIMVPKPYGRKSKRIRVHAGATRQEETGSK

SEQ ID NO: 1019199 - protein, 124 aa, Homo sapiens
PSPKFYIFICLMKFSSTCPTGTNKIRSEQNIIFFKISLHPNRPLLAQLTIPACIHLINQNPRNVGVIYLLPSTSLPKNWIGLVISQSSVLFSLPVFQLCLFSLVPATALVRYSSSLAWLHPGDT

SEQ ID NO: 1019200 - protein, 249 aa, Homo sapiens
MIQSTEFEDSQEEQNNYICNYLFQVKLIASSMITFFCFKINQLRDWAWWFMPAIPELWEATVGGSVEVRSLGPALGSVVKSCLYWRMQELAGCGGPRLWFQLLGKAKAQKSRCCLQSADHRARSVSRQNNKKLTRKHGIHVTCEGTLGSATQGFAYNKQQRRWVRYCTPNTACEAGSLTGQPVAVKTRGYVPNNETGPRCLLNTIIDIDTAHQESTNTSRRTSNNTSSPAYVQRTTEHAGNYSLNINEL

SEQ ID NO: 1019201 - protein, 249 aa, Homo sapiens
MDNRTFRLSPECAYIPHAPQRSGRVYLNLQAVVISTAYGCADVRTAGQVPVMHRPAQFIAHKVVLASSSPVFKAMFTNGLREQWLEVVSIEGIHPKVMERLIEFAYSGSISMGEKCVLHVMNGAVMYQIDSVVRACSDFLVQQLDPSNAIGIANFAEQIGCVELHQRAQEKYIYMHFGEVAKQEEFFNLSHCQLVTLISRDDLNRCSVRVLRVFHSLSINWVNVRAANSDGLRSGGCAGGGLHSLRRNS

SEQ ID NO: 1019202 - protein, 139 aa, Homo sapiens
MGGWFCHCPALAVTFHCPQPSGHWRCQGSQGCNQNAPARGGLERGGRKLNPFGPQPCIAGWPLTSLGSPKLVQGGKSGFSIRAQKNNPLGFQKFLGLPLTPIYTAKMVFWKLLSFSIWGLFFKGKILKLNLGLLPPKNP

SEQ ID NO: 1019203 - protein, 497 aa, Homo sapiens
HEGFAPAKWAQPWLLRPVAATSIALLSLRALGVAQGGTWVNGSGSCERRSPRRRGLRRRRGHRDARMESAGRWAVHRRLTWTHGLCGAGALQNRLADWAREHEAWLGARCGPGARCAGIPGSRVNTAEPRDLPVVAGGGMVFCLSSEEPRRPAAKRHGPLPGPRKSSKLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYETFPPHEFFNYNPVEDFSMPPHLGCGPGVNFVPGPLPPPIPGPNPHGSTGAQWSTGGCHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHVRRMGGPCRQRLRHSERLIHTYKLDRRPPAHSGTWPG

SEQ ID NO: 1019204 - protein, 603 aa, Homo sapiens
HEGFAPAKWAQPWLLRPVAATSIALLSLRALGVAQGGTWVNGSGSCERRSPRRRGLRRRRGHRDARMESAGRWAVHRRLTWTHGLCGAGALQNRLADWAREHEAWLGARCGPGARCAGIPGSRVNTAEPRDLVIGCERGARMRVDCAVLATWRRRMGGAGAGTAPPVPWEALLGLEGPPLPSGYPECDQGLVATNVALLPVTILPYSIEQPLEGLALRADLPEFPTIGAALGGLYPCSPVVAGGGMVFCLSSEEPRRPAAKRHGPLPGPRKSSKLLHNKFVVILGDSIQRAVYKDLVLLLQKDSLLTAAQLKAKGELSFEQDQLVAGGQLGELHNGTQYREVRQFCSGSGHHLVRFYFLTRVYSEYLEDVLEELTYETFPPHEFFNYNPVEDFSMPPHLGCGPGVNFVPGPLPPPIPGPNPHGSTGAQWSTGGCHCFDVLDLHFHFRHAVQHRHRDGVHWDQHAHRHLSHLLLTHVADAWGVELPKRGYPPDPWIEDWAEMNHPFQGSHRQTPDFGEHLALLPPPPSSLPPPMPFPYPLPQPSPPPLFPPLPQDTPFFPGQPFPPHVRRMGGPCRQRLRHSERLIHTYKLDRRPPAHSGTWPG

SEQ ID NO: 1019205 - protein, 54 aa, Homo sapiens
MLLLVALLAPTLLLVAVCGARVGVWSADFSLGVLALKAGRVLAYLGLAAALAAC

SEQ ID NO: 1019206 - protein, 153 aa, Homo sapiens
LGALPLGRRPEVTSRVRARPGGENRDAEAQRLVPDGDGRTSPGGARSSSQRSPVGPAGVRSPRPGSPQMQASPSPGIAPKPKTPPTAPEPAAAVQAPLPREPLALAGRTAPAQPRAASAPPTDRSPQSPSQGARRQPGAAPLGKVLVDPESGR

SEQ ID NO: 1019207 - protein, 135 aa, Homo sapiens
GQVKIKRLGLRHLFSSSRLLNEQLKSGPAFVGGLVKNFYPKEAKVQWKGGYALPLGYSQESVPEQGSQGSTFSLSSPLAVGKAGFEKPKVFAWGVPPQGLGLPVPKKLHQGKVLKGEGPPPAPQFQPDPLPSFGL

SEQ ID NO: 1019208 - protein, 78 aa, Homo sapiens
RMLVADELGVDCMVQPESQIYGVITYFRLIQICRLAGKESVTLPGPIIGTSQQERLSGNGPSPSQQISRVLGKGHLVL

SEQ ID NO: 1019209 - protein, 82 aa, Homo sapiens
SVTGGMCSVYLKDSEKVVSISSEHLEPIHPPKNNKVKVILGEDREPTGVLLTINGEDAIARMALDEQLKILTLRFLGKLLEA

SEQ ID NO: 1019210 - protein, 228 aa, Homo sapiens
AVVLVQVFERDPSTEGILLPKACISIEIAYKSWGAGPQECSCLPSDSERWRVLFIGTMVNSFLYAGAANFIMVAHLAINVAKARKKYKVEYPIMYSTDPENGHIFNCIQRAPPEHVGSVSSLLIFLAVGGVYQPRIATGLGMAWIVGRVLYAYGYYTGEPSKRSRGALGSIALLGLVGTTVCSASQHLGGLQVAWAVDQMAALQNHRGLKISFISNDLPLFPVTCFLN

SEQ ID NO: 1019211 - protein, 118 aa, Homo sapiens
AVVLVQVFERDPSTEGILLPKACISIEIAYKSWGAGPQECSCLPSDSERWRVLFIGTMVNSFLYAGAANFIMVAHLAINVAKARKKYKVEYPIMYSTDPENGHIFNCIQRAPRIQGII

SEQ ID NO: 1019212 - protein, 82 aa, Homo sapiens
MKAIDFEYYGYLDEDDGVIVPLEQEYEKKLRAELVEKWKAEREARLARGEKEEEEEEEEEINIYAVTEEESDEEGSQEKGGD

SEQ ID NO: 1019213 - protein, 305 aa, Homo sapiens
PGSNMSKNRSVSEFGVLEELPVVHTGKAGPYIGVEKGERLSWVEEDMKAFGCQWMGGGGRFGPVHLPVSSLKLRHTSVGCSFCLGIFLSFYLLTVLLACWEKLEAEEEDTDMVDIEEPAQKAVTLESMADSFPGSSPYEGYNIWLLRECHWIVAMDLDDSAGHWGPSSYTVARDRVQLNRVGYSDTRTGSPVRLCWEEDDYEHKDRDSRYRQAQSNRQPDKERLNVARHLATEGTKTVIRCAETKQDTNNRRSAGTQNGHNAIREDSKKRERYMRATQTEKEQPRPRTGGQTREARAGQEESGRT

SEQ ID NO: 1019214 - protein, 124 aa, Homo sapiens
GKNILRKALVFNLNGITPVCRDIGGSLLTYGRRIPLADMGKPDFGGGFQCWYVKFAPSTSMTSAQQWLDMAPLRSSQTTTGSVGACFGCAFRREAYVSKRAGPGFVVPPPPQTQHFGSFNLCHR

SEQ ID NO: 1019215 - protein, 75 aa, Homo sapiens
GLDSLHTSVSQISVLNGGKAKCSQFCTTGMDGGMSIWDVKSLESAFKALKINMTCEEYVAFILNSWGNGERGQGG

SEQ ID NO: 1019216 - protein, 82 aa, Homo sapiens
TTTIFLGTTYDALSPELYTTYFVTKTLLLTSLVLMSSNSIPPIPLLTNSYTSYESSSRYDYVPLYISKPITISSGPYRFWGG

SEQ ID NO: 1019217 - protein, 57 aa, Homo sapiens
MQPQQQQQQQQQQQQQQHVTSWPGKQVETLRLWEEAVKARKKEAANLCQTSTAATGV

SEQ ID NO: 1019218 - protein, 223 aa, Homo sapiens
MDPNTIIEALRGTMDPALREAAERQLNEAHKSLNFVSTLLQITMSEQLDLPVRQAGVIYLKNMITQYWPDRETAPGDISPYTIPEEDRHCIRENIVEAIIHSPELIRVQLTTCIHHIIKHDYPSRWTAIVDKIGFYLQSDNSACWLGILLCLYQLVKNYEYKNQRSGVHWVAANAAFSCQFYTDRFNPSFFLTSLISLSHPETDIQIFYALGPDHLDLYQNLG

SEQ ID NO: 1019219 - protein, 79 aa, Homo sapiens
VSSVVPSQPEPLTLSKSPPPPLGLTPGLAFEYHDRRPSAEPLAGGARWNSYLQKKKRKGESEGKGIRWLQPNAATGGGS

SEQ ID NO: 1019220 - protein, 109 aa, Homo sapiens
KLEEEEKKEVTEEEKTKEEKEAKGVKEEVKLANGHQKKEETYLQPFYIFYFSVYLKNLLNINIPRRNQGPELRAAVLGEQEPPCHPFPLTLNKNKKVKGILLCNHKTNS

SEQ ID NO: 1019221 - protein, 143 aa, Homo sapiens
GFASTRAGSGKEAAVAIVKFCGGPAKDGGLNLTSTFVRKNQCETRPMLLQPAGSIGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 1019222 - protein, 114 aa, Homo sapiens
SCAQWCVPVIPVTWETEAAESLEPEEAEFAVGISSLAQTSFLSCKTSRTSFVSCTLWVISKCLVLELPGVVARRTKSGVQQTEISSVGKVIDWPPFNSSPEMVFEIATYNAVPN

SEQ ID NO: 1019223 - protein, 75 aa, Homo sapiens
VPTLDIMQIMYGISSSCILLYIDAQGHQRLYNCTLATNLQCLYRVSGKISGRSSDRYTRYEEFQQLSAGIAGGSL

SEQ ID NO: 1019224 - protein, 121 aa, Homo sapiens
MTDPSPVEVAWGAVALSGGPSRQGCQPLECARCWTEYGIRHFPCPSPESKLQNRCVGKDGEGDLGPAGTPICPKGQEAEGLGLPLKAADAGAHLITTIGPRKDSVAGPMAGWRGQRYPGTK

SEQ ID NO: 1019225 - protein, 148 aa, Homo sapiens
LYESDCSRGHIRVESHRTSPFFFLSWSLTLSPRLECCGAIVAHCSLCLPGSSESPASASRVAGITGARHHACLIFVFLVEMGFHHVGQAGFELLASSDLPASTSQSAGITGVSHRARPPFCVLTSLSTMSSGLTICCSTSQNFPPLQG

SEQ ID NO: 1019226 - protein, 210 aa, Homo sapiens
MSLKNDMYATFHHQLDGKVRVDVTYPAGFTGCHQHRVRQREHFRLCLMTPGPFIAVYRISSGRGKVQVVVISEEDSCGSDVESSLVTHDARTIRVPEILSSMVNDTVQIDLGTGKIINFIKFDTGNLCMVIGGANLGRVGVITNRERHPGSFDVVHVKDANGNSFATRLSNIFVIGNGNKPWISLPRGKGIRLTVAEERDKRLATKQNSG

SEQ ID NO: 1019227 - protein, 708 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKMPPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 1019228 - protein, 708 aa, Homo sapiens; identical to SEQ ID NO: 1019227

SEQ ID NO: 1019229 - protein, 708 aa, Homo sapiens; identical to SEQ ID NO: 1019227

SEQ ID NO: 1019230 - protein, 241 aa, Homo sapiens
SHFDNVSEPGVTMTCCEGWTSCNGFSLLVLLLLGVVLNVIPLIVSLVEEDQFSQNPISCFEWWFPGIIGAGLMAIPATTMSLTARKRACCNNRTGMFLSSLFSVITVIGALYCMLISIQALLKGPLMCNSPSNSNANCEFSLKNISDIHPESFNLQWFFNDSCAPPTGFNKPTSNDTMASGWRASSFHFDSEENKHRLIHFSVFLGLLLVGILEVLFGLSQIVIGFLGCLCGVSKRRSQIV

SEQ ID NO: 1019231 - protein, 38 aa, Homo sapiens
EDPIAVGGDLFCWNFSSSSSSSSSSSSSSSSSNNSSNN

SEQ ID NO: 1019232 - protein, 122 aa, Homo sapiens
MENEALKESVSSCTQRQGMKGAAGAWLPALGLPLVEEQLIRYVHDGSETLTDSFVLMANASEMDRQSHPVAFTVTVLPVNDQPPILTTNTGLQVRASLGTPPCLLRERGQRPLLRGSELPQL

SEQ ID NO: 1019233 - protein, 110 aa, Homo sapiens
DFQGHPEKLIRLRNPWGEVKWSGAWSDDAPEWNHIDPGKEELDKKVEDGEFWMSLSDFVRQFSRLEICNLSPDSLSSEEVHKWNLVLVNGHWTPGPHSWGLPEVPRLLLG

SEQ ID NO: 1019234 - protein, 102 aa, Homo sapiens
DGLARACAALGDWQKSATHLQRSLCVVEVRHGPSSVEMGHELFKLAQIFFNGFAVPEALSTIQKAEEVLSLHCGPWDDEIQELQKMKSCLLDLPHTPVGPAL

SEQ ID NO: 1019235 - protein, 102 aa, Homo sapiens; identical to SEQ ID NO: 1019234

SEQ ID NO: 1019236 - protein, 120 aa, Homo sapiens
TRESVPFAQHSSLDSRIEMLLKEQRSKFSFLASDTEEEENSSMVLGARDTGSEVPSGSGHGPCTPPPAPANFEDVAPTGSGEPGATRESPKANGQNQASPWSSGDDMEISDDDRGGSPPP

SEQ ID NO: 1019237 - protein, 169 aa, Homo sapiens
FLALVPTRVKDPVTRPPLKIRNTFGPEVHLLPPPSEELAFNKLVTLTCLAPGFSPKEVLVCWLQGSQELPPEKFLIWASRQEPSQGTPPFVVTSILGVATKDWKKGDPFSCMVGPEALPLAFTQKTIDRLGGKPPHVNVFVVMGEVGGPCFLAARLSPPLNKLHVPPSS

SEQ ID NO: 1019238 - protein, 84 aa, Homo sapiens
VCANQTIAPSKPAENLGRSSRNMIELDWNLPSFNRKDDCNENLAAFWSDKELLIWMLGSIDPLRLESCIRIYLKPRADWGRTIF

SEQ ID NO: 1019239 - protein, 114 aa, Homo sapiens
RLKGPQKDELKSFILQKYMMVDSAKDQKIPRPMASKEAPKKLIRYIDNQVVSPKGERFKNVRNPEAQEIKATYINLKPARKYRFHLGPCRTLPEPFRVRFQRDAGALYPYTGAP

SEQ ID NO: 1019240 - protein, 103 aa, Homo sapiens
QNTPHSHLVRATNISAQPVWLPQATATTHRCGHRSPLTSVGLAQTLDRPAAAIQAETPYFHLPCTALDCVPPDSGGSPQVVTVSSSLLVGLPCTCPGGGVGRE

SEQ ID NO: 1019241 - protein, 106 aa, Homo sapiens
IGNSEAVQYTQTSVLAHLPSGKNLLPKSISQTCRLPGFLTSLQSSHLTTFVRTIYAGNALCTVKCDEKVKVYAVRGTSFDAAATSGGHASSEKASSTSPVEIKPLQ

SEQ ID NO: 1019242 - protein, 33 aa, Homo sapiens
DTTIIIMIARHRYDHHHHDRSTSIRPTTTSVVF

SEQ ID NO: 1019243 - protein, 82 aa, Homo sapiens
GFVPCLPQSWTARFPVLNPDRRFHFDSRGLQLSWRCLESCQSSPSNFSQGFEELQGTAICVSIGEPWSRHLPRDPAPAVARD

SEQ ID NO: 1019244 - protein, 240 aa, Homo sapiens
MARLLEEASLDSGSGLWRAFMGAALHLSSAGACGTIELSLSKRKADISPLRCVNHPAAPRASHMNLQAHARRHCIQWLHPRPSKEQQHLEGSSTCQPWKGTPGSWRGQGVLACSRNSELMWPGPGAAWLLTGARSGTGEVGRRLPSCQGLDTTAFSCAPIFVQASLCVGIALCSTGMMWDASPVGLSEDNTVLPRGSDLGLTQAWGAKGEPNQLLPLCRAPPSPLPLCSPLHLLQEGSHS

SEQ ID NO: 1019245 - protein, 101 aa, Homo sapiens
RLRGAASTSETPPPPPRPLSLRPLPLKPRPPPPRPRLHLRDPFLRDPAPRLRDPASPLRPRPRQQLSPSCLLPLVLWVCPELCLCAPASSYVCNFNKTKQS

SEQ ID NO: 1019246 - protein, 78 aa, Homo sapiens
RVRLLADVHVSAEPRDLPAASVTPRSSGNPRLWDPALPLRHPPTPPLRCPPRLRDPASTSETPFSETPPPASETPPHL

SEQ ID NO: 1019247 - protein, 122 aa, Homo sapiens
PVRASVLGRAGPFAPGGEVTRRGLDGRRRGVRARTRGAQGRRGSRTLPAQRRLSLAPGCAQRARLSGPCGARCQREGSGHAGARDERARCFPKRGAQCRGSAGAPPKAHLEPSTTAFWKRCV

SEQ ID NO: 1019248 - protein, 143 aa, Homo sapiens
TLVHRTPYSLKIECGLKYPEAPPFVRFGTKINMNGVNSSNGVVDPRAISVLAKWQNSYSIKVVLQELRRLMMSKENMKTPSAARRTVLQQLIKKKNHRPFPFPPIRFNQSSFSTVVNFLDTSCRHSEYWKASSHSKEIYLKIL

SEQ ID NO: 1019249 - protein, 121 aa, Homo sapiens
TLVHRTPYSLKIECGLKYPEAPPFVRFGTKINMNGVNSSNGVVDPRAISVLAKWQNSYSIKVVLQELRRLMMSKENMKLPQPPEGQCYSKYEDSLSRPKDSVTAINQKEKPQALPLPPNSI

SEQ ID NO: 1019250 - protein, 140 aa, Homo sapiens
WAPPPPCFGGPRRRALLPPPFLGEWGSPPGWGAFCFPPFDPGFLFPAPWGQGFSPKKKFFVSPKNPFPRGFFLLFPLGPPPPLFFLFPGGPPWGAPPPRFPLGVFFGLFPGKTPLGKIGKGQKNFFIFPGPRGGWGVFPR

SEQ ID NO: 1019251 - protein, 101 aa, Homo sapiens
CPREATAGSRGARRGWRGRLYNGGPRCGGEGGVRRRVTVLRSLALPSLEGVSEKQYTIYIAPGGGAFTTLNGSLTLELVNEKFWKVSRPLELCYAPPKDPK

SEQ ID NO: 1019252 - protein, 199 aa, Homo sapiens
VYLGWLQQLYPSLTANMAAQKDQQKDDLSAVKCAELARPCCLKLIPPGAVPGEWLELAACATILALEHLLWTSMLLLTGPATWESIVPAPRTQRGCTTRATMCTLFLGLILYCVVTSPMLLVAPGFFFGACYILYLRTLESTLVLFGRQVSPAHQYALAGGISFPFFWLAGAGSAVFWVPGSPPGGYWVPRFLSPKLRF

SEQ ID NO: 1019253 - protein, 102 aa, Homo sapiens
SFSVSDFLNGLRTRKKQAPASPDSNENVPPEIRMPFLSSVEVKKGPGKCTECSSYAQTQTSVNVPSMLLKEHSCPSKMGKSLYPPPSPGMLTLIAKVNPVMK

SEQ ID NO: 1019254 - protein, 78 aa, Homo sapiens
LPFRTNPSMMIDDLLDSMLTRDPGAMEMTWMDVPGDKLLEPVVCMSDMLRSLATTRPTVNADDLLKVKKFSEDFGQES

SEQ ID NO: 1019255 - protein, 78 aa, Homo sapiens; identical to SEQ ID NO: 1019254

SEQ ID NO: 1019256 - protein, 172 aa, Homo sapiens
NTKKQKTNPPKHPTPPPPPPPHPPPPTPPPPPPPPPPPPPPPPPPPPPPPPPPPPPPPPPPPPPPPPPPPPPPHNYHYPYLRHYTTSSLKKPPSPLPRTPPTPSQQRQPASPTARSFYAQVLLLESRLADAPATPAQALPQRPSDISHSHPPRFTSRAVSSLGEEMVSFRSG

SEQ ID NO: 1019257 - protein, 74 aa, Homo sapiens
FSELFLSPQGEYRVAAWVILGGIYFFYTTENLNWVPVPVKGYWQITVDSITMNGEAIACAEGCQAIVDTRHLFC

SEQ ID NO: 1019258 - protein, 75 aa, Homo sapiens
RGSLGEPASPGEIRLPSDTSEELNSQDSPPKQDSTAPSSTSSSDPILDFNISLAMAKERAHQKRSSKRPQMDWNN

SEQ ID NO: 1019259 - protein, 111 aa, Homo sapiens
MPEKLTVEIEERAVSIIRYVHPGISTRKRFPEAGVLGAPMHLDYIRTVKELGNSLDKCRNNEKLAADPQQCAHHGRQRPALHHPGQQLSGGGACERLEDGCDMALELERLK

SEQ ID NO: 1019260 - protein, 169 aa, Homo sapiens
VASAAPGSAVATRISACEVHHGGRVPEAQRPICNFGGTDTTPSFIIGYRCLQLSIKGQDRHRFPPCSSARTDDPCELHRVPYSESLFNGSPLMYLNGNPAEPGASLLYRVAVTAHQIYYSSPSATSNMKDVVIDASTVDVLGFLVVLTLTHFGASSLTFSFWFELARKA

SEQ ID NO: 1019261 - protein, 169 aa, Homo sapiens; identical to SEQ ID NO: 1019260

SEQ ID NO: 1019262 - protein, 169 aa, Homo sapiens; identical to SEQ ID NO: 1019260

SEQ ID NO: 1019263 - protein, 150 aa, Homo sapiens
RREKRRKGSRGTRRFQLPRPGGAPPIGAPWGQGSAPPPGCCCFFFIACSAASHSLPVPGKGHPSAARRRARLTGCTWGGPRGGQPGGGGEGPKLPGSGDFLRHGPRRRGPSGRGVRPRFGALPVTGRRARPAPASVPTPRAPPRLGLACG

SEQ ID NO: 1019264 - protein, 232 aa, Homo sapiens
MAPQSSIEHVEPVNVLVVEHNASDNPSHQEHSSQDTEEACARGEVHLGLKAEDGDWNGYHRSDDHNDDGFGLVHTGNGARHEAHGKRKKGQQKEPGETASGSAAGKDQVGDNEDSKGHEEDSHNPPHKGADRHKGEDSKEATEKSSRTEKKEKTRKVRRTPRPSHPPGPKPPPTALPPPPKPGPGPQRGSGGGGGRGGGPAGPKPGGGQPGKAGNPPGRKTAAHSPQGAEGR

SEQ ID NO: 1019265 - protein, 116 aa, Homo sapiens
HLAIFFVFLVEMGFCHVGQAGLELLTSSDPPASASQSAGITGVSHRVLPALPVSFPRVTLSREMKVETSLLWLSGLRAGFRGRGHRLPSASWLWAAPFLEPSCLPRTSHLAAQLHP

SEQ ID NO: 1019266 - protein, 92 aa, Homo sapiens
KCQYITIETTALVYKTKAVYAIPDVICRTAEFERLDEHAERSCQLQMAAHGARTGMRVWAARQVYDPVLSDSRVPELGEPSHNTSTQYYNSA

SEQ ID NO: 1019267 - protein, 146 aa, Homo sapiens
WGLTPLAFPHSNWAPISHSLASAPDRLRQSASMGFCQIPLAHFLGLPGDPIQWVQPHPRSTHYVDRHMANMELKPVWAGAHLVVVGLQSSCRCPKVVRPHPPGQVETVFLDDSGYSRAKHDLDDTRRKSRLEPRKSWPCTLRYFQQ

SEQ ID NO: 1019268 - protein, 70 aa, Homo sapiens
KRAQFLVEKAKKEQRQKIVQPEGEAEAAQDAWRSTEQEPWLHQNFARFRAAQEYLTRRSPHHKNRIYLTS

SEQ ID NO: 1019269 - protein, 110 aa, Homo sapiens
LGSQSSHSRVAPARWGLWPLWPAGSTARGKHVCTPTHLPAHLSAMCSRTRAGASLGSKGPQEPPWSGWTGSPGGLGCWRPLRTRPPYQQVQGQVQLSILPTSSALPVRTG

SEQ ID NO: 1019270 - protein, 69 aa, Homo sapiens
LGSQSSHSRVAPARWGLWPLWPAGSTARGKHVCTPTHLPAHLSAMCSRTRAGASLGSKGPQELSLLALA

SEQ ID NO: 1019271 - protein, 113 aa, Homo sapiens
MEVGYEVGTARGRSGVTWSQESAVPYPHWYHLIPRCLCLCHPGLVAALKPGSLLETERKEGIGKVPAAQRRWEDALRLILMGALAWSLGPPAFGGLGSRPDGGGGARKKWSDD

SEQ ID NO: 1019272 - protein, 189 aa, Homo sapiens
PQGGLTGLVCLVCILSATCFTLQSGNYWLEIFDNFAASLNLLMLAFLEVVGVVYVYGMKRFCDDIAWMTGRRPSPYWRLTWRVVSPLLLTIFVAYIILLFWKPLRYKAWNPKYELFPSRQEKLYPGWARAACVLLSLLPVLWVPVAALAQLLTRRRRTWRDRDARPDTDMRPDTDTRPDTDMRPDTDMR

SEQ ID NO: 1019273 - protein, 153 aa, Homo sapiens
RALLQLSLAWSLSPASLFSCFFNDESWPVLLAEAGGPVCPGRSESPPSCGVGRVAGAVSSNSVLTRNILLHRDCGMGRAGNWKLRAAGSPPPHSTRSAQPCKAWPQPLLAVLQDLQGPCQSDWTLPGCTVLFFPSQSPTWFSNFNLITLFTKV

SEQ ID NO: 1019274 - protein, 123 aa, Homo sapiens
GCVTEARGPVENHWRGQWLHENARQLTNSSQAAQNLATSTRRCKETQGSVGGSMGSEDSGVQRRGDHGRAARRPRTLEHSESAHSWGSGSPWTAPAEPASLAGLEGARSLPQLQTAPRRARAE

SEQ ID NO: 1019275 - protein, 70 aa, Homo sapiens
PQGSGAFFYLIFQNLLPKINNRKAVKEDRSMICLWPGCPWARMPAVTTRETQGPTSFVKDAGTGFAEPPS

SEQ ID NO: 1019276 - protein, 102 aa, Homo sapiens
AGGRWRGGGEGGGRGGKKEGGGGGVWGGGDARNKGRRPYIQTARHNIWPGKPITLLGASRRPPHFNLNGGATSKLPFYHHGASGIGTILPNNPNPNTNYLPN

SEQ ID NO: 1019277 - protein, 110 aa, Homo sapiens
EPKTSNLCGNRAYGKSLIPAVPRISVKTSASASLEATAMGTEKGAVLMRGSRHLKKMTEEYPALPQGAEASLPLTGSASCGVPGILRKMWTRHKKKSEYVGATNSAFEAD

SEQ ID NO: 1019278 - protein, 103 aa, Homo sapiens
PSLGGPPSPPWPFHCFHFPGPIQVFALSQGGSLPAAPHQHYAKGPGVRGRAKVPRLVYQVVGEGPQPRGRLLSLGSVFPVGLRFGFFIWQTPMIFQKKISDAP

SEQ ID NO: 1019279 - protein, 44 aa, Homo sapiens
FFMQFVTINSIVKLHFKINKKLFWTANLHTQRTDAIQRVLTISK

SEQ ID NO: 1019280 - protein, 152 aa, Homo sapiens
MLKFTKVVENKGRGIVSHHLVFQPLWEAEGRRISGRSGSREQAGPHGATPPGTNSSKIGPEIEGVHPYVLGTPRKTRWTERNSLGVPQETQTDAKQRPHKWDTRETHTRGVESGDRRPTTRVEATHHWATKTIPPRGTDTKQVNYASDAKQR

SEQ ID NO: 1019281 - protein, 26 aa, Homo sapiens
MGVEESLWYEPSLEELLGCVDAARPR

SEQ ID NO: 1019282 - protein, 114 aa, Homo sapiens
KRKRWFRCPGNSPLSRMLRIPQPRSLGRAFVTRSIEWFQAMLHRLQTWWHGVLAWVKEKVVALVHPVQALWKQFQSFCCFLSELFMSSFQSYGAPRGGKEELPPQKCFEPQSSK

SEQ ID NO: 1019283 - protein, 69 aa, Homo sapiens
MGIEESPRTKREQKKGKRRRGAKKKALKKPRRNGKEKREKKREQKNKEERRENTQREEDKTEEKRVDDE

SEQ ID NO: 1019284 - protein, 104 aa, Homo sapiens
LIFALDGPGNKACGLVSPFQTQTKHGEFVPLAGSLAVDPNKPNVDDSKEYFFQTQLGWLTDSELVPLPRCLCWVSTCAPTWVPYFDPGKANLPLQTPQYGALEG

SEQ ID NO: 1019285 - protein, 53 aa, Homo sapiens
LEDFIFAFASRFRRFIQLSSNLQSMKFADQSPLNPVALLEELYTSQLIDATTC

SEQ ID NO: 1019286 - protein, 126 aa, Homo sapiens
AYASSECPLTGLHAALSIWAMQLALQQQQHKKASWPKVKQGTGLRTGPMFGPRGSHGTTVSPAVSRSDTVGREVLTCPVLHTWAFHSYPAVKPPCNTMSHLGTIHTHFAFCSTQVVPVNWELEGWP

SEQ ID NO: 1019287 - protein, 248 aa, Homo sapiens
DKDSIAPKTIPVTYPAKAKGTFIADSHQKLALFFQLEDVNTGAVLTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLPPPPPPTPPPHPPPPPQNSTLVPEERWKF

SEQ ID NO: 1019288 - protein, 247 aa, Homo sapiens
DKDSIAPKTIPVTYPAKAKGTFIADSHQKLALFFQLEDVNTGAVLTPHQTFVRLHNQKTGQEVVFVAEPDNKNVYKFELDTSERKIEFDSASGTYTLYLIIGDATLKNPILWNVADVVIKFPEEEAPSTVLSQNLFTPKQEIQHLFREPEKRPPTVVSNTFTALILSPLLLLFALWIRIGANVSNFTFAPSTIIFHLGHAAMLGLMYVYWTQLNMFQTLKYLAILGSVTFLAGNRMLAQQAVKRTAH

SEQ ID NO: 1019289 - protein, 142 aa, Homo sapiens
PERWTKVFRNKSCNREVRLRQQVRNEQQIWKQKIRELRLKSIDICLQMGEPRMSEDMRLKPRASLWCLPNPIPGVFAGRWLIEGGPLVVLLDVGASAWALERWKGELWDTCNIGVPWYDREANDAVLFGFLDTWFLGEVGPV

SEQ ID NO: 1019290 - protein, 296 aa, Homo sapiens
ASFCLGPNASGQGAVCNEEAERLARHSRSGDQSTRPRTLLVHTLDTSGDPYRWEIPGALAFLRQSCLENRDFVHVLTVQDWRTGRMNFDRENAVLFEVGWEVANKVGGIYTVLETKAKVTWGRMGRQIYFLVGPNTEQGVRTQVELGGGPPSPAPDEDTEIPCNSKGIPGVFAGRWLIEGGPLVVLLDVGASAWALERWKGELWDTCNIGVPWYDREANDAVLFGFLDTWFLGEFLAQSEEKPHVVGPFHKVSGHALDITPGVEHANCLVQTIITTMTRCWERNLVAVARTSTETG

SEQ ID NO: 1019291 - protein, 45 aa, Homo sapiens
MWGQEGDFLASVDGMRVWVEVESGYGGLTTVHFQFHAVDLDTPET

SEQ ID NO: 1019292 - protein, 322 aa, Homo sapiens
NVFSEDNVAKVSDFGLTKEASSQTGKLPKWTAPEALRKKTKSNVGILLWESYITRIPLKDVRVEKYKMDAPDYARTAVYEMKNSWHLDATCGPPSSESSLKEKPKSCTPPPGMGLWLNLEGPGPAHWTEPQRAGGHSCVPACTPPAPIIRTHLWLSPLEGGRKEATEREAAPHHVGLPWPPATRLLRVLFLSFFEIFFPCVYFLLFFKIRRKKVPSKWAFYKKYEFYFSCPAREGGGGPGPFLGTPGPSLIPHFVSHVPCLLGRPVFGLDNGALFARAPGKSLSGGWILCAAANRPPALGDGIVNNPAKRTPPPASGVSPPE

SEQ ID NO: 1019293 - protein, 82 aa, Homo sapiens
RLAVDLAVALTSENPRGCVKMALDLFSLRMHGGIPALFVRMRMDGSVCPTEQCIEELVISALVDRVTGNSDASALQIDPFEK

SEQ ID NO: 1019294 - protein, 121 aa, Homo sapiens
MLRRMEMDKTREWAEQLTKMGRGKHFIGDFLPPDELEKFMETFKALKEGREPDYSEFKEFKLTVENIGYQMLIKMGWKEGEGLGSKGQGIKNPVNKGPPPVDGAGFGIDRPAELSKEDDEY

SEQ ID NO: 1019295 - protein, 127 aa, Homo sapiens
MFVFALMVPQDPPFPPLGKEGGPMCFSSFFGIGGPPPKNEPPVSSIIWVPFGFGENFKFWEVLPFPRVGFVAGIPLKTSLEFGPDGPSPGFWGSQPPMWILGGPFCVSPPLQGLLSFFPKKPKILGG

SEQ ID NO: 1019296 - protein, 140 aa, Homo sapiens
MKRLLAFGLVASVPFIALGGVVGGWWPLNVMFTLLAATAMLYLVERGRSVAPIALFVVAGGLVEFCWPALLLAASVWLYLKRPTWAAALMALLSCASLWYINGNLWALAVVPLVIVAAGVDLRVPRLRWAFYTYYPLHLC

SEQ ID NO: 1019297 - protein, 124 aa, Homo sapiens
VFLLALTIIASTWALTPTHYLTKHDVEEIEDLVARLDELGGVYLHFEARTGNNSAYLDAATYKLMDYLGTEPSINDQVILMNAIFSKNFSSPEAFSVASAAAVLSHNRYHVPFVVVPEGSASDT

SEQ ID NO: 1019298 - protein, 259 aa, Homo sapiens
VFLLALTIIASTWALTPTHYLTKHDVEEIEDRLKASLRFTNFEFAFYSIVGLSLGAVLVKACYISNLYSNVDSLFYSSSPASASGCISISETKDLFLAAVIEDSSVQIYHAVAAGFGLPFGHPHMKHLVASYCLSYGGDCAGNSSSSASPTCFSMLPDGCIVEILVLLLSWMKLGGVYLQFEARTGNNMRLFEAATYKLMEHLGTEPSINDQVILMNAIFSKNFSSSEAFSVASAAAVLSHNRYHVPFVVVPEGSASDT

SEQ ID NO: 1019299 - protein, 106 aa, Homo sapiens
VPPRVKKLGFGLRYYFRNGTPNMFREYRGLTPPGAVTQCFPKMGGRPRAPAPSLQIIKVEEIPANKFPRPAVKQFPDSKIKFPLPPRVLGRQHKPRFPPKRAHPFF

SEQ ID NO: 1019300 - protein, 294 aa, Homo sapiens
MPSVAEACWGGSCKRESFESEWKEQKVALSQLTSLEMKDDFLHGLQMLKSLQGTHVVTLLGYCEDDNTMLTEYHPLGSLSNLEETLNLSKYQNVNTWQHRLELAMDYVSIINYLHHSPVGTRVMCDSNDLPKTLSQYLLTSNFSILANDLDALPLVNHSSGMLVKCGHRELHGDFVAPEQLWPYGEDVPFHDDLMPSYDEKIDIWKIPDISSFLLGPIEGSDMVRFHLFDIPKACKSQTPSERPPAQDVLETYQKVLDPLKDAMMFQAREMLPKPVQPIKVGLTGCLEVTAFYF

SEQ ID NO: 1019301 - protein, 86 aa, Homo sapiens
ATGKPPKYIAVNVVPDQLMAFGGSSEPCALCSLPSIGKIGGAQNRSYSKLLCGLLAERLGISPDRVSINYYDMNAANVGWNNSPFA

SEQ ID NO: 1019302 - protein, 91 aa, Homo sapiens
VLPARVQNAEDHYPTKNPFTWLFLLVSCPNNTPKDGVLIGFAIMTKVLPVALFSLVGFTQMTIWAKGKPRSYLKEFRDYPPLGMPIIPFLL

SEQ ID NO: 1019303 - protein, 70 aa, Homo sapiens
MQRLQMTVELPEYEYPREKLRRANWRRWGSGGSGVPFDLSKPLAKPSPTPPEKFLNELGGALGAKGGVAL

SEQ ID NO: 1019304 - protein, 67 aa, Homo sapiens
QVQIRRKKEIFRANERACVRFIQLDGLVWGASKLVPVGYGIRKLQIQCVVEDAKVGTNLLEEEIPKF

SEQ ID NO: 1019305 - protein, 164 aa, Homo sapiens
KAISKLKARINGLKKSYMPTGLGPQAKKVFLMRQVEPPAKEASHPSRGMTRDDDIALFGSDNEEEAKEAAQLREERLRQYPEKKAKKPALVAKSSILLDVKPWDDETDMAQLEACVRFIQLDGLVWGASKLVPVGYGIRKLQIQCVVEDAKVGTNLLEEEIPKF

SEQ ID NO: 1019306 - protein, 136 aa, Homo sapiens
MKTENKYTKQLITNRVLKAVRGSTTPNRPVLRFPQDKFNSSSFSVYQNTKEKSRGCLFRWQIGPLQAEGEKATSHTEVGCSRGAVGLGGPPARLARAPAGEAPDILPKCLSEPEFWGRRTHSGHTATEGQKGPCVP

SEQ ID NO: 1019307 - protein, 136 aa, Homo sapiens; identical to SEQ ID NO: 1019306

SEQ ID NO: 1019308 - protein, 277 aa, Homo sapiens
MARLMAGRLIRTRETGSKMRRRPRHVSGMDGERRWLQKDELSEREMGSGLEWDEQWDVDGMCCVMMSAWVPLVMWLKVSGWRMGCVARRCPSEGQDSDSSSDFFRLSASTAAMSLLLLVVSALHILILILRFRGHFGQGPGGLSLGKESLNLWYDCTWNQRPPKTWACSNVSENGWLKAVQVLMVLSLIFCCLSFILFMFQLYTMRRGGLFYAPASASFAPGVAVFTGALIYAIHAEEILEKHPRGGSFGYCFALAWVAFPLALVSGIIYIHLRKRE

SEQ ID NO: 1019309 - protein, 117 aa, Homo sapiens
MDLSKDGVSLLVFRLDNDIVGFSNGNPEFIDRHWLNVLTVGCDNRHFQAGDPHVEIGHRRAIDKAKPDFLPWLEDSRPVPIWRLAVHEVGVGVPAHVNEIGWAHLHLGPHLSIGHSS

SEQ ID NO: 1019310 - protein, 111 aa, Homo sapiens
KVCPLTFPLFLLGTYVFRSVLVTGDSLKVFSNGADLFGVTEEAPLKLFQAVHKAVLTIEKGGEAGGALFLEAIPLSIPPEVKFTKPFVFLMIGPNTKFSLFKGKVVNSTPK

SEQ ID NO: 1019311 - protein, 245 aa, Homo sapiens
AFCVRVDMSLAILEEVIMWDPRVSRPCLPLGHVATQYFAEQGHASVGWAEYPEEDLKRTMMACGGSNPDQCEGSVSRLCLARCQVFEETQLGGERYNLFDWLPQAKTCTFILRGGTEQFMEETERSLHDAIMIVRRAIKNDSVVAGGGAIKMELSKYLRDYSRTIPGKQQLLIGAYAKALEIIPRQLCDNAGFDATNILNKLRARHAQGGTWYGVDINNEDIADNFEAVRVGASYGADQCADSSL

SEQ ID NO: 1019312 - protein, 69 aa, Homo sapiens
EGSSQGLSPGLCFLLDGPSPAFWTLFISPALFLTTSWQKPWLQSLALPSTCTFLPLDFGFCQSCALRFF

SEQ ID NO: 1019313 - protein, 73 aa, Homo sapiens
ICSVGVGSLGLGSVVALCLLTFAPVFITFSLEGKRSWKVSGFSFLFFFFAKGLLPAFELWLSPLKVSYSALMN

SEQ ID NO: 1019314 - protein, 165 aa, Homo sapiens
MLPAPNPLWPQSHPPPQLCWSSAPGWHLHVAATLGLTCTSTLPRLTPILHPSPLLTTPAPPRAPTTPGLTPAPPTHTRRHTPPANPPPTPAPPPRHPTPHRDITRTPRHPTRPGPRPPPAPPTAPPPLPTPGPAPPHPTGPTPRPHPPPPPPHPPTPPPPPPPTP

SEQ ID NO: 1019315 - protein, 74 aa, Homo sapiens
VGSGSRAFFPFALILRKAEPLGCGGRGQGHIPTTCRARVPAGTFRLCWEEETWAWKEPVPDGFLVASPLPPFVS

SEQ ID NO: 1019316 - protein, 82 aa, Homo sapiens
SSAQWGIGIVVMIFGMISRMILWLCYPQEPEDGLESAYILQQESLPMKIGGIFCLFVLFCLVFGGWFFAPNFRIPFALLDKS

SEQ ID NO: 1019317 - protein, 139 aa, Homo sapiens
HSWLPARALVEALAQRFQVDPSGEFVELAKGACPWKELLYHLEFGLSPPVAIFFVIYTDQAGQWRIQCVPKEPHSFQSRLPLPKPWRGFRDKALDQVSGIPGCIFVHANGFIGGPRTRKGALSMARAPLAQRSYLPQIS

SEQ ID NO: 1019318 - protein, 152 aa, Homo sapiens
MIAVHCLIVLRYLLIPNVESSSVALLSFGPWSTPTLPPTVPVACHPEPSRVLLSCRASAAGQRVGEGGTDRRPRPDVVCMRWGGGEDGDRKRTESWTRSVFLVPLLFSSRMANPCGRCPSPATLVWLFDVLDVAVLGSIVCHACPPDSGAVT

SEQ ID NO: 1019319 - protein, 165 aa, Homo sapiens
MIAVHCLIVLRYLLIPNVESSSVALLSFGPWSTPTLPPTVPVACHPEPSRVLLSCRASAAGQRVGEGGTDRRPRPDVVCMRWGGGEDGDRKRTESWTRSVFLVPLLFSSRMANPCGRCPSPATLVWLFDVLDVAVLGSIVCHACPFPVPVGAPHVEGMRLAPSPQ

SEQ ID NO: 1019320 - protein, 80 aa, Homo sapiens
RAPPKRDTLIISTKPLFGLPWWWHHSGSSPFTTFCGSQTLGANGDCLKRALVAPHLGPGQWDRAWPGGHSKPLAFHWWVP

SEQ ID NO: 1019321 - protein, 266 aa, Homo sapiens
GGTPVRLSRGVVTATPGHQTTAFRTQGPASHPPGPKSLGPLCPEVRFPAPRFVAISSPQVSKDPRLARVPASRIQASGICAYQNLSLLQTFAIWGHSSLMDAKGPTVHSEKLLYFQLLGQGIRALRISQLLDIWHTGQSMRSLSAQPGEFEHSSFQEPRNFSAVNSQALRSPPKFQSPGAVTQLSPRNVGSWEGAQGVSSLASRRYETPVLPIMVADPPRDSKGLRSGGATANGGLALASIEDHGAAAGRLLRFPGPRCARCLLSP

SEQ ID NO: 1019322 - protein, 115 aa, Homo sapiens
AISGFGESYIWGQRQLHPGSGAAISRVRGSCIQGQRELHPGSEGATSGVRDSSGIGRVAETQYHLCPVVTTDASSWEPSYSMLVYLWLPILQAWFFILLEILRTLHYHLANSFSA

SEQ ID NO: 1019323 - protein, 152 aa, Homo sapiens
QDQGEKDEPMQEFCICRLRFNICLGESGDRLTWVTKVLEQLTGQNQVFSKARYTVSAFGNRRNEKTVVCCTVRGAKADEILENDLKVQECELRKNNFSDTGNFGFGTQEHIDLGIRYDPSIDVYSLDFYVVLEKPGFIIAGKKCGTGFIGAK

SEQ ID NO: 1019324 - protein, 69 aa, Homo sapiens
WAVWQSPPPALGFSGYRPPMESLAEWGSYNGFKPPLHYWLWAGCPPIRLGLLYFFLKKNFLGSRPLPWG

SEQ ID NO: 1019325 - protein, 195 aa, Homo sapiens
SVTLRIPARSNFFHQVGDARVGVDHDLVGQAHLAASVGLFGTEEVFAVGPVVIAQRHAHRGIGIHHLLSSDDFYLVGVGVQGITRRDTADFPVIGLDQFEGPLGASGNGLALVLFFGGHVTNLLLEEFTEDRVDIAGRDQLLLGERVGKGFADALVFEPQGLVLTGGDFDVSVVLQNGMIWLIKMSRQIGESSFQ

SEQ ID NO: 1019326 - protein, 146 aa, Homo sapiens
STPAASLALHDDAHASQHSRIQRYLQLLLLVIAAGAIYPMLYLRQVYQPTMLQFFRIDDVQLGYLYSSLGTIFLVSYLPSGWLADRLSPRWLICFSLLATGALGLVYATGPSFNTLVLIFGAWGLTTGLTFWAAVIKRVNMIAGPD

SEQ ID NO: 1019327 - protein, 104 aa, Homo sapiens
GGISQILDLVKGTHYQVACQKYFEMIHNVDDCGFSLNHPNQFFCESQRILNGGKDIKKEPIQPETPQPKPSVQKTKDASSALASLNSSLEMDMEGLEDYFSEDS

SEQ ID NO: 1019328 - protein, 184 aa, Homo sapiens
GNAAAGHAFMGTNTPWSQPRRSFAALFTPAVTEEFADTGGKLRCAGRGPGQPVRVAGKTAVVEKQRRSGTHVDGRQRFLPVSRDDEDGRWGSAACRRNSADRFPARSRWSARSGLKKETRAAAVIDEVSWLHTAHSGGSRPFCRRDIIPLLSIGLYDVWRSANLSLDQLRVLVTIADVGSFSAA

SEQ ID NO: 1019329 - protein, 164 aa, Homo sapiens
RLTLPASPMAAGVSGGYQFGIGQLRHSRAASPWVLSAGWSGSVLDGLEVGGGLIATDSYQATGFALGAQPWTQAQMQWSLGYSQPLHQERGMQSQMTLNQQFAGGWGEDLTYGLQSQSYQDLQQALEPSGRLEGLRDFFSVGLSWQGTGLCNFSVGGGQSRTRN

SEQ ID NO: 1019330 - protein, 139 aa, Homo sapiens
RSFDLWATASVCAAAGLPLSCCVLGRLLPAGQLGDWPALRVAPASSRWSQIICTWVWPALPVLTPRFSHPSHLLSSKFRLFSPSACFPRVDWWGRPVACLCCHLPRLSGPNQPVHPGQSPLKLLSNRMPHGPGPCGLRG

SEQ ID NO: 1019331 - protein, 120 aa, Homo sapiens
RSFDLWATASVCAAAGLPLSCCVLGRLLPAGQLGDWPALRVAPASSRWSQIICTWVWPALPVLPPGSAIPLTCFRRSFVSFPPLHVSRVEIGGEDPLLACAVTFRGFLGQISPCTLGRAP

SEQ ID NO: 1019332 - protein, 99 aa, Homo sapiens
FTGCMCCEYPKELAVEWVFGSVCALSVDPGAALSLKRPRAPGMARACLSPSGGHTPTPCHPMQDSPLCLAAPEAQGQPWCFVLLGPPRSQSLSFVAKAA

SEQ ID NO: 1019333 - protein, 207 aa, Homo sapiens
MRKIYLENYSNEAHSFSFRVQAHLQERVEPFYLLVLHRLVSKGTKNVSLQDITKEESFAKFYNSGPAAFRSQEFAIPLQETYDVGDQAAALNILTPDRDDGKEGLADMIPAPSKFYERRQSTGAEYRGSEQDQRRRSAQNLMVSVREKVQALMHGARKENTARHNVATSGQRDKEVQSVAAQRGHTDALRDAPALERGYGEEPSPPR

SEQ ID NO: 1019334 - protein, 285 aa, Homo sapiens
MLKQLSHDTLVQLPVQWNAMAAQSFKILQGAVNWHKGESQDAASEQETSILGTCATQHCLEALRMNWECVTNISWANIIRQLSSLGKYAEDIFGELFNEAHSFSFRVQAHLQERVEPFYLLVLHRLVSKGTKNVSLQDITKEESFAKFYNSGPAAFRSQEFAIPLQETYDVGDQAAALNILTPDRDDGKEGLADMIPAPSKFYERRQSTGAEYRGSEQDQRRRSAQNLMVSVREKVQALMHGARKENTARHNVATSGQRDKEVQSVAAQRGHTDALRDAPALERG

SEQ ID NO: 1019335 - protein, 237 aa, Homo sapiens
RWFSGAAPSRLPPAPRFSGPAAIFLSAQGPPSGAMQPTLLLSLLGAVGLAAVNSMPVDNRNHNEGMVTRCIIEVLSNALSKSSAPPITPECRQVLKTSRKDVKDKETTENENTKFEVRLLRDPADASEAHESSSRGEAGAPGEEDIQGPTKADTEKWAEGGGHSRERADEPQWSLYPSDSQVSEEVKTRHSEKSQREDEEEEEGENYQKGERGDSSERNLEQERHTLFSMSMLQLYK

SEQ ID NO: 1019336 - protein, 169 aa, Homo sapiens
RAGLMDRAARCSGASSLPLLLALALGLVILHCVVADGNSTRSPETNGLLCGDPEENCAAATTQSKRKGHFSRCPKQYKHYCIKGRCRFVVAEQTPSCVPLRKRRKRKKKEEEMETLGKDMTPINEDIEETNIAYKAMKLPPGWWQAAKCLAHLKMDRMRLRKTASRHEF

SEQ ID NO: 1019337 - protein, 143 aa, Homo sapiens
MDRAARCSGASSLPLLLALALGLVILHCVVADGNSTRSPETNGLLCGDPEENCPAATTQSKRKGHFSRCPKQYKHYCIKGRCRFVVAEQTPSCVCDEGYIGARCERVDLFYLRGDREQILVICLIAVMVVFIILVIGVCTCCQ

SEQ ID NO: 1019338 - protein, 117 aa, Homo sapiens
LKKWMPRQHKQDPGTPTGYGAVPQSQGPGFLPREVRNKNNFSLVPFSSPDNDFSTLDLPFLVPNPHPVVSCRHHCLQGMPSAAHLHPNYKLPEGDANLCLGRLIVKKGGQGTCSPKD

SEQ ID NO: 1019339 - protein, 147 aa, Homo sapiens
MPSSSFRRSKITLTLAMAAVPHADVTLLRAHMEGNAVRYQAQVAGEDQQVHCHVGLAAELAGQRPVGSGGAFGQDTHVHFRARCGLGNDAQVGFGVGGVQTHALLVEVADVLGLLDGVAVADAVSADATVHHLVQFVDRGDDEARTF

SEQ ID NO: 1019340 - protein, 201 aa, Homo sapiens
MLDVMWQIGCEMKLEKLTVSYMNECSRSMIEYESHIQCNCLALVINVQSEDEDGVLMPSSIYVWHMCDLLVAIRQEELGSSLSLACVFRFNRVTNTCVDKFSGHPKGFAYIEFSDKESVRTFLGLRMSSPILRKGKSRWSQIEPNRPGISTTDRGFPRARMRALDTIYNSYRSVIVQMVLAAGAGVAFTGAGLERIMVSPY

SEQ ID NO: 1019341 - protein, 169 aa, Homo sapiens
MVFFSEVVKNRSCDGCFLTVPTAPMTVSPYGGISQPSSVGPNPLQPSFRVLFSRPLSGLSGQPCPFHFLPPGGGAPGPQNHKSLETQRTSSWREGAGPVGPPCHIAFSGPTWGPWRGFSSQTPSPHPQEKGVFLPPVIVVFWEEILLVQGQLIFLLTLEKIVIYVSSFK

SEQ ID NO: 1019342 - protein, 105 aa, Homo sapiens
HFLHRETRGAAQGCLGRPQERHPAASVLWTSGARLLRVGLLSTPSSTPGLCPPEANSLAPAVRTEISPDVATGPLGGRSSHSLNCALEDGKAPQRPSLLMSLSCA

SEQ ID NO: 1019343 - protein, 235 aa, Homo sapiens
YCEDRVIEHYLIKGLTRGQAVVQYMKIVEALPTYGVHYYAVKDKQGLPWWLGISYKGIGQYDIQDKVKPRKLFQWKQLENLYFREKKFAVEVHDPRRISVSRRTFGQSGLFVQTWYANSSLIKSIWVMAISQHQFYLDRKQSKAKIPSARSLDEIAMDLTETGTQRASKLVTLEAKSQFIMASNGSLISSGSQDSEVSEEQKREKILELKKKEKLLQEKLLKKVEELKKICLREA

SEQ ID NO: 1019344 - protein, 108 aa, Homo sapiens
MAISQHQFYLDRKQSKAKIPSARSLDEIAMDLTETGTQRASKLVTLEAKSQFIMASNGSLISSGSQDSEVSEEQKREKILELKKKEKLLQEKLLKKVEELKKICLREA

SEQ ID NO: 1019345 - protein, 47 aa, Homo sapiens
MDEYGFRAINDFGSVTISSTYKVLVFSERGTYQVTSQYTDRGGEGSV

SEQ ID NO: 1019346 - protein, 124 aa, Homo sapiens
IHDHPFPFSKIYLFIKTNTYKETEFDRVSLLLSTKKPQHVRISYGLAVSSSSCLYSFHILSISVTPRMSSGRSVLRKDIQSQQCQADLPELLSLQIPLRSLLSSINLLNERINQLRKSGSQTHP

SEQ ID NO: 1019347 - protein, 109 aa, Homo sapiens
AALRAPEAAVAGGPPDFSSRPVLERLTGPRPAASLSLALRGLGDWAAGLRVRGGGRLRPGASWPREPRDGGPGRGGGAAAVSLGGEGAAGPARFPARKLREAWTSAHWR

SEQ ID NO: 1019348 - protein, 148 aa, Homo sapiens
AALRAPEAAVAGGPPDFSSRPVLERLTGPRPAASLSLALRGLGDWAAGLRVRGGGRLRPGASWPREPRDGGASRGMGARAAEEAPLLCPLVERALPALRGFQPGSFGKPGRLLTGDDTCVGCWVSWCIGAGTGSILQCKLSPPVQNLK

SEQ ID NO: 1019349 - protein, 142 aa, Homo sapiens
AALRAPEAAVAGGPPDFSSRPVLERLTGPRPAASLSLALRGLGDWAAGLRVRGGGRLRPGASWPREPRDGGASRGMGARAAEEAPLLCPLVERALPALRGFQPGSFGKPGRLLTGDDTCVGCWHSCYLTREGGDFACDGLPV

SEQ ID NO: 1019350 - protein, 109 aa, Homo sapiens; identical to SEQ ID NO: 1019347

SEQ ID NO: 1019351 - protein, 184 aa, Homo sapiens
GGEVATGSAPLPSDPVSSLSVFLFQTTWTRLGCCEAAEPPPLGVAATTTIGVTSPASVRSRRSRAAHVSSESAHMATQAHSLSYAGCNFLRQRLVLSTLSGRPVKIRKIRARDDNPGLRDFEASFIRLWDKITNGSRIEIKQTGTNLEQPGLLYGGSVEHDCGVLGGGYDLESLLCLAPFMKHP

SEQ ID NO: 1019352 - protein, 89 aa, Homo sapiens
NHTVMALMASLDAEKPQGQKKVEELEGEIPTFNHKLQDASAEVERLRKENQVLSVRIAAKKYYPSSQDSSSVAAPQLLIVLLGLSALLQ

SEQ ID NO: 1019353 - protein, 98 aa, Homo sapiens
APLDCRVCDVRGKDVISVLGKKVARGPKFLESGRAAIVDMGPGKPMGVESFPDKPPLGRFAVCDIKQTVAVGVIKTVDKKAAGGGKVPKFAQKAQKGK

SEQ ID NO: 1019354 - protein, 448 aa, Homo sapiens
DDYHPPPPPDTEVLTGVVTATLMLSGSQAPPVRAGPISDPNATTTKPCATAAAAVTRNNPSCLDTRASPSHPDGGLSTEMPRPRAQVLHAGLSPAGLGSPVPESVVPSGDPAGQVLQRLLHRVAQLGPPLQQGVLLAAAAQTAVAHTLCVPQLLVRNLQLLLVVVVLLDFGFEVLEPLPERLQLLVREVGGLRQAPQVNHPGLLELSLSAVALVADPAQAVQALVDVRSFLLQLRVPAVQDAALDVAQVRGANDVLVDLFGPAQGLQQDVVLVNFLFVMQELPPELVQFFAGEFPRGLRFVLQLFQPGVIQPVFLGATEGVVGHCRASFFSSRPYLAKMTLRLRSFVFFSPSSSKPSSFFFQASSSFSCIFRSAWSSASLTGGRCSCWAFYSWFNFSMRYSSPDSRFGDGLGWFFSREYLPPWLAAGQGPRKSSSSSSAGSPGRNDLT

SEQ ID NO: 1019355 - protein, 84 aa, Homo sapiens
GKALQKCPNSGILWFEAIFLQARPHRRPQSVDSLKKCEHDPPVVLAVAKLFWSQRKIPKAREWFPRPVKIDSDLGEAWAFFYKF

SEQ ID NO: 1019356 - protein, 108 aa, Homo sapiens
GPTHPARGHLVVTATMESRSGAGSCRPRSVDRTLHFWSSASGWLTSLTVQDEILWGRAVGSELRSLLVPDPKLADRPRRGAHTSSQRQAGHGRYACVQAPRTPQDGGS

SEQ ID NO: 1019357 - protein, 1405 aa, Homo sapiens
GALRSGARGAARSPMQGSARHFRSRGRPVKPTWIRQRCATPQCRAPSCLRGLAPGPSTAHLLGPARQRPFVVKAPGPSAMPAAETASGSRVCFCALPGRGPGGLVPGALESLLRPHPRAVTVTHAAQPGGKIVRGCGFSMSSSVKTPALEELVPGSEEKPKGRSPLSWGSLFGHRSEKIVFAKSDGGTDENVLTVTITETTVIESDLGVWSSRALLYLTLWFFFSFCTLFLNKYILSLLGGEPSMLGAVQMLSTTVIGCVKTLVPCCLYQHKARLSYPPNFLMTMLFVGLMRFATVVLGLVSLKNVAVSFAETVKSSAPIFTVIMSRMILGEYTGLLVNLSLIPVMGGLALCTATEISFNVLGFSAALSTNIMDCLQNVFSKKLLSGDKYRFSAPELQFYTSAAAVAMLVPARVFFTDVPVIGRSGKSFSYNQDVVLLLLTDGVLFHLQSVTAYALMGKISPVTFSVASTVKHALSIWLSVIVFGNKITSLSAVGTALVTVGVLLYNKARQHQQEALQSLAAATGRAPDDTVEPLLPQDPRQHPWEQEAASCCCPRDTASPRNGQGRPPPWPCWGAGHGELSWHCLRLSRFVGEDQQKLKLGIPGISFLEVDTRPVADCVRRAHPQCNVKTASEAPMLGVHHFLSGRHPRVHREPEVGPVPTRAAPCHSQESPRRPTPAIEGPEALDRRQTGPGHEATEQGRREGTEGPGRKGLLLPRWALRTSPHLTQGCGHPQTIPEASQASSCSIARHSRAMTTEAVQSLLFRGRPPTSSTPCPPIPSTPWADELPATPGHPALLPVGVSSPEVEDKPLVFNLGGDVYVPFLFWTLSMRQAVLRSPWGEPVCPPSEPTVPIIIYHLSGSPREPWAGRCSVDGLGYVAFTWAPSLLKKETSTLNVSGARGVCQAPTLSHSPQGTVVRHTGATSQLNSSSCVTHPRGRRRPEEWLLEPCVRQRLLTMSELFTPNLATGGFPCPVQPVASQPLRPRAPGLVRGSMGLQWSRVSFPCLLFRPLAPMVTSLVFHLASHLGNTKIAPPEDKIVQKQSNNSDSLTSTYSKKSAMMMDRVRLFNPQVTFLFFGDGLALSPRLECSGMILARCSLDFLGSSDPPQPPMWLEPQARATMPGYFFVELGSRFVAQAGLELLGSSNPSHSASCSVENIGVGYYTCFSRFYKTADLCVEDRPGVCSLRCEDVLSRDFPWVSISFFLLSSKTNRRPAAVAQASSPSTLGGCRWRITRPGVRDQPGQHDETLSLPKIQKLAGCDGGCLWSQLLRRLRQENCLSPRGGGCSEPRSCHCTPAWATGQDSVSKTNTIRKCSGGGGELLICEDRLKATPRVALSTSPSRIWLPASLKIVVWHKERCRRLVLSTLEFPAAQHLVPSPPPSQGAAILFGFSVCGPETNVFPKD

SEQ ID NO: 1019358 - protein, 254 aa, Homo sapiens
THSQTTPHTTVTSGKKDPGASQPGAPRRRPPLQESEGAGPGVSGAAWEHLPLKGVGSSTKRDSLAAAPASPPGAVPPLTGKAVGQGPLCQTPPAPLQVLLLPAPGLQGSRLQGSAVGEGQGPGLQQGALVNGIEVEGRLPLTLASRKEGDPSDSGGHCAAHAANGRHGNLLKRKLLSSSMAWGDHVGLQPGAFQVVVVTQSLVSRQPLLGHKLAALQVGPIKEDLRLHDGHNAILLAETGITGQNIGIFHEGEG

SEQ ID NO: 1019359 - protein, 118 aa, Homo sapiens
LLPAGKKRVNFPFPLVVVLKSAERMGYTGLNITYPCKQAILPLLDELSDEARGIGAVNTVVFREGKRIGHNTDCLGFAEGFRRGLAQAARHRVIQMGAGGAGAAVAHALLSEGHQGEN

SEQ ID NO: 1019360 - protein, 326 aa, Homo sapiens
QGPVTEEKTRTRHRTEESPGLGWWGPHPRALVAGRHGAQAWEPRAGVSGPHLAGRVKKRVEKSNRSRLILRRLRTSSSSSVTRTRGLAAEHALLHGAAQDGLQLLRAAQEAGLRALLVEAQAQSEAPVARLVPVLGAQQVLFEVGQRQAGPEVLSQHADGRHRMAAFVTGPLMATVRMHCLLCTFQRRTVSSWELESSTLPLVDTDRQVTWFLFPLKTFPASCSGWKLLFLCPGQVKRSTWKMELSLPPQNIWCSARSMVTAMMDKSKRTESSSSPEETSHSFTVWSSEEVATRAREAPKPQRVGSVFVRPEVPWRRNSGGVGLQH

SEQ ID NO: 1019361 - protein, 115 aa, Homo sapiens
MLFHGVVFNLLILMIRPSWPPKCAGITGMSTRAQPKFYFLTNHTDLVLKLMTCSYVQNCDKTEEKLITSLFILTFFFVNQKLLMLETYYEVPLSASDLRKILKLGCTGNDDASIS

SEQ ID NO: 1019362 - protein, 115 aa, Homo sapiens; identical to SEQ ID NO: 1019361

SEQ ID NO: 1019363 - protein, 67 aa, Homo sapiens
SSQPEGSWLPYSELEQQPPVWCFWQDCLMLEEQLTWVLVCRRVISSSEYLLSAEYVSTLLGLGTQKR

SEQ ID NO: 1019364 - protein, 125 aa, Homo sapiens
SDHFKHPAYFRKSPKPEGSGEPELRPLHHFGLGLDSTRQLKLWASPFGKLNQALSFLVPSSPAAPAVSAQPPPLGCRLGSQTTQTPFPLAPPPKGLDFLFGLFVFKQNGVKIKPLQGLAPCWFEL

SEQ ID NO: 1019365 - protein, 105 aa, Homo sapiens
WPFTPPHTTGRHTREKRPPPSHSAFHSVPFALLFPPLKKGAPTPGALISSGGYVPLVFVATQRLCGGPSLGLLSHTISGRCVAMSVICPGDKKFSRGKTPWRNDA

SEQ ID NO: 1019366 - protein, 122 aa, Homo sapiens
MTSNGNFVPLLWTLYDDPFCASCALHTSRGRHPHIYEMPPQELHRHSLHANKQLLLVLGLSWVALELGGTLFLAIRGPEHDIEYPFKKGEMLNREDLIFITLDHHLVTEHPLFTPGPYPFDG

SEQ ID NO: 1019367 - protein, 120 aa, Homo sapiens
SVEIPELEFELGAVLGGKFTTLEGLLKDIRLVNNPFTLGDPALTPEFRQALLGHMQAFLMDDPAGNSYLQNVYAPADPEMVRHTRFQNEELGLNMTEGFEALLRGSSGWLKGQPPALLFL

SEQ ID NO: 1019368 - protein, 131 aa, Homo sapiens
MMDSWSLEVMSQVQVLLYFFQLEAIPAPDSKSQSILFSTEVKGPSPSPGGRQMAWKPLANRAIRRAGTFLRCPWATPKCWAICQETATQSRRTGGLGRFRPGLGAPGWPQTVVFYVATRGGPKPVHFRVQA

SEQ ID NO: 1019369 - protein, 120 aa, Homo sapiens
PEAHPPSPRSPAAMTLSITMAEPGARNDGTQEKGFWAQEKHLHSGALSFACTESVVILVASKCQPFLKPTSDHPEFPLGPCLLRVMKAGCYAHSITMKPGIGPRGTNSRCPCLPVQETAS

SEQ ID NO: 1019370 - protein, 72 aa, Homo sapiens
GAVGGGGVEVDHGTVVAALADDQHQHVGTVQTAQAVGAGDAVIGRTGRALGERWQGFLQRTAQAGFASLFLL

SEQ ID NO: 1019371 - protein, 160 aa, Homo sapiens
VPRIVSALFYTSPLTVAECAGTDDRSQQPDSVLTVAEYVRADDRPPQPDSVLTVAVCGGADDMPPQFDSVLTAAECVWAQVTGHHNLNQDSVGLPASAIRKTILGLLRGAKNNLHVRETLIVCGQRTNCGLLKTAAGSYYASHQEVESNHLPPLNHGWSQ

SEQ ID NO: 1019372 - protein, 117 aa, Homo sapiens
MADKFQVDQLAKGKANVKHEEQEAQGSTRRCWLVFRKSSSKGAPSGLEKYPDEKSVCLRGCPKVTEISVLKETKRQAAIIFTDDSATFTCDSELEAEEWYKTLSVELSGVRLNDISV

SEQ ID NO: 1019373 - protein, 117 aa, Homo sapiens; identical to SEQ ID NO: 1019372

SEQ ID NO: 1019374 - protein, 132 aa, Homo sapiens
SSAAPQRHLPCNRYLTHTQRPRSAPYAQVTPMEETPPMPWIEVQSLKAVDLQCRATLMYVFASLNQPIFEHADLENATEVLSGSLRDISQDSLQDIKQKVQDKSRYCESRRRVLFQHVHEGYEKDLWEYIED

SEQ ID NO: 1019375 - protein, 164 aa, Homo sapiens
SWISARGCHCHGAEEHSSLARWTCCALLAGSEYLKLGYVCRYHVKDSSRHVILGTQQFTPNEFASQINLSVENAWGILRCVIDICISWRRANPPPSFPNYPPKGPQQAGHPCLPAFPDGHLQLLYVRMKEEEEEEESRKKKEEENFNPVMWSWSLSFPRDYEGL

SEQ ID NO: 1019376 - protein, 76 aa, Homo sapiens
VGPSATYIALKHVAPYGLACAGLSSLMGPQQRLLHPTHENSRLHSHQGIREVASHRVAAFKSEPLSYWPWEEQRSL

SEQ ID NO: 1019377 - protein, 135 aa, Homo sapiens
PSAENDTVYRKPPRPSHTPIKNYKKISPPSLRCLGSLSPPVALQLWGGQLTTAPSPSPWGGGGCWWLRRLKPFVPVLPVPKLALPSFPPGSGAKGEGAEMSPAMGGNSGGGNFAQGGLKSSHLPPPSPLKEKKAV

SEQ ID NO: 1019378 - protein, 191 aa, Homo sapiens
MLSSIVHRDLKPSNIHFTDGYEIKEDIGVGSYSVCKRCVHKATDTEYAVKIIDKSKRDPSEEIEILLRYGQHPNIITLKDVYDDGKFVYLVMELMRGGELLDRILRQRYFSEREASDALCTITKTMDYLHSQGVVHRDLFRGFSFVASSLIQEPSQQDLHKVPVHPILLCNSCLRWVATVQIFITLSRLSE

SEQ ID NO: 1019379 - protein, 245 aa, Homo sapiens
VGLIPAVQFPGVITPQIAVRMGIVKLPCNTQDVFGSFAQQQVGQAEAQVLGSQLGPSWNVTSSDAYQLWVILRAIFMLGRDMDGACMVSCMLTEPSRLQIPPVRYSSPSFKAVCTATGTLQLPSRCLRKALSAMQREVSGSCSTPTRTKMFWSLARTSTPKAPWPTAMHFSGCRICPTRLCQMRCRAAVARMMALNFCCSFSFRSRVLRFPRILLNSRSGNFLCSWAALRRELVPTTLFSGRVSR

SEQ ID NO: 1019380 - protein, 213 aa, Homo sapiens
MGIVKLPCNTQDVFGSFAQQQVGQADAQVLGSQLGPSWNVTSSDAYQLWVILRAIFMLGRDMDGSLHGLLYATEPSRLQIPPVRYSSPSFKAVCTATGTLQLPSRCLRKALSAMQREVSGSCSTPTRTKMFWSLARTSTPKAPCPTRLCQMRCRAAVARMMALNFCCSFSFRSRVLRFPRILLNSRSGNFLCSWAALRRELVPTTLFSGRVSR

SEQ ID NO: 1019381 - protein, 120 aa, Homo sapiens
MCVHLQAQAFVPQKGFDEKAAYFGHNLHDHACAAVHNLSDDGQPFFERSVHYGALSLASVEHVREVVAKDGMQTLLAFSHLAAELESVDEPSAEQRQRITVGLYFYTEATDPDSSKTPGP

SEQ ID NO: 1019382 - protein, 161 aa, Homo sapiens
AALEPAATRGRASGVREPSGECAAASAPAPALAAVSARTPTPSLTLPFSGAAAPRPATAAPPGIQRAPGGRGRGVLTLWCRPTTPTPGSGPAEEGDAPRVGQTGHLGCEGGLGAEAAVQGRLAQQPVPAAVPAVPPWRLRSRPTTGAINSPERKAAPWWPG

SEQ ID NO: 1019383 - protein, 30 aa, Homo sapiens
MARGRWRRAWLGGRLSIAKEAAQDAVRSGR

SEQ ID NO: 1019384 - protein, 153 aa, Homo sapiens
DGEWAIKGWLDVASRGVTQIFITFGKWYDAGKQKYFASSSTLFVIEFILFHYVEIRRWQDIKNPGSVNQDPIFKQYSLPPNEVGYPGGIFNPLNFAPTAEAKEKELANGRLAMLAFLGFIVQHNVTGKGPFDNLLQHLSDPWHNTIIQTFGGN

SEQ ID NO: 1019385 - protein, 172 aa, Homo sapiens
MKENCTHQKCCGKVTMDGESTGPQPLQSHWDHFYKRNKNLPPEEQMISALPIKVLTLTDDHEFMVIACDGIWNVMSSQEVVDFIQSKIQRDENGELRLLSSIVEELLDQCLAPDTSGDGTGCDNMTCIIICFKPRNTAELQPESGKRKLEEVLSTEGAEENGTSDKKKKAKR

SEQ ID NO: 1019386 - protein, 172 aa, Homo sapiens; identical to SEQ ID NO: 1019385

SEQ ID NO: 1019387 - protein, 90 aa, Homo sapiens
TFDVEALIKLRSQTRAISDALKAQAADYLATVAPLIRPQTLFGEYLQGAQRSSGRETQGHFQSLIELFDRIGSAAPFQLVNELEVPLNLI

SEQ ID NO: 1019388 - protein, 65 aa, Homo sapiens
MRCNVQNLHIANTPLEATQRLSAQTHSCSQSLQTNPLADRPAIAKAVAHQRIQTQKSSQPPRSAA

SEQ ID NO: 1019389 - protein, 171 aa, Homo sapiens
LHNGGMKPRVMKEAVSTPSRYGPQGIRNGMMLKLPENCKKKNFWLPQVDMRAAQVAQDEEIARLLMAEEKKAYYTSQGAGEIIFGQKKASPRVEAKEQLKQQIQSQKRVMNLTILRMKGQHGHHQPMHEQTGEDAGLHSLLQNLQRFHTAFLKYQSPRHKWFITYKTIEKR

SEQ ID NO: 1019390 - protein, 75 aa, Homo sapiens
TLGVEGPWQLPAASGDQKGSPVPPKPQQAEVWAEFIFLTFGHSFSNCPQGVPPAEERPGGPTLPVTLHLGLAVKP

SEQ ID NO: 1019391 - protein, 254 aa, Homo sapiens
ELLMSSRPHGCGVSPKVIRVSLLNAPGPNLKLVRPKALLCFLIVVCSCCKQSLNWQDCVPSPSCSPEPSLQYAATQLYPPPPWSPSSPPHSTGSVRPVRAQGEGLLPWAPWMVTADRGSQTSSRSSTGETSRGGGGSPPWERTPGKGVFPLRGILCPSRAQLPAFHSCHGLTWKGGDLVTFRWMGTQLLASPGAALTVPPPKRGYLASYGPQQLRAQLWDAGEKASPAWPFYDPPAWQTGELGAEGGAKCPILP

SEQ ID NO: 1019392 - protein, 292 aa, Homo sapiens
GGGGGGVLVGPERWVAGHRVGGCPVGGGVVYTQRTKGVTAVTCSLKPSALHLPPQLGGQSVWPLSRWWGHPGTRWGRTQERCVSGCRCRLPVSLPASPLCWTPSLSSFAGKSGEPAANQAPCRQARRQSPHQPFQSQASYERAALQSPMFKRRRRRSRAGGGPARASARLEVTIALPQGLCRLLPGSLQEGQLLGFLLLVSRLILQPVGDDPLDDEVCEVAATVNLTEDAPSLGLLVWVGAIPVRDNFCAVTHQVHLEVTELCCRVRGSNHHFCNVPAGQPAQSSMQIHEGV

SEQ ID NO: 1019393 - protein, 260 aa, Homo sapiens
GTRISSDFFEEESPFLHSQAMSECIKKNRVPFYEICLRRPLAWTGALDGWGFNVTGCPLEELPGCALVVGCSSWRERKVSPRYLVVHLNHLLSLPKTRHLGRDFWVVRQNRAFKGDNSLESLKSLMDAPGGILHEFEQPRVSHHLQIMEDTGAGRAPGAMASPSGSSEATGKPRGRDGRPRREEDDVPPEEKRLRLLLEGGSAQPQDCEDGEDAPRPGREETGTQTGGDGRGVQWFTPVIPALWEAEAGGSPEVRSSRPA

SEQ ID NO: 1019394 - protein, 138 aa, Homo sapiens
SAPRGPTEPALRLPSSAERTLALGPSSSPGAGRAPGAMASPSGSSEATGKPRGRDGRPRREEDDVPPEEKRLRLLLEGGSAQPQDSPGSRQNAPRPPTKSRPPPLTKERRAQKSPFFNIFRASAFLHHLPQYTANELE

SEQ ID NO: 1019395 - protein, 233 aa, Homo sapiens
GTRISSDFFEEESPFLHSQAMSECIKKNRVPFYEICLRRPLAWTGALDGWGFNVTGCPLEELPGCALVVGCSSWRERKVSPRYLVVHLNHLLSLPKTRHLGRDFWVVRQNRAFKGDNSLESLKSLMDAPGGILHEFEQPRVSHHLQIMEDTGAGRAPGAMASPSGSSEATGKPRGRDGRPRREEDDVPPEEKRLRLLLEGGSAQPQDCEDGEDAPRPGREETGTQTGGDGRGR

SEQ ID NO: 1019396 - protein, 220 aa, Homo sapiens
SAPRGPTEPALRLPSSAERTLALGPSSSPGAGRAPGAMASPSGSSEATGKPRGRDGRPRREEDDVPPEEKRLRLLLEGGSAQPQDCEDGEDAPRPGREETGTQTGGDGRGPLPQSPLLESGIGNHICFSPRDCWKTKIRWPRKEHYMYSQLSLRVRSFASGCLKLLPLKHLARRNHPVWLAQLLHARALLEFSSQKYLGAWSQQNEMTFQQVCHHVRENR

SEQ ID NO: 1019397 - protein, 121 aa, Homo sapiens
ILSFNGMLARLEDAFVRLSNFSADIAHELRTPVSNLLTHTEVVLTKKRDLDAYEDNLYSNLEDLKRMSRMIDDMLFLAKADNGLIIPEQVDIDLVGLVSRLIEYYQLAAEDRSIRLALQGE

SEQ ID NO: 1019398 - protein, 105 aa, Homo sapiens
PTPKTYFPVFDLSPGFAQVKGPGKKVADAFHNAVGEVEDMPNALSALSDLQGPKFWVDPVNIKFLNPCLLVTLAAPLPAEFTPGGDASLDKFLGFVGPGLPPKNR

SEQ ID NO: 1019399 - protein, 149 aa, Homo sapiens
KKHPELPLTHTHICYPHHFIDLFSICTLHTVLRTRQGVCLPLVTCWISFALYCSGFELPNRSYSLVSPACPPPQRVAMISVSWTSYLSFMRSRSIWCCLVISVKYFPSYRYLCLTLIARDHSCSKVVFVWLVTSDAYANKACSQKENTQ

SEQ ID NO: 1019400 - protein, 93 aa, Homo sapiens
KACKKITANVRFLSPSKDVLFHRPPIEINLKIKIHPLQFLSGPLALFLLRCLTFPCVDISFQTKEIKARLEFWCTDVKSMEMLVEHQANNILT

SEQ ID NO: 1019401 - protein, 115 aa, Homo sapiens
MAFEYSRNRIIILQMSKKQKAPDHITSTLSQGQLRTEIFSVQARWLMPVIPALCDAKAGGSLEPRSARPAWAAERDPDSTKLAGHGGAHLLSQLLRKLRWRSAIAQEDEAAASCG

SEQ ID NO: 1019402 - protein, 69 aa, Homo sapiens
PTPPNYGKYCVRPKKPAQEALINYSRRGKGVLKHLHGRCNSESKVCSSEDSEADRYSDYGWGGPSSPFN

SEQ ID NO: 1019403 - protein, 56 aa, Homo sapiens
LMIIELSSYLDSGGAHGMPVCGFINYSRKLDKVLTLQDMLVPGQEDTFWKTVEESS

SEQ ID NO: 1019404 - protein, 307 aa, Homo sapiens
RESYEDTSASGKPENFLTYLVSERSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKK

SEQ ID NO: 1019405 - protein, 386 aa, Homo sapiens
MGVPKFYRWISERYPCLSEVVKEHQIPEFDNLYLDMNGIIHQCSHPNDDDVHFRISDDKIFTDIFHYLEVLFRIIKPRKVFFMAVDGVAPRAKMNQQRGRRFRSAKEAEDKIKKAIEKGETLPTEARFDSNCITPGTEFMARLHEHLKYFVNMKISTDKSWQGVTIYFSGHETPGEGEHKIMEFIRSEKAKPDHDPNTRHCLYGLDADLIMLGLTSHEAHFSLLREEVRFGGKKTQRVCAPEETTFHLLHLSLMREYIDYEFSVLKEKITFKYDIERIIDDWILMGFLVGNDFIPHLPHLHINHDALPLLYGTYVTILPELGGYINESGHLNLPRFEKYLVKLSDFDREHFSEVFVDLKWFESKVGNKYLNEAAGVAAEEARNYKK

SEQ ID NO: 1019406 - protein, 170 aa, Homo sapiens
MSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKS

SEQ ID NO: 1019407 - protein, 139 aa, Homo sapiens
MVLQLERKGPAAQEFVQPLRVPSNKAQVKPGQTFSVAGWGQTAPLGKHSHTLQKVKMTVQEDRKCEFDLRHYYDRTIELWVGDPKIKKTSFKGDFGGPLVCNKVAQGIVSYGRNNGMPPRACPKVSSFVPWIKKTMKRY

SEQ ID NO: 1019408 - protein, 69 aa, Homo sapiens
QYGDQDFQMEGKRAHRDYSALRASVAQAGLPAAYLRLGSTSAVKRLSASEPISSGNWKALRAVRFTSIG

SEQ ID NO: 1019409 - protein, 144 aa, Homo sapiens
AGRAGHRPESHRTVHRELSRSGELAVRALEQFATVGEAKLDKTKKGIVNEQFLLQRVADGAIDLYAMVVVLSRASRSLSEGHPRAQHEKMLCDPWCIEAAARIPKGMAALQFDPWQQEVYRNFKSISKALVERGGVVTNNPLGF

SEQ ID NO: 1019410 - protein, 64 aa, Homo sapiens
VVVGDEALVQADGGAVQRRHEPLHLDRGLGAGHELDLGVDVPQGVGFILGHREAEEEDLIIRDR

SEQ ID NO: 1019411 - protein, 421 aa, Homo sapiens
PEIKITPLGAGHDVGRNCILVSISGKNVMLNFGHIDFNNDRLETAWIKKYRPNLLITKSTYATTIRSKHCREQNFLKKVHETVERGGKVLIPLFALGRAQELCILLETFQKHMNLKVPIYFSTGLTEKANHYYKLFIPWTNQKIRKFVQRNMFKFKHIKAFNRAFADNPGPMVVFATPGMLHAGQSLQIFRKAGNKKNMVIMPGYCVQGTSATRSSAGSGTREGRQVLEVKMQVEYMSFSAHADAKGIMQLVGQAEPESVLLVHGEAKKMEFLKQKIEQELRVNCYMPANGETVTLPTSPSIPVGISLGLLKREMAQGLLPVKAKEALRASLGTGLPLGNPLQTGTSETFPLGLGCPLEQALKELGLAEHQLRFTCRVHLHDTRKEQETALRVYSHLKSVLKDHCVQHLPDGSVTVESVLL

SEQ ID NO: 1019412 - protein, 72 aa, Homo sapiens
YYKFQLWDIGWYSGLTGNFNCGCYQSYAASTVSMDWPIDFLWTLLWPPSPPQNSDMSMAWTVYEMMAKGLKS

SEQ ID NO: 1019413 - protein, 122 aa, Homo sapiens
FFITIIYYFYYSFKKLLSLHAAVLGTMKCLLPRGWEPLRPSSAVLSGSYRPDPDRNLGAVTLVSGGLLRAPNSSGPKDHERAGAGSPTDDGGRRAGHTGGAGVSAFGDAFSLKTQPLLGLAA

SEQ ID NO: 1019414 - protein, 317 aa, Homo sapiens
FFITIIYYFYYSFKKLLSLHAAVLGTMKCLLPRGWEPLRPSSAVLSGSYRPDPDRNLGAVTLVSGGLLRAPNSSGPKDLRGPEPGPQPTMEGDVLDTLEALGYKGPLLEEQALTRRPEGGLSSPEFSELCIWLGSQIKSLCNLEESITSAGRDDLESFQLEISGFLKEMACPYSVLISGDIKYRLKKKEDCLKLLLFLSTEIQASQILQNKKHKNSQLDKNSEVYQEVQAMLDTLGIPKSTTPDIPHMLNQVESKVKDILSKVQKNHVGKPLLKMDLNSEQAEQLERINDALSCEYECRRRMLMKPIRCDCTVLGMV

SEQ ID NO: 1019415 - protein, 168 aa, Homo sapiens
CQPPSATLRFSFDRQKHGTSTDRQEEMVTNWLVRNPDYTRSNLKYKDVAKSGYKGEHIKDGGGFAKLLQAVEAGDIQAGDVVLCEAMDRAGRLESLDMLTKVIAPILYAGVSIITLDDNTAYTKASVNTPQIHLLLAKIQAAHGYSQALSDRIKSKYATRIKNAKETG

SEQ ID NO: 1019416 - protein, 112 aa, Homo sapiens
LKLGGPRLIKGDGEVLKEIVTKERPKKINKQAPRGGCLAFQIRSGLLPLGPPLAKAFGRPWRPSLGRFQGANGKPYGGWWPFPPGLVFGPAQFFFRGRGWRLGSPACLAPPF

SEQ ID NO: 1019417 - protein, 107 aa, Homo sapiens
MQRFRGTREEAAPRGHSPAPRPDRVTAKAPPGCALQRGHAAHQLGQPRSVGRWRAANTPPPHPHAKHNKTPPPHPTQPTEKRRKHHDEKTGSKRNKDSEGTKEDPET

SEQ ID NO: 1019418 - protein, 208 aa, Homo sapiens
MQRFRGTREEAAPRGHSPAPRPDRVTAKAPPGCALQRGHAAHQLGQPRSVGRWRAAGKRWGPGQPRGPESPAGPPRWCVGGGAGRGRALKTPRARCGVVQQLAARGELAVLEHLLGLQVVVLVLVGEGDDLLGLVQRVVLVHGVHVALQLLGGHDAVVVGVNELLKLLFSVFHPVVVNVLALLVLHGAHGQGDELGHRELLVTILVQV

SEQ ID NO: 1019419 - protein, 522 aa, Homo sapiens
MAGDCRPGNLRASPHFLSRAVTSGSPPALLSGKLQMPFRAQAMPRMEGLSHWFGSAPQSPGLGCHPPEDEGWASCRAPVAGASWDLGNPISEPRPMAPPLPRREKAAASRSTQALGPRAQKTERTDCRVATTGWTMDPQEMVVKNPYAHISIPRAHLRPDLGQQLEVASTCSSSSEMQPLPVGPCAPEPTHLLQPTEVPGPKGAKGNQGAAPIQNQQAWQQPGNPYSSSQRQAGLTYAGPPPAGRGDDIAHQLLLLPLLPLLPLPPLLPLPQLLLLCHLLAQPTLPGPGPRLQQMWLTQCRDMPGHAGWLLSWASAPSHQALGLRPTRKVAVQPELLKRNPRSWLERDTPDYLKAQAIKQGDLPPSNSSLLQAPLGGGCSWTQGICPFMWTREHTHTVTVDTARTGMPLPHDVHTFPWPASPGSAQRLHEGLQRVHSPSSARSGFELTCLPGAETETVSWGQSMGRTAGGYSAWNWGDPRKGLQEKERVDKRVVGAAGAAGFREWKVGTGEPRQPGPRTAHW

SEQ ID NO: 1019420 - protein, 121 aa, Homo sapiens
SVKCLVRSVRFSLFPHVQPIVFKEKLTMKTDSLMEEKLECSLWCCLSDPSIPGRCCVLERRIVPWMQQESYSSSSPIWSVDSDEPNLTSVLERLEDTKENSSVRKETKLFSLFLMNIIFRN

SEQ ID NO: 1019421 - protein, 125 aa, Homo sapiens
IIRVSSSYISISMDRSAAAASGPRSRAPHSSATVAAAPPRPPPLLGPGARRPAPWAQAPAAAAAAALRPPPPEQGSPRRGMQREPDAGSARGSSSEQAAEALKAARQPSEDRAQQIASDSRSPGL

SEQ ID NO: 1019422 - protein, 112 aa, Homo sapiens
MGRTQESCTVCIENSTQGCLWNIQPFAQKTNPNQNIELSCAQAIDDLNTILRFYVRMHVARSNPVVRKKSSSSSALTFRSVVTSTRFFFFTHFDISASRASMYPAAFRSFSP

SEQ ID NO: 1019423 - protein, 186 aa, Homo sapiens
ACALLASVTLFPNPLTDPLCIPSRWLIRLIAPLPRWHTASWRYSRKGTINGGKLQDVLAHVLLVLSLDLDPLFYCSEVHLYATCQASVAPSALRHYRCGRSVQPASVGPGALPRCHQDPHEFSTSLIYTHTTGEAPGCGARTRNPKGHSIPSSDDREDQTPEMSTSRHTCLAMSHVPLSPLGIIWP

SEQ ID NO: 1019424 - protein, 95 aa, Homo sapiens
MFVFSRTFPLLSFHFLCITEASTFAGEKVSGSSRREITLRRILTFFVGVLPLLGQPPALGGRHRRVEDGENTSPSRRCEGAKLGQDRKLGRVWVV

SEQ ID NO: 1019425 - protein, 111 aa, Homo sapiens
PRPRGETSGTYPFAQQRIGTKTAASRKINALQTGVNMEKRQSTARKRFSNSTRGEGSRPEGSKLVRQDAKPAGCDPLEAWEERCAHPASRRPYTEPDVAPKAQRLGTAAQR

SEQ ID NO: 1019426 - protein, 113 aa, Homo sapiens
MRLPSEEAVNDTDHQQPCRSRLFSSRPAQNQPLLAPSLRTPVSDLCTHAVICSSTSHHSPSSPFRTHWQCPPIPSTSLQKLPSHLNVRELASSLRDLLSLLQVIASFHAFCSV

SEQ ID NO: 1019427 - protein, 198 aa, Homo sapiens
TQAPVVPYWRLPGLGIIYLLKQSANVSSAIMTVIDRVSAQPQNAEQPPETKEWQATPAGVDKTPTAQKNGLARRRLVKVINNRAKLPLCSIIETRPFILRLEYYLLHMPTDPQDPAPRTLFKSRRPQDPPAPETNLDRSGLAIVSQHDLDQLQADATNAFGESQKKLLDIEGLYSKVRSRYSFIQALRRTRGLLRIRN

SEQ ID NO: 1019428 - protein, 37 aa, Homo sapiens
ASIPAVHINQATNGGGSAFSDYSSSVPSTPSSSQREL

SEQ ID NO: 1019429 - protein, 108 aa, Homo sapiens
MGWRAGPKGPKGRPPSRAVSPGGKEGALCAPQEEKGLSSGVKPPFPCIPPQMQAPQGPLSVPFPTPWAGPAAHPPKAPPPPWECAQELRAAGAFVPKGAEFPIKGLAL

SEQ ID NO: 1019430 - protein, 128 aa, Homo sapiens
MWLRAHTGQSVLQGGEFEIFPQKPPLSSACALGGLSISGAFPARHPRGERGPWACPATIALEVRMRLPDTRGRPPEPEPDRAGVAGASRRRRSPRRRDGSSRWVTVSPPASPLPGFGVAGAPPHRGGR

SEQ ID NO: 1019431 - protein, 36 aa, Homo sapiens
MGARDSQEISFVHNPTHRSDRIVCSRCSGAQAQALP

SEQ ID NO: 1019432 - protein, 162 aa, Homo sapiens
MWTCQLTLGGNRGYAILAGGGLQVLSWAWLPLPFTCQKYSLYLLVFLGGVGPGLGWAANGGTARRCLLGAWPAFRLVGELFLFLAAKGAVSSWLRSLSRVQLNKLPNQTHPPLDCPCVSPWWVCQSTHQSHPESWSGARSCFLQIQGLQGVFLANHILLPLG

SEQ ID NO: 1019433 - protein, 54 aa, Homo sapiens
ARVGGTRRTRPEPAGAAVPSDKKDLRQPWIPLRGRGLRGSDWYWTPPRSPAGSQ

SEQ ID NO: 1019434 - protein, 73 aa, Homo sapiens
TPGPCGAATVSTEIPKNRRLLLGAANIPGSLCNPLRPQGPGRLWVRTVCVRTGAETGLRPASLSPPQRPGTSL

SEQ ID NO: 1019435 - protein, 166 aa, Homo sapiens
LSCLSPCFQAGSGLVFPRKDMAGELQCDPGAVASAETGLTSQDQLGYTRTILREVGSAMAVRQITGSPRVNVVLVMAYGSPGVMYCIFIFVKRQIMRYMQNENLEGDLTVPVGHQLTPKGLDKRGRLDNPKYPGFRKTMNSTLQKKKQEYNWKPREIKVATTICIG

SEQ ID NO: 1019436 - protein, 169 aa, Homo sapiens
VDSRGSPWRLMTANGVVRSQIINDLALGRNMDELLRLVDALQFHEEHGEVCPANWKKGDKGMNASPEGVAAYLSENAGKLYIATRIKKPAFVAGFFMPGLQGFQCLSWLFAAPTGVCIPLEERLVSRKGRKASPWISDQSLKSRQPPISFQRLTMPQNSSAVFSVSSAP

SEQ ID NO: 1019437 - protein, 115 aa, Homo sapiens
MPDFGLQQLDTSRALAHRPGCKESLRLPSLSALPRSLARRQRGRASGGLAPRPSSGTHVAPPSAARRVPGLPWQSLLSGRAPGTPFSTDGGRPRGRNSPGTPARPGQEAMGGWRP

SEQ ID NO: 1019438 - protein, 88 aa, Homo sapiens
PALPGKVGRGPKTFEGFEAGAPPQVSVFFAPPCPGFRASVHKEPPPHGQVEGFFSPCQQLSSLGQVAWPAPWIGDGPGWARSGAQFGR

SEQ ID NO: 1019439 - protein, 175 aa, Homo sapiens
CRFVNECANGFNCLFTHNHNLIDHLIGEVQIGEALQKLQLDYFQIGLRFQYLGFGNFACRCGSTAGVKRPQNIDLGTYAAPLDINFSSSIDNRNQEGNFFFIGNSGNGQAELPQEQVAQGLEIELPCLNVRLLNQGLAHCAKPLLSINETKCGLYCGRTHRYRFGCVHLRAQGGR

SEQ ID NO: 1019440 - protein, 114 aa, Homo sapiens
SQKPGVGAGHGGDPKLSPPKVQGRSEAGAGPGPKASNFRGLGKGGRLPSAPPSSKDPTVFLDSSSSSSDLDPDVKSPPAGSKQHESIPGKAKKPKVKKKEKGKKEKGKKKEAPP

SEQ ID NO: 1019441 - protein, 94 aa, Homo sapiens
PKSPVWGRATGEIPSSVPPKFRAGRRQGQVRVQSKDPTVFLDSSSSSSDLDPDVKSPPAGSKQHESIPGKAKKPKVKKKEKGKKEKGKKKEAPP

SEQ ID NO: 1019442 - protein, 307 aa, Homo sapiens
GRGLPAEEFKAKVEAVVEKLGVPFQLVATHAGLYRKPVTGLWDLLQQANGTPLSGNSFVDAAERPAWAPGRKKKDFSCAVRLFALNLGLPFATPEEFYLKWPAAGFELPAFDPSTFSRSPLCLPESRALLSASPEVVVAVGFSSGSVEVPPVLKKAPSVSDADYVHCEQGTRLGSWQRVCDHVVKTALKQGKQGSTSQQHKHQTPDEPRLGTYAVRREPRAVPHASCFPSFTATLEQARHNNRFREITDSSHIPVSDMVMYGYRKQFEAPTLAEGFSAILEIRSRLWVEPRLGRLNCQFSEAEPRPA

SEQ ID NO: 1019443 - protein, 70 aa, Homo sapiens
MAAGEQACMAAVSLLRLRLQRRPLQPPCVLGSRGGPFSMIHPREARHGCPWGPREALEGRGGAGRSQKTQ

SEQ ID NO: 1019444 - protein, 130 aa, Homo sapiens
PGLGAARPTRPARDGNYPGSGGGAASVGAGGAGRVEHRPDEGPGQGPPRVPSVPQVPSVPRVLPRIPVMPQPRQGLGHGRTDRGAALGEVGRGEKTVAKRRSPGKERPGKLDAVGALEGPQEWTWGNRPP

SEQ ID NO: 1019445 - protein, 118 aa, Homo sapiens
MWSCYSLLFILWPFVYAVSLSVFNRLYFLVSTYSLHMLCALSFLVLGDIFSSACVMHGRGFFSYFGPVLTFPDGVCPVRGLPSWQGLPRDFLSVLGIVLYPGTHLSLKAHVIRMLFLP

SEQ ID NO: 1019446 - protein, 118 aa, Homo sapiens; identical to SEQ ID NO: 1019445

SEQ ID NO: 1019447 - protein, 292 aa, Homo sapiens
METGAAELYDQALLGILQHVGNVQDFLRVLFGFLYRKTDFYRLLRHPSDRMGFPPGAAQALVLQVFKTFDHMARHDDEKRRQELEKKIKKKEEEEANTVSAAAADKEPVPVPLQEIKIHSTTQLDGHQELKKEAASSPYEGNGPWFTGGKSSKSSYMVLLKIPREPPILPKIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYVVDAILEGEEPIDIDINKER

SEQ ID NO: 1019448 - protein, 74 aa, Homo sapiens
TRLLLYCRLSMYRISTKKELLLLERKEEDSHTTLHETPTTGNHYRAITSLERQQVPSEAGLFSKKMIATSAAIA

SEQ ID NO: 1019449 - protein, 255 aa, Homo sapiens
APGAGRSGAQPTWFGREAPGRGQLPACPGEPGANQPLCAPRPACPHYPALPRRPDLTPWPDALLRRLLSLPGAGPGTELSPVRGSVCDPDNEAELGKQTVIFPSSLTEEAQQCLVKLFNEIFDLLKEKKQERLRGARMGKIKKEMLQRGTLLILTLLIVNETHCARCLQLYQLLVELAKGSAWNCGLFTMQKAVAASTLEEQGMDIVNPCHSVPELVQNRLTGTWYYAACEQPCFNEVRKLPRFIRSLHWAGCTV

SEQ ID NO: 1019450 - protein, 221 aa, Homo sapiens
APGAGRSGAQPTWFGREAPGRGQLPACPGEPGANQPLCAPRPACPHYPALPRRPDLTPWPDALLRRLLSLPGAGPGTELSPVRGSVCDPDNEAELGKQTVIFPSSLTEEAQQCLVKLFNEIFDLLKEKKQERLRGARMGKIKKEMLQRGTLLILTLLIVNETHCARCLQLYQLLVELAKGSAWNCGLFTMQKAVAASTLEEQGMDIVNPCHMVNVSRHECI

SEQ ID NO: 1019451 - protein, 183 aa, Homo sapiens
APPGEASARQRARFGSKLRRCSRSDSGPRWAPRAAREPRTAASPEDAQSARVAAPRRAGAESEPGRPVAAWPAAAWWAAPAGSPRCPPPASASGLEAGSASEPMARGPCLLTPPPQKSNQHESRTGMVVPGADNEGYQSTRALQRRYESIAIASIDKRIPWKLRTQSIPLTEQKIEALSAQCR

SEQ ID NO: 1019452 - protein, 134 aa, Homo sapiens
APPGEASARQRARFGSKLRRCSRSDSGPRWAPRAAREPRTAASPEDAQSARVAGGEGSGGGGRGVPWGGGDGGGGGLGAGGDGVGEWGEEGVVGGWGGGGRGGGGGGGGGGGWGGGEGGGGWGGWVWVVVGGLV

SEQ ID NO: 1019453 - protein, 112 aa, Homo sapiens
GGGGSGGSSSRSSCSGPPRPGGGHPPRPRLEGRGAARPRSDRHPPLPARPRAPRPAARSPPRALLAEEPSPPPARPPGAAPAPPARVRPPAPAAAAARLAPRRLPSPGPLEQ

SEQ ID NO: 1019454 - protein, 120 aa, Homo sapiens
MATHSPLAMLEILIGKIKPIFSRAGKLGNTTWQNCKRLILLPLIGWADAIAHTLVSFGFSDGKQLALSIEIRKEVNEQFSTLGGFFRKFELVIAADEKDIIYTRSNIRMKMFILSHRGRL

SEQ ID NO: 1019455 - protein, 111 aa, Homo sapiens
PPPPPKESTYANNWNEILRQFQQGKWGYLIWVSHPNSSRQDLPYTSPEHLDTLSCLASSCYWKSNDDVFIQFIGLSISAKINVISVPAYLSEVGKLLCKVLDSKYYKLLKK

SEQ ID NO: 1019456 - protein, 127 aa, Homo sapiens
MSLITSSSSSFVNMWEWPGCTVASSMFVAFSFSSITCLGMMSEELMASKVIDLWETACKELWAPPAAEPIPRPSHCTPDSIPHTRRPFSTPPNATPPRDKAPGSPSPSPNKARLDAWVKLSTVIVSL

SEQ ID NO: 1019457 - protein, 133 aa, Homo sapiens
MWEWPGCTVASSMFVAFSFSSITCLRMMSEDLMASKVIELWETSCKEPWAPPAAEPIARASPCPPRPRWGPMRRGAFLPSSPSCSPGAGHGAWVAGGRGVGRAPRCPGLLVGGPGVGLRSGFVGWGGIGDWPT

SEQ ID NO: 1019458 - protein, 117 aa, Homo sapiens
TRGSIQIGHSAGSPTGVIPPYSIPDMPTVTWACVIPDPMHTASASATRGSIQIGHSAGSPTGVIPPYSIPDMPTASSIGAKDALRTSSFLRTTLLTSTLVVAKTRHATYFSMSPRFP

SEQ ID NO: 1019459 - protein, 254 aa, Homo sapiens
VDSNLVAYNKQDMYLSSKENITSNTKHLVHLDWMSREDGSHILTVGIGSKLFMYGPLAGKVQDQTGKETLAFPLWESTKVVPLSKFVLLRSLDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAAI

SEQ ID NO: 1019460 - protein, 295 aa, Homo sapiens
RLPVFVVGLTSRQDKMDLGEEYNYLFKVVLIGDSGVDKSNLLLLFTRNEFNLESKSTIAVEFSTRSIQVDGKTIKAQIWDTAGQERYRAITYAFYRGAVGALLVYDIAKHLTYKNMEHWLKELQDHADSNIVIMLVGNKNDLRLLAVPLTRPAPSQKEQLVLHRDLSLGFHYVEEAFKNILTEIYRIVSQKQIADRAAHDESPGNNVVDISVPPTTDGQKPNKLQFCQNLLPLRLHPACVLRPPPPRYPLAPPCCSSVAGSFQPSQELCTGPRKDRSQFYPFCPGKARPVCCTMK

SEQ ID NO: 1019461 - protein, 74 aa, Homo sapiens
ILGLCYPSHSRGSAQPGPKFDKQRLDGSVSSWFRSIQTRIVGAVVRHPYDTSTTESRDEKRGQSAFHRHGTSHH

SEQ ID NO: 1019462 - protein, 242 aa, Homo sapiens
MLLSFHCQVIVPGSPPPPRFPPPLSLTRLAGGCGGRGGGRGGAPLVWGGGRAGVGVGVGVGGVGVVGLGVVGGGGGRGGGVVGGGVGGVLGGGGVGGAGGRHLQAAGRDVAHGRLHVVGDPLHEVAAVLVLHVEHLLVHLLHGHAAPEDGSHRQVAAVARVAGGHHVLGVEHLLGELGHVSARYCWLPRLVRGAKRGMKKCRRGKGTMFTASLRRSAFSWPGKRRQVVTPLMVADTRWLRSP

SEQ ID NO: 1019463 - protein, 193 aa, Homo sapiens
MLLSASVNSISSMPSPVYQCRKALRRNMAVNCSEMRLNSSWMAVLLPMKVADIFRPRGGMSHTAVFTLLGIHSTEVAAVLVLHVEHLLVHLLHGHAAPEDGSHRQVAAVARVAGGHHVLGVEHLLGELGHVSARYCWLPRLVRGAKRGMKKCRRGKGTMFTASLRRSAFSWPGKRRQVVTPLMVADTRWLRSP

SEQ ID NO: 1019464 - protein, 173 aa, Homo sapiens
SRRRPEPGAPLQRGAGCGAAACLAPLARAGRSPAMPGFDYKFLEKPKRRLLCPLCGKPMLRACAGFHLLATGFCDTCLQEFLSEGVFKCPDGPSFLCGLCQRSTHDPGKACERYNGYFWAPWPLIPGLLAIPHMCAVNGCLGRLWDGRCQRNLVTFITKGAHPLEVNPWHGFK

SEQ ID NO: 1019465 - protein, 111 aa, Homo sapiens
TLITQRKCCLTILEANTSTNPILGMDSSSAGRHIQHGRTHGSLGTDPAILPTHLSIHITTQTLETIVQRREPCICIAIGRRHTVIQLRFTHSIGCQHTCSHRHLAYIERAA

SEQ ID NO: 1019466 - protein, 142 aa, Homo sapiens
MHLYKPACADIPSPKLGLPKSSESALKCRWHLAVTKTQPQAACKPVRPSGAAEQNICGQSFYVFMEFRCRKPPEQRRAWHTGTADCKVIQPGTALMSKVVIQTTIRTEHSKTKPCTNTDGNNAVSPLHWVAFLSSGLRTFSV

SEQ ID NO: 1019467 - protein, 111 aa, Homo sapiens
MIAPGCFEALVPQQLRHAPQKARTPGMWFLRVVFYRQKSKNHFSPTYSKWAGNEVIIISKGMFSCTALENFDGPLGMLLKPNVPSILTNIRYDSRRIITSGYLFVGLYGQQ

SEQ ID NO: 1019468 - protein, 191 aa, Homo sapiens
GPAAPQNPGALKFSVHLSILPMALARAQHGQGFWVGRLSFLLAWSSQPYTLPQAAPSLTCCCPYRSEKPCLAGPRATVFPLFHPSPSQRSSPVLSQKPKENRGKASCQQLPFPTALGGPCLCSREGIFMGMIPAGAVRFDPNSAQFSSDEGLALMGTEKCVDLLPARAALSWVLGPSGGQGCANPVQNRVL

SEQ ID NO: 1019469 - protein, 136 aa, Homo sapiens
GPAAPQNPGALKFSVHLSILPMALARAQHGQGFWVGRLSFLLAWSSQPYTLPQAAPSLTCCCPYRSEKPCLAGPRATVFPLFHPSPSQRSSPVLSQKPKENRGKAYVSRNFLSIAFGDHCLCSREGIFMGMFLLER

SEQ ID NO: 1019470 - protein, 113 aa, Homo sapiens
MTYVLTRRGNVRGLHGSGLRYSARIREGIWGEIGLSGIKSLNRNQEKPNITRCAAGGTVHYYETGTEDGWGHVNGGNCRWGPACGQAACYGIAAFNDGTGWVKLIGNNNSSVH

SEQ ID NO: 1019471 - protein, 315 aa, Homo sapiens
FGAHLATVCHPPTDGQGKALKGWKDGSEIDKSRRGWEGEGSGMGDGKGKGHEGAGTMKAKGRTEDTGRGTMEKVMRYKGKRCAEEEKKESRQLGEKIEVEMGEITSMDILMTIGGEQRKEGTEKWAPTDKEQKCYTRTKLHCTTGRERQWRWNDNEEDGLKIIIDGANVVVCQANKGMASTDGVGIANDPRLYDGRRRAGGPTPPCGTGGGTTTINTDENVKGAETGSRTISVKSTSITSRTGKDNTGTGINEGDERGAISNDYESRKERRERKEEKTERTGDAAEIGGNGGMTNMHAENEKETKEKQMSRVTGE

SEQ ID NO: 1019472 - protein, 67 aa, Homo sapiens
MPQLRLLGFALVSNGTKCVKYRNAVLLLVSKDGNAIVSCGILYSRLISNREHVGAAGPFGRNGHARE

SEQ ID NO: 1019473 - protein, 334 aa, Homo sapiens
FGAHLATVCHPPTDGQGKALKGCVHDEKKSKHETERAPFDISVSASMITVGDTPYDTHFFYALRWAPPLHLGANNGLFTYWWCVFWAISCDDNARSAHCATYRADPELTASRDDDDKRNVIGPLKNGAGLNVGNVNNGLFTNFLYNRSNGGNRKNLRLNPTDIGGVNGRTNFIKRGLANHSTTGTNPLGGNLTRLHNNRGLVKFGNTPSGGDLRKNMPDFGGNGLNGLPLGNGGGRNWNPNHPEPYLNSEYDYNGPSVGNNGGGGNNGHKLLNRNDAYQPYGAPLSHFLPDVNNGNPRNPFNLGNGYAGKLGGFGGLAYTTLPGYFGYGALARL

SEQ ID NO: 1019474 - protein, 175 aa, Homo sapiens
FGAHLATVCHPPTDGQGKALKGCFWFRLWPPHLIFSWPSPFCVDLLNYPPIYGHFPVFFIFLLSASGTRIYQTKLMNQNGFYYTRLYRTHDDSYNAQYCGVTVNNVSDVTVAYLTYVENWGLTEREFNSPRTKFVLDWSVSVLDEIRTGVFLWFLNDRLFSHALAMVCLVATTPR

SEQ ID NO: 1019475 - protein, 232 aa, Homo sapiens
YLLTALPGALLAPFCPSSVSAAAGSCSGAEWSEPRVLQNALTETISRLLRVEIKPMDFIVTSTSRQEAFDACSWDDNLLVNNEDLLSHSPGMFDENTPNSRVYKNEHAWFTQITPDLNDSSSLSNNHNNVLCQLCGHCEYRMGSEYRTWVSILKFLEEYKWPIHGIPKVSAEHGQNDTNFCFPNLSKVVDAYLRPDSLLEIVTIELIDTWGKNYRPFRTSSADKLDYFKYCA

SEQ ID NO: 1019476 - protein, 162 aa, Homo sapiens
WQVAPDWGQARIESMVANRPDWCISRQRTWGVPMSLFVHKDTEELHPRTLELMEEVAKRVGVDGIQAWWDLDAKEILGDEADQYVKVPDTLDVWFDSGSTHSSVVDVRPEFAGHAADMYLEGSDQHRGWFMSSLMITAMKGKAPYRQVLTHGFTVDGQEPTC

SEQ ID NO: 1019477 - protein, 291 aa, Homo sapiens
PTRPVTATGQQRRGHREKKRSPVQSYKVYQKSSLYINKNQRLQERLYIQNDGEDVLHLQTGSRPDGETRQRRGYREGREGASRPGEGRGEGRGGDGLLPASINRQRWEACASCCVRRSGWALRARGVRLPRPPLPGSSGFGPEHGSGWGRRAGWATRSQREGGNRSLESAKEKGRRRRRPPVLLASGQPRPSCRPPHPAKTLWDPSFMGAANRGFYAFPRAGRGSTGSCSSCGPGPAVQSSLEGWNEPATEGQQGGARGYRGGGGRRTFTHAVEAQGTQAAQPFHPTVRGP

SEQ ID NO: 1019478 - protein, 184 aa, Homo sapiens
ARSSQAPRSVATAASPCALGYPPRSHPRRRPGARSAAPESVPLRLRGDGHQKQKKRLAGAAYNLVREGSAVIWVFKYGSTIVPGEQGAEYQNFIQQCTEVRLFAFVRFTTGDAMKKSKFALITWIGEKVNGLQRAKNGTKNLVKEVVQNFAKEFVISDRKELEEEFIKSELKKAGGANYDAQKE

SEQ ID NO: 1019479 - protein, 193 aa, Homo sapiens
TPPPPAISGTAPNPTSQWHTPRPHRGNPSIPARPEDEAHSRGPPPPRNPGMFMPGTLYVYIYIAHAPHPGGRGLPLAASTGPGSSGAHASPTRKGTPSRVLKDELCSGPSKLLRKALASPQETLNQRDLVTRMKLYGVERGPLEPSEPGCSGSSPGGRSAMTGEWARKPPRFYVRGSPWVSVVDRVAEQDTQA

SEQ ID NO: 1019480 - protein, 323 aa, Homo sapiens
METILEQQRRYHEEKERLMAVMAKEMLTKKSTLRDQINSDHLDSGHAKIGDMEVSGNLRDQYDDKDGFTNGGAQCTLSGPEMSCCNTIIESCDVQEYRRKGPKSGSVCPNVRWSLRGTALKARMRIQVYKRHETWGRSQMKRDMVVISISMDVSSKYGNRKASETAGMNDIPCGILEQFIPTFLTERKNAEYEEIATRCCLTCHQDHTDRVKPLQDQTATLGEESGNETGKTGDELANLTRKKRRENSQDPASMSKPPTGRPEYALPREARPSRGSMQPATNVGERGGPTTHADHTRNRHQTVTKNLGRTWQRTPPKAGTPTQ

SEQ ID NO: 1019481 - protein, 49 aa, Homo sapiens
MCFGMEVEAPSHDGDAYEDKGRCGPTGEGDKRCGACNGKSCLKGVISAI

SEQ ID NO: 1019482 - protein, 247 aa, Homo sapiens
MPPSGPRGTLLLLPLLLLLLLRIHSEEEFGDTGEGWETVDDARLSLHPDVKTLRLLRTSDAWPALWQRTTLELAQCAPCCHHDHVMTMMCSSVRCDPHVGLPCHVLQDTTKMLACRLVLAHWMQLRMHAASSQQARPQGPELPTHEGQLKFHHQTQTMYPVPAPAGDQKEVDTSEKKLLERLPEVRGAPASVILREPSPQDFLMLHGDLMGAGLTWHSQLPWGPVSCWAPGARARHGISRIGCTQIT

SEQ ID NO: 1019483 - protein, 277 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVY

SEQ ID NO: 1019484 - protein, 82 aa, Homo sapiens
LFPPSFRAATMVRMNVLADALKSIKSSRHKRGKRQVLIRPCSKVIVRFLTVMMKLVDMWPNLKYIDDPLELGRSRCEPQQAG

SEQ ID NO: 1019485 - protein, 236 aa, Homo sapiens
MVSVLTLPGKAFVKSPCSLGPSKPCHNSHSVSAHLSSEASFPECERDTDRETDRQACSSSSTCTRPLPFGERLGGLIPLAAAPSQHSVHLWASWPAQPCVHLGREGPQGPMGYPPGGCMGWGGEAGTGPGRQAEVCGQEAVKNSEVREPETGARLGGYRGERRGPPERLGPPSGPRTAEHHLIDRFASVETSIATLCSQDQPAQPTLSLLRKAPLVWAHGLAVFQPGDHRLGLPLH

SEQ ID NO: 1019486 - protein, 212 aa, Homo sapiens
QNPQYNPQTPGRRPCTTQTSSLPMLPPPPQGSYQPSPSPQSYHQVAPSPAGYQNTHSPASYHTPSPMAYQASPSPSPVGSPMTPGAPSPVDYNPHTPNSIQNSYWLTTNIQKTYLYTQVEQTIIHNITGGSVYLKDKVINISSKHLPITPTNNIKILKDREATGVLLSIDGEDGIVRMDLDEQLKILNPPLPGEAHWKPEAGQGRWTSSDEE

SEQ ID NO: 1019487 - protein, 214 aa, Homo sapiens
GYQYTNSLQSKLAPVRTSPIGSIRVYALYSEAPFGYMSYWTTLDAPSPCVATIPQQRPRSSVHSMLEASHATCVNPTWTNSCMIGLRGQPTSDIYMVALATRHGDHPAVLHRRVHELLVMYLNGTSENGLSGIFSEHSGAVSPATRVTNNVLESCSLRTEDREATGVLLSIDGEDGIVRMDLDEQLKILNPPLPGEAHWKPEAGQGRWTSSDEE

SEQ ID NO: 1019488 - protein, 281 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREDEQERGRDQHHLPAHGPPPSISTNQNPDAALRAAAPGGQPGVHSHDQCEIRVVKLDRLDLARKELKRMQDLDEDATLTQLATAWVSLATGGEKLLDAYYIFQEMADKCSPHPGVLNGQAACHMARAVEREAVRRGKKDEGYGKWYLNAVQKGSLSEKILSVRVQVHLKGAAREM

SEQ ID NO: 1019489 - protein, 294 aa, Homo sapiens
MAPPAPGPASGGSGEVDELFDVKNAFYIGSYQQCINEAQRVKLSSPERDVERDVFLYRAYLAQRKFGVVLDEIKPSSAPELQAVRMFADYLAHESRRDSIVAELDREDEQERGRDQHHLPAHGPPPSISTNQNPDAALRAAAPGGQPGVHSHDQCEIRVVKLDRLDLAPGKRGGKALWANNGKELKRMQDLDEDATLTQLATAWVSLATGGEKLLDAYYIFQEMADKCSPHPGVLNGQAACHMARAVEREAVRRGKKDEGYGKWYLNAVQKGSLSEKILSVRVQVHLKGAAREM

SEQ ID NO: 1019490 - protein, 184 aa, Homo sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGHRRTEGFLLLVQAVRAHLTGTEAPEFFAGEAGLDPSAPLVTPDHWPHS

SEQ ID NO: 1019491 - protein, 299 aa, Homo sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGKGRRGFLLWYSRATSGTEKKFCGGRLEKDKENLTKPNWPESDYPPGISCSWHIIAPPDQVIALTFEKFDLEPDTYCRYDSVSVFNGAVSDDSRRLGKFCGDESRGSISSEGNELLVQFVSDLSVTADGFSASYKTLPRGTAKEGQGAGPKRGTEPKVSCPQVP

SEQ ID NO: 1019492 - protein, 116 aa, Homo sapiens
RQRNKQKKREWPKKKSREKDRQKDKKTTKWVKGPGQAQQQCPGISTSLPWGSGGGEGLAGASVLTGLLLLMPYYPSSSLLGSLAGGIPRAMDGWAELAEDRGSWRLPGEVEAWVWG

SEQ ID NO: 1019493 - protein, 155 aa, Homo sapiens
RQRNKQKKREWPKKKSREKDRQKDKKTTKWVKGPGQAQQQCPGISTSLPWGSGGGEGLAGASVLTGLLLLMPYYPSSSLLGSLAGGIPRAMDGWAELAEDRGSWRLPGKKNNIRVTRNVKYQNRTTQDYIQKQINKISNINKYKTEKHQTVQIKN

SEQ ID NO: 1019494 - protein, 57 aa, Homo sapiens
TDSGISAEAAGIDWGIFPESDSKDPGGDGIDWGDDAVALQITVLEAEPVLRVLPSVR

SEQ ID NO: 1019495 - protein, 138 aa, Homo sapiens
MAHLRGFANQHSRVDPEELFTKLDRHWQGARYGEGLQGPSITTQRRWWPSMIIDLEEAEGIDNRGNIQARKITVPRVSADRPLNHPDTLASYVKEATKANGIIMDVPGRAGADTGQCLKPGPTEEDIMAQKLRKSKGR

SEQ ID NO: 1019496 - protein, 138 aa, Homo sapiens
MAHLRGFANQHSRVDPEELFTKLDRHWQGARYGEGLQGPSITTQRRWWPSKIIDLEEGRRHDNRGNIQARKITVPQSVQTAPKSPKYFRASYVKEATKAKGIIMEYLGAREQTRDSAYKPGPTEEDIMAQKLRKSKGR

SEQ ID NO: 1019497 - protein, 240 aa, Homo sapiens
MQMSYAIRCAFYQLLLAALMLVAKLQLLYLIAAVRHCTGRRSKTNIIELLSPRPHGPEDTGQGRSYRTALGLWQASQDASRPTYPAIYSAALPDRTTHCDPHTSAASLRTRHRPRRCNNPMADNPCSPGYLTWAQRPTRNRATLALIPAPLPRPVTSPGPNPQMARDTAGQRPAAHTRLDKGTHTTGSGLVEQPTGTPLSGEAHQTKPLGRASSAMPGHSRLQSRPTADRDRVLGPPRFP

SEQ ID NO: 1019498 - protein, 340 aa, Homo sapiens
EWGLGTAPPSYSWGTAVGTREGQERGLKQGSSNGATTPQSQPRPLPDPGGSSCGLGWGVGDPPQALPLPSSSLLSGSTHSFRQENEAQREEEVGEEDEGGAEVAAQMKAEVRGVGKATPPPHPPQKGARKQQHQAAGGGDKAGFKAEGPGAGGASGLSEKPCQLLFSELYSSPAPTHLKTSSSMGVQWCRFMKRASSVKRTQVQVPTSQASSFFSLRKPSLCAEFSHLKILPSGTGTKLRSLKCRLGTGALRTSLHSLFTGGRVKVISKLFRIFRKPTLNRKLLLFWVMNTELSFSTKLTWLEPWPAAKVLRTGLLPCWLQHGRLLPSPARNATKLSSLP

SEQ ID NO: 1019499 - protein, 248 aa, Homo sapiens
MSCSWISPEGKVTPCSLKPSVLVPAFRMVAYTRRARDFLVSRTATTPSERQYPFPAVSKALQVPSGLSIPSLKNCTEVYGLQQRRLIALPLMAAHVALHRCGLCLGKSVLQWTIKAWRKHALCPSCDCLRALLKLGQKKDEHGLSHQSLAGSPPCCSPRVSRGLGSGPPRSQSRSRPPRRQCVFLGVNLGDASVHDGFIGDFQQQPQLRVIVLLLLGVTPKKRLNLKVLSSDRGSAKPLRRFSAFPGC

SEQ ID NO: 1019500 - protein, 358 aa, Homo sapiens
RAPSCRTVHNGPLGNKPSNHLAGSSFTLGSGEGASEVPHSRQAAFSSPIETDVVPDTRLLDKFSQITPRLFMPLDETIQNPPMETLYIIDFFIALAICNTVVVSAPNQPRQKIRHPSLGGLPIKSLEEIKSLFQRWSVRRSSSPSLNSGKEPSSGVPNAFVSRLPLFSRMKPASPVEEEVSQVCESPQCSSSSACCTETEKQHGDAGLLNGKAESLPGQPLACNLCYEAESPDEAALVYAARAYQCTLRSRTPEQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTDL

SEQ ID NO: 1019501 - protein, 321 aa, Homo sapiens
RAPSCRTVHNGPLGNKPSNHLAGSSFTLGSGEGASEVPHSRQAAFSSPIETDVVPDTRLLDKFSQITPRLFMPLDETIQNPPMETLYIIDFFIALAICNTVVVSAPNQPRQKIRHPSLGGLPIKSLEEIKSLFQRWSVRRSSSPSLNSGKEPSSGVPNAFVSRLPLFSRMKPASPVEEEVSQVCESPQCSSSSACCTETEKQHGDAGLLNGKAESLPGQPLACNLCYEAESPDEAALVYAARAYQCTLRSRTPEQVMVDFAALGPLTFQLLHILPFDSVRKRMSVVVRHPLSNQVVVYTKGADSVIMELLSVASPGKFIQK

SEQ ID NO: 1019502 - protein, 33 aa, Homo sapiens
RIADLRMSVEADINGLRRVLDELTLARTAAGNA

SEQ ID NO: 1019503 - protein, 162 aa, Homo sapiens
MTEALQWARYHWRRLIRGATRDDDSGPYNYSSLLACGRKSSQIPKLSGRHRIVVPHIQPFKDEYEKFSGAYVNNRIRTTKYTLLNFVPRNLFEQFHRAANLYFLFLVVLNWVPLVEAFQKEITMLPLVVVLTIIAIKDGLEDYRKYKIDKQINNLITKVYSR

SEQ ID NO: 1019504 - protein, 272 aa, Homo sapiens
MSPLIMGLDVNPDACLTALLDICKLLEAVCPSSPTSSGHEIPTQLLGKDLQSSLCPPFPLAWALLLPTPLLSFHPEGCAPSHSHCLACHLSLHPVQTSSSGLPAHQPVMGWMPKCRAKLMHLLLMSFSVCLMTSGDPSSSARQPRSPTLSSAYLPSHGRQHPQSREVCASGTWNMQGFADSSSMLLPLPFSLPPKSTLLPRHHLCPPNSISTHQPLTSHPNSIGHLPNSLASTPLRPPGRDYAVHSDDPRTQECSPCVAGPLYMLLIQRHSG

SEQ ID NO: 1019505 - protein, 106 aa, Homo sapiens
HKENIEYWLGLIVTGKYFNKSSPKLHDRVHDDCATNELRASPFWLWLVVVVVFQPGCLSPTPPLPHLQSLSLCLALTKAEVQYCKSWLTVALTSRAEVILLPRPPR

SEQ ID NO: 1019506 - protein, 155 aa, Homo sapiens
MADQLTEEQIAEFKEAFSLFDKDGDGTITTQGVVGQLNEIPGKNPTEAELQDMINEVDCRWELGTLEVSLLEFLSMNGPRKDDETPTDEVTDEYDTRAVRSSVLDMGWGNWLHHAAARAAFTINDEPGGEKLTDEEVDEMIRDADIDWTIGQVNY

SEQ ID NO: 1019507 - protein, 262 aa, Homo sapiens
RGRENKGGQHSRRGPGRKAREHRRAGKRPRAKRGKRKSTQSNRGGRGHGEAGKATTTGQRSEKGGGSDKRTREKGEKEAAERGKGAGKEAGGGEKRKAERERGSTESAGGKGETSKDGTEAPGHRDGKNRTGTAQADGAGRGAAGGGEEAGSAKKGQTREQARRADTRGGKQRRGGGNKREATEPPDSQKREEERGKEGSTYIKKGDNPDTGAFGPISGWNGDNMREPSANMPGGKGGKGTRKEGQGQWNHAAGGAGLQPTT

SEQ ID NO: 1019508 - protein, 465 aa, Homo sapiens
KDKMEQKENVPPGPEVCITHQEGEKISANENSLAVRSTPAEDDSRDSQVKSEVQQPVHPKPLSPDSRASSLSESSPPKAMKFQAPARETCVECQKTVYPMERLLANQQVFHISCFRCSYCNNKLSLGTYASLHGRIYCKPHFNQLFKSKGNYDEGFGHRPHKGLWASKNENEEILERPAQLANARETPHSPGVEDAPIAKVGVLAASMEAKASSQQEKEDKPAETKKLRIAWPPPTELGKFQECAYGGKGINNVNSRNMASLKTNISKPEVPEDVDLDLKKLRRSSSLQGKKPPIHCSSFISKHLCQEPKNCVPTYQERLEHVRAAVKSLWVEELQKGKQVENAKASKKNGNVGKNKPGKTKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 1019509 - protein, 280 aa, Homo sapiens
YCPSGRNGSQHGSGVRAMLQGPEKYFSFSLEITAYKSQVDNVKPGLGFSFEFTEQQKEFRSYCCKFAQSRQHPSQWLQTSCIKHWCNIQSPLIQQEPGNWFNATTHIPENLWRSCDYGNFGMLVVNSVAQHTGLWHVPGVSATAHCTRHTFFWGPNAVIHSLLGKLASSKSKGKSFARSNALQAAHWMCALMSVTATLAAGLWNGSWVINRNTSRNKHQAGCRSSFISIGQHTTGGHKTQTGTAHQHDSHSGNCSDTRDTGMQESEESRNSLPWVNSQTL

SEQ ID NO: 1019510 - protein, 327 aa, Homo sapiens
SGPRSWLELRALPPRPLSRADAPGGRVAALRAPPYHARCPGWGRPSSQDTMPEDGAGDGGEVPALIPDGEPLREEQRPLKQSLGSSLCRESHWKCLLLTLLIHACGAVVAWCRLATVPRLVLGPEAALARGAGGPPPTYPASPCSDGYLYIPLAFVSLLYLLYLAECWHCHVRSCQAPRTDAHTVLALIRRLQQAPPCVWWKATSYHYVRRTRQITRYRNGDAYTTTQVYHERADSRTARGEFDYSAHGVRDVSKELVGLADTRPAALQQVLHFSAEAEASYLTQRARFFSANEGLDDIAREGMHLKDVDFRESLMVFADPAAALRT

SEQ ID NO: 1019511 - protein, 156 aa, Homo sapiens
TNFIFTLVGVWLVEKVGRRKLTFGSLAGTTVALIILALGFVLSAQVSPRITFKPIAPSGQNATCTRYSYCNECMLDPDCGFCYKMNKSTVIDSSCVPVNKASTNEAAWGRYITHFTIRIYNNISKRGLCLSFQSACTYSSSFKLAFITTLLCSIYW

SEQ ID NO: 1019512 - protein, 183 aa, Homo sapiens
KKLANKKELKQQGRSKKYQANHEDKQKNFLFLRLWDRNMDIAMGWKGAQAMQFGQPLVFDMAYENYMKRKELQNTVSQLLESEGWNRRNVDPFHIYFCNLNIDGALHRELIKRYQEKWDKLLLTSTENSHVDLFPKDSTIYFTTDSPNAMTTPRHDKAYVIGPFVDNEYAARHIPSQATADPN

SEQ ID NO: 1019513 - protein, 102 aa, Homo sapiens
MAHRFPALTQEQKKELSEIAQSIGANGKILAADESVGTMWNRLQSIKVENTEENRRQFREILFSVDTAINQSIGGVILFHETLYQKDRQKLCRDILKEEIVV

SEQ ID NO: 1019514 - protein, 121 aa, Homo sapiens
FTLGGPPLYKRMRDKQFICAKRPNPPVQENFDVNKYLGRWYEIEKIPTTFENGRCIQANYSLMEKDKIKVLNQEFVELDGTVNQIEGEATPVNLTEPAKLEVKFSWFMPSHRTDPATDYEI

SEQ ID NO: 1019515 - protein, 113 aa, Homo sapiens
MTLAGYGGSVSCDPSTFGRPRWGRITLSPLEFDTDAVGNIVRARYLSLFRLDFLRWSLALSPVLECSGSESRAHCKGPAPGFKKVDPGRQTSRSSMRLQAHRLPMTRIKLEVL

SEQ ID NO: 1019516 - protein, 182 aa, Homo sapiens
MVSLSCGAEAGLYCCHLGSLQPPCLILLPQPAECLRLQAALPRLTGLVETGFRCVGRAGLQPLTASDPPASASRGAGIADGVSFTQCSMVPRLECSGVISARYNYTSQPPALASKSAEIAASARRHPVWDSEECLCLAAIVWDGEEPSAWLPSLESEERLARPPSHLGSEECFPSGITSRNK

SEQ ID NO: 1019517 - protein, 147 aa, Homo sapiens
QWVDIMTMDYIFNVLDLNMYNRPYTYQVHDYLRSKLVFPSMKMTCIFDVTFRVLVVELGSDSVIMTGSYNYLLQDVLTRITKCVSDPLRRVEADNSKPRATPKPRKVGLGGKRRKDENSVDSLDFSNKTLHTAWHPPEKSMSSGGYK

SEQ ID NO: 1019518 - protein, 223 aa, Homo sapiens
SRNRSRSEAQPDPAMEQPRKAVVVTGFGPFGEHTVNASWIAVQELEKLGLGDSVDLHVYEIPVEYQTVQRLIPALWEKHSPQLVVHVGVSGMATTVTLEKCGHNKGYKGLDNCRFCPGSQCCVEDGPESIDSIIDMDAVCKRVTTLGLDVSVTISQDAGRYLCDFTYYTSLYQSHGRSAFVHVPPLGKPYNADQLGRALRAIIEEMLDLLEQSEGKINYCHKH

SEQ ID NO: 1019519 - protein, 271 aa, Homo sapiens
NEVTHSGDTGVETDGRMPPKVTSELLRQLRQAMRNSEYVTEPIQAYIIPSGDAHQSEYIAPCDCRRAFVSGFDGSAGTAIITEEHAAMWTDGRYFSPRLAKPIGPAPGHHSIDKWRLEGHTNSGRLAGELCFLKDPGLWSWTPCIIPTDYLEAKSAQFSTKCPAITSFLSRRTSLDKTLDRPSWAALATPLPHHWAWIYTRHSPWKRHTVGRPFALAPMGLRRNRYTVAFRLHPSPIHTRRTQPWPSFYTLPQEITMVRSHPIPPHSTLPY

SEQ ID NO: 1019520 - protein, 318 aa, Homo sapiens
VSIHDRRRTAGQAGGLRGSLPGLRRRGKPLHPPLEPRPKVADQTLHRPGGPVTQSTNRMASYLLADLPQGVDLGRPGIPPHETCHHLVHPVHTLTAWGTLAKALVLLELNEAGEGFHDVLERPMRITAAVPRPVCPSPSPSKSISTVSKTDLGISGVDEPPGITARRLSQPPVTPPACSISSFKGTDISPPTVQGWLTPEKNSLVPEYASAKASQPGTTAAECGGHHFFHVGHSCWAAKHSHVCEGGLQAGLALLFLGLDERFTEVGPSPAHHKHVKIARTCANCLIGLLDGHQIGGSLQNSLGCRRSPGPMAGPHRK

SEQ ID NO: 1019521 - protein, 137 aa, Homo sapiens
LFIIDPNGVIKHLSVNLPVGRSVKPRLVKAFQYKPEKVCPANWTPDSPTKPSPAASKEYFKKKITNLHLLNNHSNLLFRWFEGKMLFKTQNVLFKFWQPLKGLEIVYWLGGWASFFASKRSLITQHSSPLPSPHPPL

SEQ ID NO: 1019522 - protein, 210 aa, Homo sapiens
SGESRGAAGLSPVSSSCSLGRAAVTVHRRRRGLHRRVHPPASMATTATCTRFTDDYQLFEELGKGAFSVVRRLCDENPHAGATQQKSSLPRNLSAPRITRNLEPLSARAYVALLKHPTHRAPPMTSIPASTGLPLPRCLDLCYRARTCFAAPRWPEQLLHSRSQHASPLLLRSRLLARVLTEHPPAMTIVHQWTLKPAEPAAGDVNARVP

SEQ ID NO: 1019523 - protein, 247 aa, Homo sapiens
MGCRACALREDGTCRLLLLLLLLGRRCGRRGAARRVLLLLLLGVLSAGLRPGALATEHYSPLSLLKQELQHRQQQEAPAGGGGCSPQSGDWGDQYSAECGESSFWNFHDSDCEPKGSSPCDSLLSLNTEKILSQAKSIAEQKRYPFATDNDSTNEELAYAYVLSGSGLSDEANTAFVQQLLQILSPLGRITEAVNDLTKAIQTAASDGWYRHRGTLELHITLDYATAHEHFTQSLELTKKQPIATLS

SEQ ID NO: 1019524 - protein, 141 aa, Homo sapiens
ETESPFVTRLECSDTILAHCNPRLLGSSDSPASASRVAGITGTCHHTQLIFIFLVETGFHHVGQAGFELLIWWSACLGLPECWDYRRKPPRLAKKIKIYLVYVLTSYTQRILDFFLKIIIKPPISPVEKEILRFLCSFFPA

SEQ ID NO: 1019525 - protein, 91 aa, Homo sapiens
IHDTETKMEEFKDQLPADECNKLKEEISKIGELLARKDSETGENIRQAASSLQQASLKLFEMAYKKMASEREGSGSSGTGEQKEDQKEEKQ

SEQ ID NO: 1019526 - protein, 212 aa, Homo sapiens
SGVADMPRRRELLLSSRPESSHYGEPWLLDAGSLCGHMELTLGTSDKKRPKPVQEWNIVEGQAYTSGQVHALECNRYPPSGAAGGWLAAIMDGGLRARLMRWCAAGSPMAGAHGDSLMVDGLGLTRALATHEIRCNKTRAKTKKPTMTAHALERPDTQAKRTRKRAGRTTAQVPLASGQVPTEPQAQTKHNRQMTHSRTDILSRENNAPTTQ

SEQ ID NO: 1019527 - protein, 174 aa, Homo sapiens
MAPSASCCSRNCSLIIPFLCFISLASTTVANCSSRIASLLLRFNSGWTSSLRLRLLLSPARCLICLPASPSRRPAFPKGFFRALPSSESSFPLSIQPCRATNSRRMSFVPSKIRKMRRSRSTRSTPGSFMKPIPPMIWMHSSVTFQAASEPKILLMAASIWKSVAPWSMLALTM

SEQ ID NO: 1019528 - protein, 274 aa, Homo sapiens
MLAYGQRLEAERTVSRAHRAVEREMPALGWAVAAILMLQTAMADLPGDSAQEGRGVFRPKQPRAEGSAQLPLVQEGAEAAALHTTTMAKNTVFLIEMLLPKKYHVLRFLDKGERHPVREARAVIFFGDQEHPNVTEFAVVPLPGPCYMRALSPRPGYQSSWASMFIFTAEYALLYHTLQEIPLHQFFLNFSFQCHDKLAFTVAPRGVASGRRSWLIRYVESFLHPTGLELLVDHGTAGHWAVEVWYKFYGPEARYADGEVDVVVLEARCLGGGH

SEQ ID NO: 1019529 - protein, 349 aa, Homo sapiens
SRAVPPHGSPPPGRPEQSTADSGPLSHPRGPVASADPESGPSRTRAPPSRPRASPHPGSEVSRGPAWEELTVYQGKVASRCVGPGERVRREGPIAQGPGSCGGHPRLALAQGHPGFTVGAPAPASPVPTTEAVGHRPVMLERPPALDMPMPTEGTPPPLSGTPIPVPAYFRYAENGFFLKRPRGLRRSLPTPPTAKGSLPISRLFPPRTPGWHQLQPRRVSFRGEASEPLQSPGYDPSRPESFFQKSFQRLRCLGHGSSSEVFQVRSQEDGGLYAVKRSLSTFRGPKDRARKAEVGSHEKVGQHPCRAAGEAWEEASCTCRRSCVSQRAHCEAWGAPCLRPGGYMRESC

SEQ ID NO: 1019530 - protein, 125 aa, Homo sapiens
LPPHYGCPHSFFGGPHFRSHTLGKGFPRRGAHLLLSLWPARVKEPLHVLIWRERPKGTRWTRGHASERGRRGLTCPPSYLRVTAPLNPRPRPRKRGDSSRFSLFVATAGGPRSLCTFISEPRGFG

SEQ ID NO: 1019531 - protein, 82 aa, Homo sapiens
ATKPAAAELPAPMSAHNRGTELDLSWISKIQVNHPAVLRRADTNPGSQNREKREGKLVCFLKAVTLLETYTPFGGGTTFQQL

SEQ ID NO: 1019532 - protein, 209 aa, Homo sapiens
YDAGSSGAARAMSAHNRGTELDLSWISKIQVNHPAVLRRADTNPGSQNRQQQAVPTLLLGSLHQLFTLYQHLHSHFQRDDYILPTFSPGPLVNKRAKYPNSGERLLLKRLYNIICIDYTLRIYLTGRRTGRKTTRPGLLVARLLNSHLYGLASACNIISLWRTQGAPAWAFPMLGPGPPLLKNTEFSNDESRLGAAATDSQATSKLDVA

SEQ ID NO: 1019533 - protein, 80 aa, Homo sapiens
MTTGNNTVRFNPNFYRNGKCILGTLTGPAPPHSISSLISIQSLMTNPTINPFNKRIHEDSKNYNLFIPHETITSVFYIIE

SEQ ID NO: 1019534 - protein, 247 aa, Homo sapiens
MATKDGALNWMPLLDFHHKKCLEYPFYVISTEPCGPAGNPNCPYALGPQEEVEQKQILLIQRVLYIMTPPLVAHDGPLTSSSSNVLEIFISNIFFTFLSFPNPVNAFFSPIPSCTTYLSRYTCVKKLDHPDISSVLSGLYSVVLSYICSSYPGRLTFSHATENPLVGNHQTVFICASMTTEEFSEHNFDILVSLETSTRGIYKANSHIFCFPQIAAPYRTQSSFSKECCYSKQFTGPLSMLYKPGKF

SEQ ID NO: 1019535 - protein, 225 aa, Homo sapiens
YRKVKGEEVQNPGTSTVGEWASPGEEGQLEKGKQEHRAGGDDGTTGVILHVLGRCRKNLDPTFSVGGAKKLSMDPGPKSPLPGLPLSSSVQLQPGSDGCLLPLSFPTRSQVEGRQGEPDACYPRFPHSHAQASGHCRPAGASPPGIWGALQVRAGLLSIAGAGPLGLQDNGLLSGGKREGGRGLHASFPRPGSVLVLRLRLPQEFPQYPWQLRALVNVFVPVAKV

SEQ ID NO: 1019536 - protein, 286 aa, Homo sapiens
VCWTAVVLLLARAEACGIYHWQMIPYRIGSLGRLLLLADRLAGGDALSLLLPTRCRMIIEVRSKYFNSSSSRIVLGKWSQPWPIGFAPCPCDDDDHGQDDSELRWMLGRGRYRGGEISPDPATSFGGTVVCEETSGAYEKTDTDGKFLYHKSKWNITMESYVVHTNYDEYAIFLTKKFSRHHGPTITAQLYGRAPQLKETLLQDFKVVAKGVGIPEDLIFTMADRREWGPGEADPQAILIPEIRKVFFPQKRKIQGGETGNGTPRKRNSFRWAIWPALYGKTTRFL

SEQ ID NO: 1019537 - protein, 101 aa, Homo sapiens
RGPTWAKDSKAAGTPGSAAQAGWVGGRRAETGAAPAEIQSELQSMGKRDSFRIRSVSTLAKNSNKKLVSLKTTGQHPTKQTPHLWPDVDIFCPGPPHMEVD

SEQ ID NO: 1019538 - protein, 46 aa, Homo sapiens
MTRQALWKHIPDMKILFPHPSMQLNQLLRTEKFGSPIVEVVNTLSF

SEQ ID NO: 1019539 - protein, 177 aa, Homo sapiens
KCKCHGTSGSCQLKTCWQVTPEFRTVGALLRSRFHLLPLLILACTTCNWLAMLDAWAHAWVHPSAWLPGCSLGLRLTGAMPPACPGLSKSLPDFCERDAAPWTLAGTVGPPCATRCSAGSDGCGSMCCGRGHNILRQTRSERCHCRFHWCCFVVCEECRITDVGQRLQVSGPGSPGP

SEQ ID NO: 1019540 - protein, 84 aa, Homo sapiens
KFGHKGRENSGGAIGQTKLGWNSGAWFGFSSETMFAKPDWAEIEKFDRSNLKKTETQETKGGVRRQYALTIPQAWPSNLTSLSG

SEQ ID NO: 1019541 - protein, 102 aa, Homo sapiens
KFGHKGRENSGGAIGQTKLGWNSGAWFGFSSETMFAKPDWAEIEKFDRSNLKKTETQEKNPRLSKEPMDQEKQAGESKGGVRRQYALTIPQAWPSNLTSLSG

SEQ ID NO: 1019542 - protein, 78 aa, Homo sapiens
RVLGSILNATVAMMVLTPTQKYVPFSQMVPPTTNPSIPPPGTHSPIIQTPPHPSILFTNNEPGGPPIPRYDIPVKIFC

SEQ ID NO: 1019543 - protein, 185 aa, Homo sapiens
MHDACTHHLGIHNSMWAPHTADTFWRRNLPIFQCVHSAELRATVWALINLYTAFGPGGPKPQHWCGIGVVPQRRSIFIGAALSSLAVLNPPRGHTHRMAPTWAGTPKTTVAQRAHRPTRPLWGHVCKLGALTHSALAPRYHGAPPIYTSHTYTPRFVAPSGVAAPTDIQIRRSHKFVRGAYPRSV

SEQ ID NO: 1019544 - protein, 253 aa, Homo sapiens
MSSNECFKCGRSGHWARRMSYWCEAVVCGMMKPVRTTRAYIRRAYMLKSQSGSSVSHVPTSSWSTFRPMHDACTHHLGIHNSMWAPHTADTFWRRNLPIFQCVHSAELRATVWALINLYTAFGPGGPKPQHWCGIGVVPQRRSIFIGAALSSLAVLNPPRGHTHRMAPTWAGTPKTTVAQRAHRPTRPLWGHVCKLGALTHSALAPRYHGAPPIYTSHTYTPRFVAPSGVAAPTDIQIRRSHKFVRGAYPRSV

SEQ ID NO: 1019545 - protein, 109 aa, Homo sapiens
MYKGSQALGDAANIVFVHPHGECLRILPQVPQRSEEFFIAGKLQDGLLHITTCSFVAPWNSLSLAQRRGFPKTYPVGCEESTVFPCLSIPCKLQSGTHWLWTAQLLQGF

SEQ ID NO: 1019546 - protein, 305 aa, Homo sapiens
PAPAHTFTRAQEPPCGDCPLGLLLLLPLAGHLALGAQQGRGRRELAPGLHLRGIRDAGGRYCHRARTCAAAAVPTTVPCPYIGRQYVTCDPLLQPAQDPDCCPDFWDFCLGVPPPPPNTKDVCYGRSISIPVIGERYMGTTGNPCATLPRQKQGSGAVVDLSNHGLVDPMKNKGNYSWAGNSAFWGMLNEGIRYRLGIRPSSSVMNMHEIYTVLNPGEVLPTAFEASEKWPNLIHEPLDQGNCAGSWAFSTAAVASDRVLNPFSGHNNAFSFAPEFCLVTPTSSRAAAVGVSMVPGGSCVAKGGV

SEQ ID NO: 1019547 - protein, 209 aa, Homo sapiens
PAPAHTFTRAQEPPCGDCPLGLLLLLPLAGHLALGAQQGRGRRELAPGLHLRGIRDAGGRYCHRARTCAAAAVPTTVPCPYIGRQYVTCDPLLQPAQDPDCCPDFWDFCLGVPPPPPNTKDVCYGRSISIPVIGERYMGTTGNPCATLPRQKQGSGAVVDLSNHALVGFPHYNSSNSGATYWLGQAWGTNRFGPGMEGFRGAPTRPFRF

SEQ ID NO: 1019548 - protein, 277 aa, Homo sapiens
MAPDPHSREARQQRFAHFTLANQSLEEIVFATATPAILQLSRGGTQIAPAERPSAIESDAFLDDILRKVQPLWTVKYHPASKDDQLYTRERPFAQSQELQVELQSTSIFEFSRDMNELQLKLMPGVALLIAISIFSADRPNVQDQLQVERLQHTYVEALHAYVSIHHPHDRLMFPRMLMKLVSLRNPEAVVHVRSKFFALRLQDNRGSHRAALLKIMRMCTDMTVFVSPYFLVFLAGMAEAWVAASLEVDRAEKGETFLGAGQGDPPAGIKTESQDG

SEQ ID NO: 1019549 - protein, 259 aa, Homo sapiens
MAGAEDWPGQQLELDEDEASCCRWGAQHAGARELAALYSPGKRLQEWCSVILCFSLIAHNLVHLLLLARWEDTPLVILGVVAGALNADLLVVAWYTGVLTHGALWQLPIVAERLIIRLLPGSYQIDPDQAIITGSEVHTETKGDNCLVIDCCRCYNMGYKLPHPQPVNALEQLYPWECFVFCLIIFGTFTKQIHKWSHTYLGCTAGVTLLQELALSFLPRKQHRIHHVSPQETYFLHHHRLAQVPSGEDRLLGRLGDLI

SEQ ID NO: 1019550 - protein, 202 aa, Homo sapiens
GPALPRRRGRQCPAPLISAVSLIPASALLSLFLFPEYRAQSLRPEGRPARSLARPPPETPPPRPGAGAPAAAAAAFRPLRPGPGPPGHAASAPRAPAAQPEEMMLRNGTFLTLLLFFLCAFLSLSWYAALRVVEFTGEFADSVQRESSALSPGAGEIRGPCQNARARDEHSHGRSQRTPMERGTLTAVLHCPRLHHCDTAGK

SEQ ID NO: 1019551 - protein, 137 aa, Homo sapiens
GPALPRRRGRQCPAPLISAVSLIPASALLSLFLFPEYRAQSLRPEGRPARSLARPPPETPPPRPGAGAPAAAAAAFRPLRPGPGPPGHAASAPRAPAAQPEEMMLRNGTFLTLLLFFLCAFLSLSWYAGGKGVVYYH

SEQ ID NO: 1019552 - protein, 178 aa, Homo sapiens
RREGLGDVRATERKAQRPGRRPCRRRQFIFIESPELNVALHVFSKLHRWLWGTRAQLTLLPARSPAPSSRLNRAAESAGKGSRQPGVGGARRGRAGSGGGAHLRRSRPRGRSCAGCRRCLSPASCGRASPARAPAGTCGAATGAGARARGSPPRRGASPGGPWPRPPAAPGRGSPAAA

SEQ ID NO: 1019553 - protein, 97 aa, Homo sapiens
ACIMRVYASGSGLYFIIAVMQQQAVTWTHTSPWSHNAYCYSRRIMAVYEETSMGSNRVCQALASEGHLLVRLRSSPLNLPPKPIPLLGTWQAMRIGP

SEQ ID NO: 1019554 - protein, 79 aa, Homo sapiens
EPTSSELERHYIHKPILRTHVGQHLGMTSHRKMGMYGLLSGHSEDRVWRQLTDHVDLASERTLEKTLGSTCICQAQTAE

SEQ ID NO: 1019555 - protein, 46 aa, Homo sapiens
MAPPSTREPRVLSATSATKSDGEVLPFPDADFEFALGSAIKATGGL

SEQ ID NO: 1019556 - protein, 245 aa, Homo sapiens
MGEETRDQDLHRSRSPNCKLTVYLGKRDFVDHLDKVDPVDGVVLVDPDYLKDRKVFVTLTCAFRYGREDLDVLGLSFRKRPVQSPPYPEPSRPGATGGGWGSWASMGTPSPYRIFHGVTLQPGPEDTGKGCGVDFEIAFCAKSLEEKRRKGTLCGVVIRKVQFAPEKPGPQPSAETTFLRSLHLDKELYYHGEPLNVNVHVTNNSTKTVKKIKVSVRQYADICLFSTAQYKCPVAQLEDDQVSPS

SEQ ID NO: 1019557 - protein, 46 aa, Homo sapiens
PEPGKTAIQDSDAGALLATCKDQHLLRGPLGLPWGAGCLGTVQDTH

SEQ ID NO: 1019558 - protein, 118 aa, Homo sapiens
MDGWMDGWVGEPINEWINEGSVFKVKETWKLDSNPQAPHGIVPGIVLPKFPLLAINSQNLVSVPTEKRPGIVALFGGKKGVPNSQGLFVDIYLGLKKKKNSPQSQMIVQSHGTPCPVP

SEQ ID NO: 1019559 - protein, 161 aa, Homo sapiens
LGTFDLTGIPPAPLWVPQIVTFEIDVNGILRVTAEDGGFTPGGQEEIRMVNDAEKFAEEDKKLKGRIDTRNLDGYAFSLKIQIGDKEKLGGNFSSEDKETMEKAVEEKIEWLESHQDADIEDFKAKKKELEEIVQPIISKLYGSAGPPPTGEEDTAEKDEL

SEQ ID NO: 1019560 - protein, 161 aa, Homo sapiens; identical to SEQ ID NO: 1019559

SEQ ID NO: 1019561 - protein, 161 aa, Homo sapiens; identical to SEQ ID NO: 1019559

SEQ ID NO: 1019562 - protein, 161 aa, Homo sapiens; identical to SEQ ID NO: 1019559

SEQ ID NO: 1019563 - protein, 128 aa, Homo sapiens
EFGTRCLGKGGLLASLVLISMVTLYPSVPGRSGGYSKVCVSQVAAPLGNDGGAWLWTVLRSFHDALMFVVLFQSSWSHNRLGSYLMTAFYRWVYLRLREEEGLPRQVCGRAGIQGQALTLSGIWVLLL

SEQ ID NO: 1019564 - protein, 279 aa, Homo sapiens
QAVRPEYWMVAQSKGKFRPGPAQLAGSQVAGKGLAGAEHRHAEPWGRGLGCVVLGPAAEGGAGRQHAKPGALGRGAPGELRGRSASAPPNPRTCPTPPRRRPPPLQKRPGALPRRLGAGARRPRRLLRLERASPDRLSAAEPRGGCDGADDHAGRAVQSPPDTGRRLPWSTGYAEVINAGKSREQGGTRLAVTVGVCGRSEECSEELLGSLAEDGRILVYSYGGLICWDMQVSRSMLKIGHHGILAFDYIREQLKDLVEITFRNPSATIPFDSQHFGTK

SEQ ID NO: 1019565 - protein, 338 aa, Homo sapiens
QAVRPEYWMVAQSKGKFRPGPAQLAGSQVAGKGLAGAEHRHAEPWGRGLGCVVLGPAAEGGAGRQHAKPGALGRGAPGELRGRSASAPPNPRTCPTPPRRRPPPLQKRPGALPRRLGAGARRPRRLLRLERASPDRLSAAEPRGGCDAPMTTRAGLCKAPRTRAAACPGAPGYAETLFCPRARRRSPAKDELASSPSRPGSLKAKGKGVSRRSGVLFNRGHSGWEDSLTRFPAPAPQFPVPLTEFPSPSTPRNSPRHQEAASFPRSGEGDARGRGGSHLDALQPANSCWPGKEADPLPGAAGWPPGCVYFKCICRERRAPREMGALSSLRKVAGGPWT

SEQ ID NO: 1019566 - protein, 157 aa, Homo sapiens
MLVKENVEVDLSVLLCVGSVMWVGGGSGMWRVRLFVVLLLACCVLSLVVGARVPLWVGCAARAGVRVSSPAAPWAAWSRARVVCGAGYVRSVCGWVGGGGVVVKMGGGGGGGGGGAVVWGGVGCALLFAGGGSVVVRCSGGVRFCGVVFLLERGWVG

SEQ ID NO: 1019567 - protein, 130 aa, Homo sapiens
MAQGEKQSVPISPGTGTGKLLENSCRKTCGPFRLTVMLKITHGVREQFLPFCTKRQKFSIPQFEGNTAEGPWQSGFCFPWQVGGEQGKDLPQLFPNPAQSPLEWQGNLVTCSSPSVWQATDAVKGTSLQK

SEQ ID NO: 1019568 - protein, 314 aa, Homo sapiens
MGSLEDYTRDHGMSISFSYWVSEAVVVYKWITTKLGLDLSHPSLAWYHFLSISQKAMSRPLLITFTPSAADPSDLWKDVAVSMTTDPEKPKSTLDGAAARAFYEALIGESEQRILTPKKISGLNLPDEKKREKKTKKNEGTSSMKRDEQEERHQRKTMVQGEIPLRLKDKDRLNRDTGEAAQRGRTCTELKETAENRIERREELGGNMIARACLLVDPHLNVCCIERVQGDSIVSYLLEPWRLPGVGVCELSRDAAQLAEEAGFPEVARMVREHGETKSPEGLYSLPPVRELHFQIPPPTSLLTAVYRGSQLQP

SEQ ID NO: 1019569 - protein, 266 aa, Homo sapiens
MEKWNHTSNDFILLGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMAYDRYLAICHSLYYPIRMSKMMCVKMIGGSWTLGSINSLAHTVFALHIPYCRSRAIDHFFCDVPAMLLLPVQILGSMIYGFVTALSPFPFHASLPVGRVLFAVYHMHSEGREPSPPFHTFTVVIFYALLSTLSPISAHQLTDLAVSTPS

SEQ ID NO: 1019570 - protein, 38 aa, Homo sapiens
MADLDKLNIDSIIQRLLEVRGSKPGKNVQLQENEIRGL

SEQ ID NO: 1019571 - protein, 38 aa, Homo sapiens; identical to SEQ ID NO: 1019570

SEQ ID NO: 1019572 - protein, 304 aa, Homo sapiens
EEQIHLQVAVPSHGFALLALVGLVGVASDPAASRREHPELLHHFSTQEKTPQICVVGSGPAGFYKAQHLLKNPQAHVDIYEKKPVPFGLVRFGVAPDHPEVKNVINKFTPERAQFRPVCASLGATVECGQGTVTVPELRGGLTKPVVLTLRGQRTIRALEIPGERAATVCAPARAFGGWYNGLPENQELEPDLSCDTAVILGQENVALDVARILLTPPEHLERTDITEGSPGCTEAESSEDSVAQMGRRGPLQVAFTIKELREMIHVTGSPANYGSVDSLSTPGPDSEVPVQEAPADCRSKATT

SEQ ID NO: 1019573 - protein, 157 aa, Homo sapiens
PGLGPVRPPGWRAGRRTRRTAGPGRLSFGKTLAVPPLVSVDPAVAFSRAADLCPPVAPAVLEQKGPPSSRTEPRAPSPMEQASAGVPRLRPGRRALWHLFPPPRVPVRPGRDWLGNRGREEVAVQQGIGAALPWFLARPQVRPENTSMALPLCPTTR

SEQ ID NO: 1019574 - protein, 236 aa, Homo sapiens
RPGKPRQPRAQPIQRPGLHQSHGRQKSTDRTGLTQKRTSFNYAMKEAAAAALKKKGWEVVESDLYAMNFNPIISRKDITGKLKDPANFQYPAESVLAYKEGHLSPDIVAELGVPAILKGWFERVFIGEFAYTYAAMYDKGPFRSKKAVLSITTGGSGSMYSLQGIHRDMNVILWPIQSGILHFWGFQVLEPSLTYSIGTLQQTPELNPVRMGETPDDICMRHHDFAPRALCLNFSK

SEQ ID NO: 1019575 - protein, 329 aa, Homo sapiens
VRTASDLTWPQLKGLGRRRRVRVWRGASWKRARVARPSPPPFPLSESGFCGATGEPSGVPEPRSPGRGPWWGLSATSRGRGRSWPRVVPPCGSVIGWKRSRTPRGARSLGDPVLRTPDICSSRVPALVAYGPLLRGHGENAASTGGASDSGKNGEVNSGPPGSWAQWQDKGGPSASAGKAEELRGKEAEEETEREGSGGEEAQGEVPSAGGEEPAEEDSEDWCVPCSDEEVELPADGQPWMPPPSEIQRLYELLAAHGTLELQAEILPRLASHAGGQSEEERSDEEPEAKKRKRKNTHATEFDFDDEQCHKGLLIDRRAPRNSAGAEEA

SEQ ID NO: 1019576 - protein, 215 aa, Homo sapiens
QSTYYGSFVTRLLDSQLSDHAIEESVLIYDPITAQGCSLKADRLTPLMEVCKEKDFSPEALKANITFEMFEGVPIVIKHHLINVLMWELEKSAVADKHEWLSLSNHLGKNQWLMRVDEMSQDIVKYETDMRTSKRQQQKHQYQQRRQQEDMQRQSRGEPPLPEEDLSKLFKPRQPPARMDSLLMAGQITDCQNIKEFTAQNLKLFMAQALQENNN

SEQ ID NO: 1019577 - protein, 107 aa, Homo sapiens
MSPTTLDTRPLRVFLPARQQQQRQKQQEQKQQQNSSKFRPGTNPSTSFEPIKADPTGVLELPKELSEIFDPTRECMSSELLEELMSSEVVAPLLRLSPPPGEHPPLS

SEQ ID NO: 1019578 - protein, 116 aa, Homo sapiens
PLLGPLLRPLEKRSIRVGITQFSRCRLSPLSLTRKGNSLTRCASRVRQCLALLQLKLGALHPLSCTHFPTLPSEMNPVPQLEMQKSHVFCVAHAESCRLELFLFGHLGSTCRDILH

SEQ ID NO: 1019579 - protein, 291 aa, Homo sapiens
FPAPAAPEDCALRPFPRAPRAHRIVAGPPAVAIGAPLGEALKNRAPPRRRSLALYYSTPGHALACTPGPVSPPPEPPPLESAEPLGPAADLWADVDLTEFDQYLILQPDSARRPRAPVPRGTGQTGPARHVLPRGEQPDLRAVGRQQRGLLQRVHLRLVPPAPPRVPAALPSRSPRDRSDRDAAALLSNIRVYVWFHVTARLGASDARPGARSTSQATLPGLLGHLPSGGPCEGAWSSHVSRGFSRKPEPRTCWQSCQGNIFEAPAPFLAVYFLQPDCINIFYFVFLKKYT

SEQ ID NO: 1019580 - protein, 385 aa, Homo sapiens
GLEPFVWAGKKKPSDPSFSCFSSFFLSGFSSLQPAATMPRKKAAAAAWEEPSSGNGTARAGPRKRGGPAGRKRERPERCSSSSGGGSSGDEDGLELDGAPGGGRAAAALAVLTAGKAGGAAVVITEPEHTKVSASNLKGQQCKGQLLIHGATNWDLHWSKQKCLNSKLLTAISVRIVGAPQIMGAWQGVRVRTVVSGSLCCTQPPHQHGTRTLWQLGVDMRSASCDMVPPSRVKHPTHRRPTPTRERSPQCAATTLAPATETAPRRTRRTQTWPPSLRTDRSRTTPRNERQASDPNARPNPQTGCCNNPTWTPHMRWDTRRTQPPGSAADTRHVLSKPDTHHRYRGHRAKCAHTTPRHTLLITTSSIQAHTMTTKPPATYRNSTT

SEQ ID NO: 1019581 - protein, 117 aa, Homo sapiens
MKSDGSVLLPPLGILRWFCTNIGAMHNASSLEVVELGSLPGESFSKSVRILQKPATADGMEWKVACAMAKLGMDVDWQVQYTHVCMAQMHYTDMVRKRCFCLLVPKSLPRTGFLQMF

SEQ ID NO: 1019582 - protein, 209 aa, Homo sapiens
MATQADLMELDMAMEPDRKAAVSHWQQQSYLDSGIHSGATTTAPSLSGKGNPEEEDVDTSQVLYEWEQGFSQSFTQEQVADIDGQYAMTRAQRDELLCSLQTLDEGMQIPSTQCDAAHPTNVQRMAEPSQMLKHCSCKLDSLIKMMQKLPQVQSLNWPKLLNDEDTVVGQYRAQTMAPSPLQKREAPTPGNNARTPQQGHCHEVPCGIH

SEQ ID NO: 1019583 - protein, 253 aa, Homo sapiens
GRVAQVVRTVINADFPFPLGWLGGYLAVLAGAGLTFALQSSSVFTAAVVPLMGVGVISLDRAYPLLLGSNIGTTTTALLAALASPADRMLSALQPVCGLLPGGPTGSAPETPGHAAPPLTGRDKCGTPWNPPSFFLPLPCLYPLRPSQCRVLLHPLQEALQTAPVCGLLQVRQPLEGPVTLFSPPVALCLLPAGPGLCRLSTLGTEETGSLGRRHRQSQVGRCFPRRSPLRAAVMQSVLGGAGLDCSSQERAG

SEQ ID NO: 1019584 - protein, 102 aa, Homo sapiens
MACGATLKRPMEFEAALLSPGSPKRRRCAPLPGPTPGLRPPDAEPPPPFQTQTPPQSLQQPAPPGSERRLPTPEQNFQNIKTKNIARYHEVETLYEVVLNHE

SEQ ID NO: 1019585 - protein, 122 aa, Homo sapiens
GVHFKASVQQQGLESRFCGAPRPAPRTPLKQQEGVFHPVFCNILYKTVLCPWGRAGFGKEKTNETPFFFFRPTTLESFLPPYPFPPFGFYFKVRGLPGSWMPDKYYIKLGCYLKWNKAVCPG

SEQ ID NO: 1019586 - protein, 177 aa, Homo sapiens
MTTRSGVPLVDRNPFYVEVIVMWPLLSKQWVSLWRVYVSGGVSRGRLFLRHYWCPSRCRSLTRVLVESYRKIKEAGQNFEIIFGSADRSEESFKQYFSEMAWLAVPYTDEARRSRLKPGVRKSKGFPTLMLDPQRGDHVGGGWWKGGWGGCALAPQARAGALRLQRRAKRGPLPRPF

SEQ ID NO: 1019587 - protein, 132 aa, Homo sapiens
HEAAEEPRVLCIIQDTTNSKTVNERITLNLPASTPVRKLFEDVANKVGYINGTFDLVWGNGINTADMAPLDHTSDKSLLDANFEPGKKNFLHLTDKDGEQPQILLVSYLESPIFIIFVHCHLLLEDAVSQRK

SEQ ID NO: 1019588 - protein, 106 aa, Homo sapiens
ALEILTGGNELQAFASIILDQFRYDPHDVPRHEVPGSEIRERLTPRKPVGDLAGDLRLMLPPGRWKFDGSCSEDRPCPAATWKTGKITLVLPGVTELGGIGPGDVV

SEQ ID NO: 1019589 - protein, 259 aa, Homo sapiens
QAVGAEGGAAGRGPMGPGGRARRRRGARLDSGVRGCEGARRALRPAREWASPGLAGLSRKKGGARAKACRAGGPGVEVEVGAEEGAEPRRKGSGEGGGGWAAWGERSGAPVRSSAVAPEKGCSGGERAGPDKRRRVGTEAPGGPPMEPGVWAPKKDPRAASNGETRRGNEELLLGRNQAVKKGETKNGKSDYPYDQNGQSTGSNGGMQFGAIPATRLLEGRKEDSRMPLKGLVAHCLLRAMIHELDTKTSWMRANITYH

SEQ ID NO: 1019590 - protein, 335 aa, Homo sapiens
SEDVRSDFQRRVPYNYLQRAYIKLNQLEKAVEAAHTFFVANPEHMEMQTEQLQYITGAHTLRCLNALQLGRQQKPSHTLAAAYKCSELNIMRLMTLRLAITALRTSLNENTFVEDTECRTLLCRRPQQTLKNYEYFTGTNGWICTEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELLHISCRRVWGFSSDWNRIASDQICGRDGMGTRVPFMTCTAWIGARRSVDFPLGTTWSLPSKLEPIEEWPPRYQKHLDGH

SEQ ID NO: 1019591 - protein, 319 aa, Homo sapiens
RLPGAELFRFSPSQWRVGWGGRSPKPLGDMEPRRAAARGAWLGVSGGRWGRHLAAELVYHLAGALGTELQDLARRFGPGGWRPGAGCLLVVRALELLEQAAVGPAPDSLQVSAQPAEQELRRLREENERLRRELRAGPQEERALLRQLKEVTDRQRDELRAHNRDLRQAAWRPEALQEQLQRLLLVNAELRHKLAAMQTQLRAARDPREGAPQPWRKPTPQAKERARGQAGRPGHQHGQEPEWRPAGAGAPGNPEDPAEARGSGRPSEAGQCRFSREEFEQILQERNELKAKVFLLKELAYFQRECSQTPGPRPSAGMK

SEQ ID NO: 1019592 - protein, 132 aa, Homo sapiens
GGHKLSKAGRGTQASRTRARKEPPEGTLSLCVNMTSKLAVALLAAFLISAALCEGAVLPRSAKELRCQCIKTYSKPFHPKFIKELRVIESGPHCANTEIIVKLSDGRELCLDPKENWLQRVVEKFLKRAENS

SEQ ID NO: 1019593 - protein, 159 aa, Homo sapiens
MKLITILFLCSRLLLSLTQESQSEEIDCNDKDLFKAVDAALKKYNSPKVNNQFVLYRITEATKTVGSDTFYSFKYEIKEGDCPVQSGCTATVGKRSSTKFSVATQTCQITPAEGPVVTAQYDCLGCVHAISTQSPDLEPILRHGIQYFNSTTLHFFLFT

SEQ ID NO: 1019594 - protein, 111 aa, Homo sapiens
MTPPRNSVNGTFPAEPMKGPIAMQSGPKPLFRRMSSLVGPTQSFFMRESKTLGAVQIMNGLFHIALGGLLLIPAGIYAPICVTVWPPLWGGIMYIISGSLLAATEKNSRKC

SEQ ID NO: 1019595 - protein, 111 aa, Homo sapiens; identical to SEQ ID NO: 1019594

SEQ ID NO: 1019596 - protein, 93 aa, Homo sapiens
RTRELQSMADQEKISAALKKTLLDRVLSPTVSTLTKPGKPLTRLALGGKKDKICPLDSDPLETPPKHPALLPPFPACKEKACLGFQVLVIKPP

SEQ ID NO: 1019597 - protein, 275 aa, Homo sapiens
HPASICRRAAATLPESTGHRSTITCPEFGPPPCRRPAQRASAPVCCVRACEMCSSVPRYARALAGTAPADCPGRRDSRRSVAVRALLRREARALPAGVRLVLGGHPVRRLRLLPDVTPCLWCRRVTGGDCTLRRGDSVAARCREEQQTLCTPSPAAKSACCAGRLTASAPHAAEAGSPESPESTEITEEELLDNFHVMAPSEEDHSILWDASTYGSKALHVTNIKKWKEPCRIELYVVESLAKAQETSGEEISFYLPNCNKNGFYSRQCETSMDG

SEQ ID NO: 1019598 - protein, 261 aa, Homo sapiens
AAFGPCPLNRPLVSPVTAAPVNPERVFLSLAAFPHCFAPKGPGPGGGAPPPGFEGREGPPLFPKGFSPPGPQDTVWAANLRPKSGGGSGGKKMKNEIAAVVFFFTRVRKHDKLKKEAVERFAEKLTLILQEKYKNHWYPEKPSKGGGASEDGKEFQRVDARDVAENRCVGGSLGAKGRLLGDAMEVCGREGEKNKGAENDENKDERKVTRAEKTSDYHSGSSSSDEETSKEMEVKPSSVAAASPVYQISELIFPPLPMWHP

SEQ ID NO: 1019599 - protein, 220 aa, Homo sapiens
RRRGSRTRRTRLAALPVAQRGPVEAEPQFPARTRSGPPNLRPKSGGGSGGKKMKNEIAAVVFFFTRVRKHDKLKKEAVERFAEKLTLILQEKYKNHWYPEKPSKGGASEDGKEFQRVDARDVAENRCVGGSLGAKGRLLGDAMEVCGREGEKNKGAENDENKDERKVTRAEKTSDYHSGSSSSDEETSKEMEVKPSSVAAASPVYQISELIFPPLPMWHP

SEQ ID NO: 1019600 - protein, 296 aa, Homo sapiens
MDQLHDAMRCGECKEDNASDQINPTGIDGVSGVKEHQQGCYHYRRKRRTCGETATKYHRHNLRKLQIPSKKRTRNKPKPIPKESDVKTFNYTAHLWDILVAKTSCEENKVIDQNRSYDQESVERALTCANCGQKLHVLEVHVCEHCCAELMSDPNSSMHEEEDDGKPARRRCKNDECREWYHPAFANQWWCSPECGTKIALERRSKEREKAEKAAEKKRRREEQKQKDKLKIRKLALKPRSYWIKQAQQAVNAFIRERDRDLPCISCGTLTSAQWDAGHYRTTAAAPQLRFNERNI

SEQ ID NO: 1019601 - protein, 302 aa, Homo sapiens
MLRSISDFSALKELLSGPNRLKIRIDDYAWSRGTVMYRRSSVKNSVPLRTQAVNCVPLEDFGGHHPDPNLTYAADLVETMKSGEHDFGAAFDGDGDRNMILAKHGFFVNPSDSVAVIAANHLQPSRISSRLGSAGFARSMPTSGALDRVASATKIALYETPTGWKFFGNLMDASKLSLCGEESFGTGSDHIREKDGLWAVLAWLSILATRKQSVEDILKGQNGRDFFHSRGVGGGRKQMMGLVGFDSFVGKYANKFHWEKALYSDPWDGNHFNKSGVLHFHWFSNRLPTERHGSAGATFGCT

SEQ ID NO: 1019602 - protein, 174 aa, Homo sapiens
DKEFFGLRDYYSLIKMVFAAAKASNRKPSPQDIAQAVLRNFSGKDDIQALDIFLANLPEAKCSEEVSPMQLIKQNIFGPSQKVPGGEQEDAESRYLLVLTKNYVALQILQQTFFEGDQQPEIIFGFGFPKDQEYTQLCRNINRVKICMETGKMVLLLNLQNLYESLYDALNQYY

SEQ ID NO: 1019603 - protein, 241 aa, Homo sapiens
QPLESPGPAAMAVEGEIKYVKILLYVLQLAFACVLIAVGVGVRLVLSQTIIQGTTPGLLPVVIIAVGVFLFLVAFVRCCGACKEHYFLMVTFAFFLSLFMLVEVAAAIAGYVFRDEVISEFYYHFRQMENPHNHTASILHGMQEFFSAVGLLTTQIGRKSPSMSKNRVPDSCCINVTVGCGINFNEKAIHKEGCVEKIGGWLRKNVLVVAAAALGNAFVEVLGIVFACCLVKSFKNGYEVK

SEQ ID NO: 1019604 - protein, 74 aa, Homo sapiens
YLVPTFGEDRMNVLDLGKKTSWVCKVLTLEIVDHDAVELQVLCAVSALPQYTLTPSSAPPGLMLPAVVLQDNTS

SEQ ID NO: 1019605 - protein, 222 aa, Homo sapiens
MAVAVFFEWSMEGPCGIQLQKQFVLNEPLEAGMMVTDEPGYYEDGAFGIRYLRMLPLWFHVKYQAIMFNNRGKPDLLNLLTLVPIQTKMIDVDSLTDKDVATGSNNYTAMSLQGDDDVREGIAENRADQESSRARLISRRRNPSSTQHVINTLPGFVFVKCSGGRKKPGRSLTSFPSPLPCLSRTSRFYTFIDVVKQEQKIFLSSLIVLVAKALSVLVIFVN

SEQ ID NO: 1019606 - protein, 138 aa, Homo sapiens
HTHPHPPPLKARHEALAPPPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPL

SEQ ID NO: 1019607 - protein, 307 aa, Homo sapiens
SASRQWSHLEGLAASGRSHRPRPTMAEELVLERCDLELETNGRDHHTADLCREKLVVRRGQPFWLTLHFEGRNYEASDSLTTGPAPQEAGTKARFLEEGTVVDQQDTLLQLTTPANPGISTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGCAAGDPGDNNYGGRRYPMSWIGSVDILRRWKNHGCQRVKYGQCWVFAAVAASAEVPGHPYPRRDYNCGHDQNSN

SEQ ID NO: 1019608 - protein, 265 aa, Homo sapiens
MAEELVLERCDLELETNGRDHHTADLCREKLVVRRGQPFWLTLHFEGRPTEEQKTVEIPDPVEAGEEVKGEWTCCRSTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGPGGCSGMVNCNDDQGCAAGDPGDNNYGGRRYPMSWIGSVDILRRWKNHGCQRVKYGQCWVFAAVAAQAEVPGHPYPRRDYNCGHDQNSN

SEQ ID NO: 1019609 - protein, 145 aa, Homo sapiens
LLPPTSSTLPLPSGCAGAWGGEGRLVSPSSLIINNYQELALWDIRAPRPRERCRPASHASPEPTVLPSVPPSPSGALLGARSIPCSCFTLSFSPRRDSLATSSTAVQLPQSGTHCYTQPHEPLQTSQVSSRALPDPAHIPSAGLC

SEQ ID NO: 1019610 - protein, 306 aa, Homo sapiens
MASWCLFRVCATVLSRARSRGRPGQSSPPWDGEGVEAAPRCPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPVTGATSDCLGRRPVMLLCLMGVATSYAVLGHLSELCGLPGLQADWGASAKGTSDLSKAIVADLGSPLARSQGMAVIGVAFSLGFTLGPYARSLPDPWNMAALVMPLLFAASDLLFIFCFLAETLALEKLEASIALGYRDAADLLSPLEEFSAVARGPAPPSGPLPPCAAWGS

SEQ ID NO: 1019611 - protein, 129 aa, Homo sapiens
TSLWAVLSVGFLGVESVHHKGHSLSREGARPPPFRNCCGNKVLTCPQAVYGRPWAQCGMYRALGRGQCWRQSPACGGTLRRGVWRSGRGWEGLASGRGAGCCGHQYGCLFRKRENMVKAARGLSVGTMW

SEQ ID NO: 1019612 - protein, 182 aa, Homo sapiens
SLPDRSSCGGPRPQPTAMGWDLTVKMLAGNKSQVSLSSSMSVSKLKAQITQKIGGHAFQQRLAVPPNGVALQDRVPPSNQGLGPGSTVLLVVDKFDEPFNILVRNNKGPNSPYEVRLTQTVAPLKQQMNGLEGVQDHLFWLTFEGKPLEDQLPLGEYGPKPLSPVFINLGLRGGGPKPGGGS

SEQ ID NO: 1019613 - protein, 314 aa, Homo sapiens
ALEIANAHRKPLVIIAEDVDGEALSTLVLNRLKVGLQVVAVKAPGFGDNRKNQLKDMAIATGGAVFGEEGLNLNLEDVQAHDLGKVGEVIVTKDDAMLLKGKGDKAHIEKRIQEITEQLDITTSEYEKEKLNERLAKLSDGVAVLKVGGTSDVEVNEKKDRVTDALNATRAAVEEGIVLGGGCALLRCIPALDSLKPANEDQKIGIEIIKRALKIPAMTIAKNAGVEGSLIVEKILQSSSEVGYDAMLGDFVNMVEKGIIDPTKVVRTALLDAAGVASLLTTAEAVVTEIPKEEKDPGMGAMGGMGGGMGGGMF

SEQ ID NO: 1019614 - protein, 314 aa, Homo sapiens; identical to SEQ ID NO: 1019613

SEQ ID NO: 1019615 - protein, 171 aa, Homo sapiens
MWTVQNRESLGLLSFPVMITMVCCAHSTNEPSNMSYVKETVDRLLKGYDIRLRPDFGGPPVDVGMRIDVASIDMVSEVNMVSGLPRGPAVRLTQMGNGQVPLPSAFHWRSPRPWPLRSHSAPAPRSGTHTRSPLVCNFDTHGLLRCSRETCSALFWEGRVTVAPWICWGGV

SEQ ID NO: 1019616 - protein, 115 aa, Homo sapiens
HNHIHPLVIFHFQKSIIHFSRFVQQSIIKGFFSTLIKKFLHLQKSAYAIKYSQDHKIQMSLGLLNLEIHSLEYTGKRKKFALVKGVYHFLEELLKASNICECAKSRYKGILYNLC

SEQ ID NO: 1019617 - protein, 282 aa, Homo sapiens
LSPFLTPFNQSPLLLLSASPAPDPFPQYPLPASLINPSVAAHHDPIRIQLKDSSKFPSVPQYPISLTHQKGLQPIVNKLCSCSLLRPTHSPYNTPILPVKKSDGSYRLVHNLQAISQAVLPIHPIVHNPYPLLSLVATNTTLYTAIDLKDAFFTISLHPDSQNLFAFTWTDPDTLQSQQLTWTVLPQGFRDSPHFFGQALARNLTSLNLSPSHLQNVDDLLLCSPSLKDSQTHTGTALLNFLAIKGYRGFPFKGQLFIFMMTYLGINFSLGRYDSAALIENY

SEQ ID NO: 1019618 - protein, 285 aa, Homo sapiens
VCSRQPRRQLARPPLGPARSFSPLATMSESFDCAKCNESLYGRKFIQTDSGPYCVPCYDNTFANTCAECQQLIGHDSWELFYEDRHFHEGCFRCCRCQCSLADEPFTCQDSELPCNDCYCMRFPRSAPLVGRLSCLGPGSWNKEAKHGMSTASCAVAVNSHWCSRSFVPDKGAHYCVPCYENKFAPRCARCSKTLTQGWSDIPVISHGIENVLVCYRMPERPWAGQQFHLPGMKIPTVWPVFGFACCNAPIVRGGSKVSFEKRWPKCFSCARCSNSLVGPGFVTG

SEQ ID NO: 1019619 - protein, 190 aa, Homo sapiens
GAGGGAPQGSAVFRAAGAAMAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFLCRFTVVVATQLPESTSLRLADVLWNSQIPLLICRTYGLVGYTEDHYIKNIQ

SEQ ID NO: 1019620 - protein, 190 aa, Homo sapiens; identical to SEQ ID NO: 1019619

SEQ ID NO: 1019621 - protein, 106 aa, Homo sapiens
MMRLKKQRMKTQKAKKGVNKTCTHTMDFICHEHLYVLIRHEHVHFILKSVPLVRLTVFCTLLRLYFHCLYINTRFCTAQRERSEGNVICAILTVHYKLLKLIFGNE

SEQ ID NO: 1019622 - protein, 258 aa, Homo sapiens
SGVDLLCGRLAGLDSGSAFYSAFLVSSAPSRGTLLCGCLKKKRNFIVPQPHLRLERGVLSDALQAEREGRRRRVEVAGPSPPSALAGGEGGTMSGSLQAGSGSAGTSPGSSAASSCDFRLLVFILFPVAAFRGGFGGSAGLRRGGPGRRLWAASGALVRCCAGGCPPYRVAAWVLVVHLACPGDTDARARPSAGVRRQQLQPKQQDRGSDSPRPPSATGSSTPYEDQQATTTYCPICYDMIDRSIHDNCGTAFATQVY

SEQ ID NO: 1019623 - protein, 224 aa, Homo sapiens
AATAATPPRILPGLRRPAPHPRPRAPAPLSSRPRPSARQAPLPATRQAPRRPARRPGPARAPQPPAARAAMGVEGCTKCIKYLLFVFNFVFWLAGGVIGVALWLRHDPQTTNLLYLELGEKAKNFYVGIYIIAVGAVMMFVGFLGCYGAIQESQFLLGTFFTCLVILFACEVAAGIWGFVNKDQIAKDVKQFYDQALQQAVVDDDANNAKAVVKTFHETLDCCG

SEQ ID NO: 1019624 - protein, 62 aa, Homo sapiens
MTKSVDPSLAWIPLKYVNVVCDNTSASEEEKSGTAKKCKAQLQELTYSKNRSNLFGWLVSSP

SEQ ID NO: 1019625 - protein, 304 aa, Homo sapiens
EKQRSSAFVKKKTPESFSGPAFSKLVFVAMEELIVELRLFLELLDHEYLTSTVREKKAVITNILLRIQSSKGFDVKDHAQKQETANSLPAPPQMPLPEIPQPWLPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWPEGDQRSLQWMKWPRGSRVSSSSKLTGAQGQQLEE

SEQ ID NO: 1019626 - protein, 261 aa, Homo sapiens
MPDLERGYTGADGGARRAPAPGAPFVNVLAACSVGLFTLLHPCRRDGACVRGASAARWRPEPPDSGPPPLPTSSLPEGYYEEAVPLSPGKAPEYITSNYDSDAMSSSYESYDEEEEDGKGKKTRHQWPSEEASMDLVKDAKICAFLLRKKRFGQWTKLLCVIKDTKLLCYKSSKDQQPQMELPLQGCNITYIPKDSKKKKHELKITQQGTDPLVLAVQSKEQAEQWPEGDQRSLQWMKWPRGSRVSSSSKLTGAQGQQLEE

SEQ ID NO: 1019627 - protein, 171 aa, Homo sapiens
MLEPQDCELCQYLCAVMGLDRIEERLPILNQPSTQIVANAKGAVTGAKDAVTTTVTGAKDSVASTITGVMDKTKGAVTGSVEKTKSVKKKQKKLKAQLHSTHLIEFARKNVYSANQKIQDADKLYLLMGRVEKDIGYDDTDESTCAEHIESRTFAIGPQPDQLQTRAPSCP

SEQ ID NO: 1019628 - protein, 116 aa, Homo sapiens
IFQTGTCSQADTHSKTHTHSRAAHMYIHTHTLTFPDSHTPAHAHKLPHTHKLPHTHTHTHRLMSTLSPTHGHTRKLSHSHNLSRAHTLNNHTKTPLPLWPVNLTSSERVGCRGSST

SEQ ID NO: 1019629 - protein, 242 aa, Homo sapiens
RLCLCLWRVVRVSAAAEEEARAAPSGGEQAAVGRAVAASRARRAAAQEARGWRSASRRRRRQRPSSWRRARLRLRGGPRAPPPHPGRPRRRVNWAGLQRTGSLVQAAGLEPDFWQPGPWARAPLAAKSRSTGPFGLGSTRHSASADVASSPDEVASARGSMELLEHCGVCRERLRPEREPRLLPCLHSACSACLGNSSGDTYPQQCFSKDIVENYMRDSGSKAAPTPRMRTSAALAVIMPQP

SEQ ID NO: 1019630 - protein, 110 aa, Homo sapiens
WPGAGGGRDTALSAPGGCGPGRGGAGRHPPGGRPAFLPTFAWEAPGPPGFVLFINVLLSKLPEERGLCVRQPGPQRRPQHTVGAQHGLLMGLRTSPDPWELPGASSTQNP

SEQ ID NO: 1019631 - protein, 128 aa, Homo sapiens
DFLGRQEPGIRNRSLQRLTRTYERVGYGGVRSQLQYPRGRGRRTIRGYEPESISVNTAKFCSHQNIKTSWMRRREFATLVIRGVRGTRAIRIREVEVRTESQPRNRISVRVIERDIAPTYTLRRGVWH

SEQ ID NO: 1019632 - protein, 154 aa, Homo sapiens
GQVTCAPAPPRYEKPPSVRARFNRGFSGQFSRGVSEIRHTADRWGVSLDVNHFAPDELTVKTKDGVVEITGKHEERQDEHGYISRCFTGKYTLPPGVDPTQVSSSLSPEGTLTVEAPMPKVATQSKEIPIPVTFELGAQFGGPKVAKSDETAAK

SEQ ID NO: 1019633 - protein, 69 aa, Homo sapiens
WFLGGPSWDPFRDWYPKSRLLDQALGLPRLPEEWSQWLGGSSWPGKVGPLPPAAIESPAVAAPAPWVFF

SEQ ID NO: 1019634 - protein, 200 aa, Homo sapiens
PLPVLRVSVSFPLLRAFFARSAAGLSPDLGFPLLAVRCYGHVARGFPLAQSEQPGAFRGPPPARGPKKTYWASTISKERGSGPTPFHSDHPRLRARARTRAPVLRRSTSRKLELEYSLPGILAATNVAPQLILSSKLPHCLEVCRQNCQMNNLPHLHVLGLTWVIYIGIFWLYHHKILSLHLMCSLNQKILKTFWLQYIF

SEQ ID NO: 1019635 - protein, 80 aa, Homo sapiens
PLPVLRVSVSFPLLRAFFARSAAGLSPDLGFPLLAVRCYGHVARGFPLAQSEQPGAFRGPPPARGPKKNYWASTISEDRG

SEQ ID NO: 1019636 - protein, 279 aa, Homo sapiens
FRWWRKRRSVMGIQTSPVLLASLGVGLVTLLVLAVGSYLVRSSRLPQVTLLDPNLKVACYELLDKTTCEASNTQEGSSCALAHRANQHVWGCRVGQTSIYRLQPGIDGSAGHQGHTLLSPGDEDQGYVDSESSSVYAERAVHPKIFLREGSMSQYLDSLNGWGLLDGAFGGQAGLRHTTGKGQYKQFSPTRNRPPEPPSWRKKRGTMIAGGTGISRMLRLIRAILTVPEDPIPSAFCLCANQSRERISSCGEDLEELQARVSQSAFKLWFTSGSSPRRL

SEQ ID NO: 1019637 - protein, 74 aa, Homo sapiens
FRWWRKRRSVMGIQTSPVLLASLGVGLVTLLGLAVGSYLVRSSRLPQVTLLDPNLKVACYELLDKTTCEASNTQ

SEQ ID NO: 1019638 - protein, 166 aa, Homo sapiens
MAVRGKLIAVIGDEDMVTGFLLGGIGELNKNRHSNISGGVRKDTHTMQVRIEEHFADYIMSKTGMTCGIILDQNSTSRRTYGVGNALDRPQQSDRIPRMVRGRVPSKERSSMTPAGHSNGLAVQWSRGDVHMHVSSCSLRGLPAASRVIPYVFPKVLSPGLALQPF

SEQ ID NO: 1019639 - protein, 140 aa, Homo sapiens
MAVRGKLIAVIGDEDMVTGFLLGGIGELNKNRHSNFLVVEKDSTLNENQDPFRKFLNRDDIGIILINQYIAKMVPHALDAHQQSIPAGLENLFKEHPYDAAKDFILRKARACSLSKTCARGLLIALSPFLGSRPLPRLCH

SEQ ID NO: 1019640 - protein, 46 aa, Homo sapiens
SRAITSRSVKALPIVRVVAACLSRKFCAANSRSIRSNGSLSDQAIS

SEQ ID NO: 1019641 - protein, 124 aa, Homo sapiens
STPPSLITSVKVLPRRSGALSPQPSLTGTRANMRTPSRLTFGFAEVSIFQGVEEQFRLLPTSVTLSADLQFATLVAGLNTVHYPISNRYLPHRLGKIMGKLRVRRRAKIQAEWIVGQDTDVAAS

SEQ ID NO: 1019642 - protein, 210 aa, Homo sapiens
MNASEFRRRGKEMVDYVANYMEGIEGRHGSYPARGARCTCVPLIPAAAPQEPDTFEDIINDVEKIIYAWGDSTGNSPYFFAYFPTASSYPAMLADMLCGAIGCHSASPGVVPAHGMHPAGDCDDGLAREDAANYQRHFRNDNTLAEGGTAVIHGQVPGEATLVALTGPARTKVIHRLQARVPELTQAAIMEKLVAYSSDQAHSSVAHSWL

SEQ ID NO: 1019643 - protein, 252 aa, Homo sapiens
RALEPHLKNRLGAGGIRRSGGWREEPLRELKLRIKPDQDDNLPKAPRFVAEPMGEKPVGSLAGIGEVLGKKLEERGFDKAYVVLGQFLVLKKDEDLFREWLKDTCGANAKASPGLLRMPFREWCDAFLCDALWEGSQIPSPHPEFGSRVGTSSPLSSYEEEEMAMGRYSPPRYSGDIVGVFSPKTISNFFGDSRSWIASPASFFPLASSLVDRLQFLEWIPGPFLTQPLFNPVDNSGLPFVEEAWSCKVVRS

SEQ ID NO: 1019644 - protein, 129 aa, Homo sapiens
RALEPHLKNRLGAGGIRRSGGWREEPLRELKLRIKPDQDDNLPKAPRFVAEPMGEKPVGSLAGIGEVLGKKLEERGFDKAYVVLGQFLVLKKDEDLFREWLKDTCGANAKASPGTASDALQRVVRRLSV

SEQ ID NO: 1019645 - protein, 100 aa, Homo sapiens
MCALPKRRFFGPVQQIMKFKSLDDVIKRANNTFYGLSAGVFTKIDKAIKISFDLQGTVWVNFYGVVSAQCPYGGLKMSGNGRELGEYGFHGIYRGQKQSQ

SEQ ID NO: 1019646 - protein, 319 aa, Homo sapiens
GAPLLRVPPSPLPAPLWDPPAAFPTNEIFAMSKRKCRGFRGAQQERARQPQVRSRVPRPTPASPAAAHRRATPAGQQQMRAESRSGAQRRRGSARRGAHRDLRGCVRGTRSSGSSNALQAVDAAELALSPLRRLDQAQHFTNPGPAPLPPAGRALLAPLAGEGHTRWRYRAWVGLTLNCNPPHQIAQTTPRLLNLLKSKISPLPGPRCRGDCGELLCPHLLWPLTEAPGANHGTPDPSCVTESTPASLSQSCLQKGGDPSSKTPAQSLWPSLPGLRVPETLTFCLALGAEAGAGCLQFERWGWATGTAAHLRTGSLAAG

SEQ ID NO: 1019647 - protein, 142 aa, Homo sapiens
GAPLLRVPPSPLPAPLWDPPAAFPTNEIFAMSKRKCRGFRGAQQERARQPQVRSRVPRPTPASPAAAHRRATPAGQQQMRAESRSGAQRRRGSARRGAHRDLRGCVRGGRGGVDGVDGGTTTMGVVGDWVVGDYLDGGEGGG

SEQ ID NO: 1019648 - protein, 129 aa, Homo sapiens
MCKLLEVLGGFPLDIRVYCGYEYTINNLKFACYVEPGNAAIGEKLAWAKEKYSFGEPTVPSTVAEEFTYNPFMRVSGPGSSGGGGWHSLQPGVGLRREKTVQQHAGEMDPVTTMRAVRREKDQFKMPRD

SEQ ID NO: 1019649 - protein, 108 aa, Homo sapiens
MCKLLEVLGGFPLDIRVYCGYEYTINNLKFACYVEPGNAAIGEKLAWAKEKYSFGEPTVPSTVAEEFTYNPFMRVREKTVQQHAGEMDPVTTMRAVRREKDQFKMPRD

SEQ ID NO: 1019650 - protein, 108 aa, Homo sapiens
MSDLWLLSGLSLRLENDAECVLQWRAGQTISPHRHLLRLRSCALDAASSESLTLMEWTKTRRAVTMTVVGCAFSAGHAALGGLACCDEISLTYALASPISVLQIAVLI

SEQ ID NO: 1019651 - protein, 511 aa, Homo sapiens
MALRAMRGIVNGAAPELPVPTGGPMAGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFEKNFITQGPYENRTVYETLDIGWQLLRIFPKEMLKRIPQSTLSEFYPRDSAKH

SEQ ID NO: 1019652 - protein, 133 aa, Homo sapiens
MGSALSHRALPPHSALPLLLALWLLHMEGPPRQDWSVEPTALSCVASILLAGPHGELLRMLLPTSPVAPIMGATCACFSTCDCTLHGPLCSSYSLLSLSTRCRRYGSLALSPSLISTPSVCPSALLLLPVVGA

SEQ ID NO: 1019653 - protein, 102 aa, Homo sapiens
WNATGLTRQAKCAEVKEKIDPGFGKKVEEGPLIFEVWGSRPWLIEFLASPCVVKASQKITLGGAFLFVIKHNTVRVGVFKQVDKKAAGGGKVPKFAQKAQKG

SEQ ID NO: 1019654 - protein, 128 aa, Homo sapiens
ACLSQGAPAKTTVGPYGWGTGIPKAVHNSWACPSFNLGLRETKVEPHLFSVAEEDEVSIKKAAKAVVKAMAFMGKVTFDTTKWDGQFKKPASNSKLRTYLPDFRFTPFKQAVKETCAWFPDNSKQARK

SEQ ID NO: 1019655 - protein, 162 aa, Homo sapiens
RRGRGPAVLGAMRASLLLSVLRPAGPVAVGISLGFTLSLLSVTWVDVSRAAHVPCPNLDDSELACLLLCNTNCWLLPVPNSVCMPWSWSAENARVAWLNVRLVENFRVFYHPSPAKKAIITYIHLLALLTYSHSFFFSLTLGSVWVFLDVAHGGRRGPTWAW

SEQ ID NO: 1019656 - protein, 139 aa, Homo sapiens
CSRVYEESPSTLNFEIGVTIHNRPFLKALVTDELQGLDATIPKATVARDDTTVTFHDVDVHANGIRHVREKSQTVAETMSASGRVDWSELSRLAGAKITYNDDAGETGRVTIVREMSVLGARVDVSITAVPGVEPMLVS

SEQ ID NO: 1019657 - protein, 223 aa, Homo sapiens
MISPVLILFSSFLCHVAIAGRTCPKPDDLPFSTVVPLKTFYEPGEEITYSCKPGYVSRGGMRKFICPLTGLWPYQHSEMFTQSMSFCWNLRNSGAVRYTTFEYPNTISFSCNTGFYLNGADSAKCTEEGKLAPGAYLSVLPSSALHHPYLRYATLRVYKPSAGNNIPLSGHSSVELFATTCDVGNMIPFTCTTHGNWTKITRMQPSKHGPIPHQGPDHGFDYA

SEQ ID NO: 1019658 - protein, 126 aa, Homo sapiens
SPSSERPLDMCVANEHTERHDASRHRGLQRKATAAGLAEAPTGSTGEPRSAPKAHPLLAGSQKARALGATMGHHLPITKGNSQHPGPAISHLDSPKGHEDTSPKTYSKILTPALFTIVQSRKQPGA

SEQ ID NO: 1019659 - protein, 72 aa, Homo sapiens
TCEANIRSWPSRTGRMLKPGSPAGLKNLTGRSLAPRSSSKLAGPRFFTFGAPFRVFRFSCSPYNNLSASKVL

SEQ ID NO: 1019660 - protein, 252 aa, Homo sapiens
MTAPVPAPRILLPLLLLLLLTPPPGARGEVCMASRGLSLFPESCPDFCCGTCDDQYCCSDVLKKSCGARKGVLCLGQVPASVEPVEQLGSAHEVRPGYNDPMSGFGATLASWPDIYVLTVVTIIICSPAPVLPLQDVPRPRPVVTTTNPHCGACPLSSASKCCARNLDQIPGYQHHALSRECRTDATNEEPTNLTRQARATGYTKPVEEERRNPAAALNPLCPEGQRDHGFSAQEEGHRKGATRRGTGTRGG

SEQ ID NO: 1019661 - protein, 198 aa, Homo sapiens
MWPARGAASRRSCLVSSAWTSELPVSREGAWNQGTLEPCNVTTSLGVALEGTGPGVRGGMSRFVTWRSGAQHRAGQVQRMPQPGARESRNDCGASTLAASLDGATSPVFSAAVPGRFAGTELTCKLSPFPGGPQEGFLDSRDFAATAPYGLCSLELVCLRGSPCVSPRPCSSRLPGASNSVLGALLTEEAPPLWMTWY

SEQ ID NO: 1019662 - protein, 314 aa, Homo sapiens
LPPPTPPPPPHTPHPPTTPHSPPPSPHPPPLLLPPPHPSLPPPPPPPPGPPPTHPPTTTPPHPTPPPPPHPQNNYRVYVYSRSRVLWSQGYSAVPSSPGMACSHPGTPRFQKRCSNGTDEHRSELNLRRLFDANKDRFNHFILTLNTNHVAYPVCDYSNEPGARTDVDAGMLVEYLCLDPGRGGRPVKRMFHGETINYTEGRSLCLHCVLLREPGLNTPILVRLCNGLLIAHECQQGFWTMMNVFLAHAVSRSGDLEVGTQCKTITDVINIGIGGSDLGPLMVTEALKPYSSGGPRVWYVSNIDGTHIAKTLAS

SEQ ID NO: 1019663 - protein, 321 aa, Homo sapiens
LPPPTPPPPPHTPHPPTTPHSPPPSPHPPPLLLPPPHPSLPPPPPPPPGPPPTHPPTTTPPHPTPPPPPHPQNNYRVYVYSRSRVLWSQGYSAVPSSPGMACSHPGTPRFQKRCSNGTDEHRSELNLRRLFDANKDRFNHFILTLNTNHVAYPVCDYSNEPVLTVSDCGLAVIAGCDLKSSGDCSDVPALWSGLFCVDEMKSTYTRCVSDACAALCALREPGLNTPNPVYHCAMDVDAYECQQGFWTMMNVFLAHAVSRSGDLEVGTQCKTITDVINIGIGGSDLGPLMVTEALKPYSSGGPRVWYVSNIDGTHIAKTLAS

SEQ ID NO: 1019664 - protein, 98 aa, Homo sapiens
ALRSVNDRTDPCKVNNTAKRRYDHVIGFKTFTKEIGGRCAGLKRKTRRTWRHLSACDHVLIEALGIPPEPKPGDGQTFFSEIGLDQPPFAAVDILGFG

SEQ ID NO: 1019665 - protein, 33 aa, Homo sapiens
MIITIFHAISVVPIATVYDDGPGTHEKAGYFGL

SEQ ID NO: 1019666 - protein, 397 aa, Homo sapiens
KLPLLSAAFFGRECRFAASPKGGVVREQSAINTAPPSAHNAASPGGARGHRVPLTEACKDSRIGGMMKTLLLFVGLLLTWESGQVLGDQTVSDNELQEMSNQGSKYVNKEIQNAVNGVKQIKTLIEKTNEERKTLLSNLEEAKKKKEDALICRPGISVVQKLYRAPRSVLMKTMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHREASLLLFAVPHRPQAVNALLLRSEPPEASTAMFQPFLEMIPEAPAGHALHFQLPGLSRAAEILEKGRYPTGFGEIANSRAASDKARCSPGFSGVSPPPVRGADPGWGRIGARGPL

SEQ ID NO: 1019667 - protein, 74 aa, Homo sapiens
GPGVRPSHCAGPVPPNTASGTELLSDPRLVKFVPATTENRNENVTSQALRALCPRPQPGGRPCPASSTEREDGR

SEQ ID NO: 1019668 - protein, 130 aa, Homo sapiens
SSILKAVLSPLPTHWEPPHPRPSPAPPLSPPLPAPTQVLPHPAPIHVLLRPDVGPALAPGPRPRLTQAPPPLRPAPARAAGGPGAKAPEPAAAVGTMWFFARDPVRDFPFELIPEPPEGGLPGPWALHRG

SEQ ID NO: 1019669 - protein, 113 aa, Homo sapiens
MGISRVHGPGGLLQHRVHTQPQKDRLLHQPLSPYTLWKQTVFYMEDYLTVKTGEEIFGTIGMRPNAKNNRDLDFTIDLDFKGQLCELSCSSDIQDELRPGFPALDEIQGLECI

SEQ ID NO: 1019670 - protein, 212 aa, Homo sapiens
SGASEIRGRGTGGAALRPVRGDSAVRLQQKGNRVSPAPPGALRAGLGSRTGGDGTDEPAPCRNARQVPRYGGVTPAELPQVRPGAGTRRDRRSPRTPLDWAWRWRWRWRCALALVLSDSRVLWRSGRGSHLFSHKDILPGNIALVSRTPDDVFGLGEPSPDPIMKKVYSTAINLGLTEGSAMWLAWAPWHIKLCNHADDSNNWRVPIHCPLI

SEQ ID NO: 1019671 - protein, 155 aa, Homo sapiens
SGASEIRGRGTGGAALRPVRGDSAVRLQQKGNRVSPAPPGALRAGLGSRTGGDGTDEPAPCRNARQVPRYGDVTPAETAPGPAGSRDKTGPPEPPDSFGLGLALALALALALALGARLALLHDYQKYRVEISMKRIRNNTAEYGASKDKVKEQNS

SEQ ID NO: 1019672 - protein, 113 aa, Homo sapiens
VGLPKKPLFDWGKLNSPSYGSWVLVEILRDFGGTLSIKDLSQMPGITQNDIISPLQSLKMVKYWKGQHVICVTPKLVEEPLKSAQYKKPPITVDSVCLKWAPPKPKQVKFSKK

SEQ ID NO: 1019673 - protein, 154 aa, Homo sapiens
MRFRTAVTLALFGALIGGAPGAVAAPTASATTTTTYVDCSAPTPGRGTETSPLNSLTQLKSAFGPGRKVLLRRGSTCVGTVVINASGRAGADTLLGAYGVGKTPVIDAKASAHNPRSAIEVDNKSHFVIQDLTVRNGYFNDISVEAQCLLGSSE

SEQ ID NO: 1019674 - protein, 285 aa, Homo sapiens
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAHSSGMSHPPTASREDKSPSEESSPTRRPQESVSGSVPSSGSSGREEDAASTLVTGSEYETMLNRRSMSMGYERERVVAALRASYNNPHRAEEYLLTGIPGSPEPEHGSVQESQVSEQPATEAAGENPWSSCGTSPVPEHAAGDSNLRCCRPAPLGQETLSFTAISGTGESSDVTSPGSW

SEQ ID NO: 1019675 - protein, 520 aa, Homo sapiens
EKSKLLEKFSLVQKEYEGYEVESSLKDASFEKEATEAQSLEATCEKLNRSNSELEDEILCLEKELKEEKSKHSEQDELMADISKRIQSLEDESKSLKSQVAEAKMTFKIFQMNEERLKIAIKDALNENSQLQESQKQLLQEAEVWKEQVSELNKQKVTFEDSKVHAEVLNDKESHIKTLTERLLKMKEWAAMLGEDITDDDNLIEMNSESENGAYLDNPPKGALKKLIHAAKLNASLKTLEGERNQIYIQLSEVDKTKEELTEHIKNLQTQQASLQSENTHFENENQKLQQKLKVMTELYQENEMKLHRKLTVEENYRLEKEEKLSKVDEKISHATEELETYRKRAKDLEEELERTIHSYQGQIISHEKKAHDNWLAARNAERNLNDLRKENAHNRQKLTETELKFELLEKRSLCTRCSKYSIWQESIPIWSLTIGLASSEQSFLSPQLVGVPPNSHLAAGRGKVRGPGPWLRFQKGIAVKYDHGPCGSCQTTKCLPEWLPPREVCGGHILGQEKFVQVY

SEQ ID NO: 1019676 - protein, 174 aa, Homo sapiens
MWLTAGGVGGPDAGPAMLYGLVGDGKLAQVVADHFGLDLHLVEGLAVVNAHHVLPTISGWMTHCSRRCAFFTISGFLQWAAPPSVALRQALQRGSVRASAEGPGFSRRRVARMCLQCASACLVGLCPAAVVSRLHAAVGDTCEKAPFFIRLYFCHCAPLHSSLGHRVRLCLQKK

SEQ ID NO: 1019677 - protein, 187 aa, Homo sapiens
WESCAPLLAEPLFERDEAGGVGGPDAGPAMLYGLVGDGKLAQVVADHFGLDLHLVEGLAVVKPTMCCPPSRVRMTHCSRRCAFFTISGFLQWAAPPSVALRQALQRGSVRASAEGPGFSRRRVARMCLQCASACLVGLCPAAVVSRLHAAVGDTCEKAPFFIRLYFCHCAPLHSSLGHRVRLCLQKK

SEQ ID NO: 1019678 - protein, 105 aa, Homo sapiens
MPEIVGYLFVGLFGFRLPDQETSTSVSGSDFNWRTVNRKSVSQGAHLKGGKLRKPWFETQEALTIESSFLNTQDEIYSLEKTQPQGHRLEILSSYRLAAKIKIFY

SEQ ID NO: 1019679 - protein, 736 aa, Homo sapiens
EAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFECILDKRKKPLPYGSHNIALGQLPEMPWESNIEIVGSRLPPGAERIALEFLDSKAMPWESNIEIVGSRLPPGAERIALEFLDSKALCRNIPHMKGKSAMKKRHLEILGYRVIQISQFEWNSMALSTKDARMDYLRECIFGEVKSCL

SEQ ID NO: 1019680 - protein, 595 aa, Homo sapiens
EAWRRLERFDIKLLSEFSSCLADQHLYFSPLMGKIADIVHRNLETTQDLSSLSVLMVNISSLISRHFQQQLVNKTELLFDTIDSSEVNVAKSIAKFLRNVRYRYQPLLERCNNVFLSNVDHLDLDSISKILSVYKFLQFNSFEFIIMAKKKLTEMIPLCNHPASFVKLFVALGPIAGPEEKKQLKSTMLLMSEDLTGEQALAVLGAMGDMESRNSCLIKRVTSVLHKHLDGYKPLELLKITQELTFLHFQRKEFFAKLRELLLSYLKNSFIPTEVSVLVRAISLLPSPHLDEVGISRIEAVLPQCDLNNLSSFATSVLRWIQHDHVYLDNMTAKQLKLLQKLDHYGRQRLQHSNSLDLLRKELKSLKGNTFPESLLEEMIATLQHFMDDINYINVGEIASFISSTDYLSTLLLDRIASVAVQQIEKIHPFTIPAIIRPFSVLNYDPPQRDEFLGTCVQHLNSYLGILDPFILVFLGFSLATLEYFPEDLLKAIFNIKFLARLDSQLEILSPSRSARVQFHLMELNRSVCLECPEFQIPWFHDRFCQQYNKGIGGMDGTQQQIFKMLAEVLGGINCVKASVLTPYYHKVDFEMYLG

SEQ ID NO: 1019681 - protein, 76 aa, Homo sapiens
SGAVLQQLEGRGGGAGCPVLAMKPQQAPVSGKVFIQRDYSSGTLLPVPEPEFPAELENRIDMARSLNETVRTLNNL

SEQ ID NO: 1019682 - protein, 146 aa, Homo sapiens
MKPQQAPVSGKVFIQRARRGPTAEPLPAVPWRRGPPWLRPALARPPPISDAAPIGNDTLRLLWIVSPNSTLFTSSLAHSILRRFCRPITLTIPRSLHRSHAHPGLLPAPLAGLADCPSTFCRPPSTVSSHAAFPATHIPAGIFLSN

SEQ ID NO: 1019683 - protein, 104 aa, Homo sapiens
MYETALWGSDLGRTTASPCLPPSPRAGSNAGARKRTWEGSGPYFPRGSRTRSPRVVRRKPKGRTQRSRRAQTLPRGPRGVPPARDSGAPGARKPHERRQRGPAL

SEQ ID NO: 1019684 - protein, 145 aa, Homo sapiens
EVLRGGYSEYDMITGHRFIDIWQAIKPQRIGRQEWPEVPMDEDFKLGTLKRLGLPHSTQADVGEAWQAMLVRVRDWHDLDSRFNTEMEKLIDFVTRDHFHELDNGGDGMSIDVDTVSDLIRDVSARVIDPRFRTLHDHQIHQKKP

SEQ ID NO: 1019685 - protein, 233 aa, Homo sapiens
MFAWYRCRCSQQRREKKFFLLEPQMKVAALRAGAQQGLSRASAELWTPDSEPTPRAAGTGVQTLTTWSPGAAVPPTLVSICRRPIASLQGREDTGEPALSADLGWRGLGLSSHPEGTDTGLLGRLGLCVTHSWVRADPSPPPPRSSKLCFLSFQNGTTSPPQHPTYQTHAPPSALIKPTDPAFIAASLAGPAPGVGSALSTPRAPRPSEGALPEPQTHSSSGLLGGLGTYLSL

SEQ ID NO: 1019686 - protein, 73 aa, Homo sapiens
KSPKPHLDLDSIIAEVKAQYEEIAQRSRAEAESWYQTKYEELQVTAGRHWDELRNTQQEIAFEIKPCLIQEAD

SEQ ID NO: 1019687 - protein, 102 aa, Homo sapiens
PSCSHPQSGHGAPQELQSHLFHRLPARAFLFMMSPFFEAWTHPFLSLGPAPSPLGPLWPGEKEFPWVFPVPRLPGWFSPPFPGRLPWPGGKCLFVCNPLPFF

SEQ ID NO: 1019688 - protein, 242 aa, Homo sapiens
CCCRQAPGAEAAPVRPPPEPPPALDVASASSAQLFRLRHLQLGLELRPEARELAGCLVLELCALRPAPRALVLERTRLCACTQPPSVAPPPRDENALAPYALLPHPGPGPSADRHPSQHRTIQPNGALEYRRQTDLDLYRLRAYTSGLGKRGIRPGITVLTTGITARYNRHKNMGTQQALAMSGGDAEGHHMIHQRVQLHDRTGDKEHAFWESHERAPPHGHKYLGGRSIGEERQGKSIRNR

SEQ ID NO: 1019689 - protein, 281 aa, Homo sapiens
MCLTGSHCHAKVDGTQLRGLTRCTRSHYHWIGDGTLVRLRYQHGGPGHGLLSILSAFALHASIWSLARSTSRGTTDGAQQLVGCRNYLSSRVSSAIGGEVPQRYVWRFCIGLHSAPRFLVAFAYWNQYLSCTSPCSCYRPLCRLKIRTQMSWRTVALLVLTYVSSSEDFLWVPGMHGRTCGNVFPAGDGPVPSHILDLPTSWCGHSAVDVAPESSFPFQPIRLTDHQENAFMVFIASSLGHMLLSCILWRLTKKHTVSQEVRSIPSGGSKADQKRIRTSVL

SEQ ID NO: 1019690 - protein, 274 aa, Homo sapiens
MCLTGSHCHAKVDGTQLRGLTRCTRSHYHWIGDGTLVRLRYQHGGPGHGLLSILSAFALHASIWSLARSTSRGTTDGAQQLVGCRNYLSSRVSSAIGGEVPQRYVWRFCIGLHSAPRFLVAFAYWNQYLSCTSPCSCYRPLCRLKIRTQMSWRTVALLVLTYVSSSEDFTIKKMLCMVFIASSLGHMLLSCILWRLTKKHTVSQEDRKSWKRLIFSFFSALAVYFRHNMYCEAGVYTIFAILEYTVVLTMAFMAWWDFGNKELLITSQPEEKRF

SEQ ID NO: 1019691 - protein, 120 aa, Homo sapiens
LHRGPCALRALGRQFPLRCVCCSASVWGGRSQRLLSLAPGGLWPSAWVSLGLLESGDVQGAPVEHPLCWEEQVPRACGSAGLTSQTGGLQDLTKPLGPGLMADEVLECRSVPQVPRTKPV

SEQ ID NO: 1019692 - protein, 215 aa, Homo sapiens
RADAASARACWARAAAVLRSLHGVPDEEVSVAAAAAANCATCCSLSPAALKRACCREPEMPAYPCDRCLMAFHLSLGLGSELLTAIGLGSETQANSTTDALNVLLIIVDDPAPSMACMGISWGGPPDRTNLHTFFFKMPLGSKQCAPRAAFLSSLAGDLCTNRLYEFKLYLKVQLGNFFNIPQDFQGEWAMGPMSGGKKLSTWGYLLNNTDEFSG

SEQ ID NO: 1019693 - protein, 87 aa, Homo sapiens
GSREPDPHLSSKQAQKGVLHRGLGRREVLLVLPGDRSAATPTVSWDSPDLLFNQRGAERHALVAALKAKRCTQPRVELVSGTAMTVA

SEQ ID NO: 1019694 - protein, 75 aa, Homo sapiens
TLLRIPGRFEARITGLTVLLPHSSAITIKSDTQQHEVLLGTSPFMSEADPPPEPLQTPQPHIPTLIRSPLLQARC

SEQ ID NO: 1019695 - protein, 287 aa, Homo sapiens
MAAAAAGLGGGGAGPGPEAGDFLARYRLVSNKLKKRFLRKPNVAEAGEQFGQLGRELRAQECLPYAAWCQLAVARCQQALFHGPGEALALTEAARLFLRQERDAAQRLVCPAAYGEPLQAAASALGAAVRLHLELGQPAAAAALCLELAAALRDLGQPAAAAGHFQRAAQAAQLAPQLRALAPRRLGEGRLLAKLLGAELHRAPWAVFTAAAWARGRATPVQVTAARRPPGPQARAGQRRPPAALLPPNSGSAAPSPAALGAFSDVLVRCKVSRVLLLLLLKQPAKA

SEQ ID NO: 1019696 - protein, 267 aa, Homo sapiens
MRTVEVVFRAISQAVLPTHPIVHNPYPRLSLVATNTTLYTAIDLKDAFFTISYTLIPKTYLLSPGLTLTPSSHNKSPRPVFTFLGFRDSPHFFGQALARNLTSLNLSPSHLQYVDDLLLCSPSLKDSQTHTATALLNFLAIKGYRVSPSKAQLSISMMTYLGIQLSPGAQAMTPARAALIENLPPPSSKSEILSFPGLAGFFRIWISNFALLAHPLYEVAKGPPNEPLNPSHNILPSFHKLQTALVTASAPSLPDISQPFTLYTAES

SEQ ID NO: 1019697 - protein, 150 aa, Homo sapiens
MGMGVPEGSGHLGLAVLEKPQQAIVNPHTGWTAQLAKERINGRTRPITIKDDKVATFNRCIAERGLRLFHHEYMDKLDAWRIRRHGLEIQADLRELDWKTTHRMSPPPLEGRQTVSQWPQTLSGSAEEDDSQRQKLDLEPANAVNRVRHA

SEQ ID NO: 1019698 - protein, 368 aa, Homo sapiens
RLYGWSMGCERGGFRCPAKPFWRLPPSAPWAPWAPLAQYQLTWHVTSEPDAHGWLAGGTPCWLPIWCSSSASTWHATHMMDPFRKRLLVPQAQLPCLPSAGGGFKTARERKMADKVLPQRIRELVPESQAYMDLLAFERKLDQTIARKRMEIQEAIKKPLTQKRKLRIYISNTFRPSKAEGDSAGTAGTPGGTPAGDKVASWELRVEGKRVWMILANMKRKFSSFFKDDLGLVEHGAKGAVRGLTITLAGDGSRMPIQPSETDGFQGNNAVEILKGQDATFVLMLEHQAPQYKLDPRLARLLGVHTQTRAAIMQEPVALHKHKQLEDGHKREDINWKRYFRQIFSVADLRFSENLMKLAGLFTFKTLG

SEQ ID NO: 1019699 - protein, 458 aa, Homo sapiens
RLYGWSMGCERGGFRCPAKPFWRLPPSAPWAPWAPLAQYQLTWHVTSEPDAHGWLAGGTPCWLPIWCSSSASTWHATHMMDPFRKRLLVPQAQLPCLPSAGGGFKTARERKMADKVLPQRIRELVPESQAYMDLLAFERKLDQTIARKRMEIQEAIKKPLTQKRKLRIYISNTFRPSKAEGDSAGTAGTPGGTPAGDKVASWELRVEGKRVWMILANMKRKFSSFFKDDLGLVEHGAKGAVRGLTITLAGDGSRMPIQPSETDGFQGNNAVEILKGQDATFVLMLEHQAPQYKLDPRLARLLGVHTQTRAAIMQEPVALHKHKQLEDGHKREDINWKRYFRQIFSVADLRFSENLMKLAGLLQHPDPIGHQTMSFSVDPKRPEEDSCDDIDVEVGRTIEGPKGANFLGSYTNQAGDCLLECQDPMRPIESINQVKTQRRFKVSFRPNPRIPSRNGPVP

SEQ ID NO: 1019700 - protein, 149 aa, Homo sapiens
MGPGLPEWDSSDQGDGLDTSVASPSSGGEDEDLDQERRRNKKREIFPKVATNIMRAWLFQHLSHPYPSEEQKKTVAQDTGLTILQVNNWFINARRRIVQPMIDQNRTGQGATFIPGQPIGYTETQPHVAFRPPGSVGMSLNLEGEWHYL

SEQ ID NO: 1019701 - protein, 136 aa, Homo sapiens
VFLHQGPPRPGGGSPRSVDPVDGRLVQHSFQALVLKEQGRQFYNVAPDPVPQGLKGLKEGALKSPVSQKRRLCFPCAQIPQTHLVERTRLRCFEAQGMCAPHGCDLGHRPQSARSLKGVIGPGEHTARLAATSGRL

SEQ ID NO: 1019702 - protein, 58 aa, Homo sapiens
DSRRISIRLAGNLCTLTILTSLSAEIEESNLTKMMLDKRILCSPPLSGPPIEGYRSSN

SEQ ID NO: 1019703 - protein, 102 aa, Homo sapiens
AGEAPACQAAEGAGRAEPGVGARARMEALPVSPLRAAGRQDPATSRIPRAATRSRHAGGDGAAVAGCGHWQTGWPAEGEHRCFTSSPGGCGRHRLVLFPLVH

SEQ ID NO: 1019704 - protein, 102 aa, Homo sapiens; identical to SEQ ID NO: 1019703

SEQ ID NO: 1019705 - protein, 122 aa, Homo sapiens
ENNEELPKSAYCSCEKVVKARIFHPQKESTDPDGDGLLKPYSANLTYSIRERRICVDEGGIWPYTSLGKRNRVLSASSHSLLLDNSYHDNLCFQGAENRRKLAYMRTDWPEEQQLLVANGVT

SEQ ID NO: 1019706 - protein, 192 aa, Homo sapiens
SGIPGIVRPLFCPAFNNLTNALSRVTLESDLLPSIFCFLVSDSCFGMAMTGWSLVTGAGGFLGQRLILLVPGAGARPARVLAAFGPPPTAFPPPPPPLPVLAGLLAAPFLPRPCPDRLGPPHPPPVSFLSSVSLPPPSCLSLPTPLLPACLPARVPVFPPVASPPPPPRPSSRLALPPRLWPPPGPLPPHTA

SEQ ID NO: 1019707 - protein, 199 aa, Homo sapiens
SGIPGIVRPLFCPAFNNLTNALSRVTLESDLLPSIFCFLVSDSCFGMAMTGWSLVTGAGGFLGQRLILLVKEKELKEIRVDKAPELREEFSKLNKTLTVLEGDIDEPFKRAQDVSVIIHTSFIDVFGVTHRESIMNVNVKGTPPLEAVASVPVFITSIEVAPSEIINGEEEPENTWPPPHSKKLAEKAVLAANGWNLKN

SEQ ID NO: 1019708 - protein, 218 aa, Homo sapiens
LKGYSASVSVPSLLGPRRSSCTTCLRRGPIPLHPREAGPGLLAEDIRPNEHCPLYEMLSDKGPGKPSTEEFQAKWKPFQEFSRLWPGLLIRKSPESTKVSLKEPVETQSSCPPTTRSCGGERGSWLAFHPSCVSLLVHLSSLSRECLHLLPRPPLSHFFLVWLGVFRLPVLSRVCGAPAMRLFVTHSHHKGLYIPRSPELFRPASYLSVHILRNKPVT

SEQ ID NO: 1019709 - protein, 216 aa, Homo sapiens
MSQLSALSGVTWRYLPPDCERCEVLVACAPSLPGVPSPSGSLVSPGLVCWLCCILSARPRGEGAARASESGAMEPRELGKVGLEGPGGRPLPPEDRAGLGRGGAARAEAPYVEGFAGPSALRPPGGGGEERTLPFGVRCIELSVRWVDGGDPRVERCEGAFHHLRFEEALLRLGVWIGRLELQGGTLDGLILPRSSLTKKGLKREGIWHAFCHFCF

SEQ ID NO: 1019710 - protein, 74 aa, Homo sapiens
FEMESCSVTQAGMQWHDPVSLQPPSPGLKQFSRLGLPSSWDYRCPPPHPANFCIFSRDGASPRWPGWPRTPDLR

SEQ ID NO: 1019711 - protein, 128 aa, Homo sapiens
VRASRTMWIPRGCRLKSTLVQTSKLQPLNPNQTTKPPPPKQTTKNHQNACRRCCRYLRCLRHGPDRRLCLSHQRHQRHPHRCSHHRPYQRCQLPVPEHPPRCRCCCRPRCQPLSNFNFFLFETFLSLP

SEQ ID NO: 1019712 - protein, 113 aa, Homo sapiens
MPLFPRRGHVGRTSWAGSGSASQERDPKLGDLEILSGLWGPCLSSPPEIDDSLSSHTEVSPDLTSSRLTGVAGALGEWEAAQGQLFHENRETGELWGGGGGAENWKERRPAKV

SEQ ID NO: 1019713 - protein, 113 aa, Homo sapiens; identical to SEQ ID NO: 1019712

SEQ ID NO: 1019714 - protein, 107 aa, Homo sapiens
HLLAAHPPVFRSSPPASGGNSQMYQRSVCSTTGTPGLLYVQQRELAVTSPKDGSVSILGSDNATTCHIGVLLHTGYGATCLTHCDGTDTKAGVPLIMNSIKSFSDCA

SEQ ID NO: 1019715 - protein, 151 aa, Homo sapiens
MKSLGVLSPVKNSAVSLDILNLYMVNQISCKKKIPETVRKPTHVNMNRDIKMPLRKHNLELTMSPHCVPSKLCLDDTETNVNCQRLSSKEDLGPVQSQGMDSYSMLHPQFSKIENCSFTPSSFSVELPSNRHISKLNFTSGISTYSSGTCI

SEQ ID NO: 1019716 - protein, 151 aa, Homo sapiens; identical to SEQ ID NO: 1019715

SEQ ID NO: 1019717 - protein, 68 aa, Homo sapiens
AERLLGGWASGGGPEGAYSGPDVVRRPWGILLKLRFGAELRCLSSRHRDLSVKRFGKMNWVGGSRSRF

SEQ ID NO: 1019718 - protein, 218 aa, Homo sapiens
TEPGPQAAPCQLSSSHSRSNRLLSPMARRHASSARPQTIPGLHAGGTAAPAPDGRQPTRNRSIPELCGTRFRLGRHVPHQSNSTSHSSATHIASIQPWKRCCCGLKADTHDEIQLGHIHNVTEISEAPIRERSQVLLDTLIHPDSNLQMTARNGLLITEVLKIAGIARDDVISLLHSETFMNHFLDTAEATIKTIDYWKIGTPGEPVELEMRPAVALN

SEQ ID NO: 1019719 - protein, 261 aa, Homo sapiens
ITVCHRQTVRTDQRQCSEHRHGTFLLGLQDTTAQLIALDGFKQGLEVAFTKTIIALAMNELEEYGAHQGFRENLQPETAVATFRCAIEQNATVLQFCSRLTVRRQAAFQHLVIGLWRRSHKAHAHGFELVPGGNQIVSQEGHVLDAFTIELHQELFDLARTLGGFLIQRNADLAIGGGHGFGRQASVFALDVEVANLTEIEQVLIELGPVGHATAVHVVGQVIDLFQACAHGMTIHAVQVNEVNVVDGVAVDAPANLVVVG

SEQ ID NO: 1019720 - protein, 68 aa, Homo sapiens
VRTKLNEMCKITAQTLCWVPGDAEPSAGTLRPHVEACKDCVLDKDLLRHPCCSSQRLKDGCGTCGRLG

SEQ ID NO: 1019721 - protein, 102 aa, Homo sapiens
VRTKLNEMCKITAQTLCWVPGDAEPSAGTLRPHVEACKDCVLDKDLLRHPCCSSQRLKDGCGTCGRLGWVTSPRMPSLTTQRSSPGTPSLSCCNPFLAILFA

SEQ ID NO: 1019722 - protein, 287 aa, Homo sapiens
MVALENPECGPEAAVGTPGGRRLLPLPSCLPALASFPRCKRLSASRRKQHFINQAVRNSEPRCPKANGAEEPPAPVRTTQYLLTLLEKDGGLPGLEDGDLAPPVIIQGIFVRGLHTNATYVEVWNDFMNRILGEDAVMQGYFADSGGMQEHGVNGSGRKGPGRGEDRRKKDPAYTPRECFQRINRRLHKPVLKRIRIPMETLETWEERLLRFFSVFPQACVHQSTVYDNSFERLLLHAVCQYMDLISASADLEGKRPDEGHVIGTWISCPRGCSCPPTGASTADCGP

SEQ ID NO: 1019723 - protein, 171 aa, Homo sapiens
LRREVHSRGEMLMPVHFLLLLLLLLGGPRTGLPHKFYKAKPIFSCLNTALSEAEKGQWEDASLLSKRSFHYLRSRDASSGEEEEGKEKKTFPISGARGGAGGTRYRYVSQAQPRGKPRQDTAKSPHRTKFTLSLDVPTNIMNLLFNIAKAKNLRAQAAANAHLMAQIGRKK

SEQ ID NO: 1019724 - protein, 358 aa, Homo sapiens
GGSGRFCAGSRRLLLLLLFLGPWPAVDAIGGKYIGVEKNQPIAVSRNASPGEEFPHGEVEPAVGEMAQRSASLPPVRLAELHADLKIQERDELAWKKLKLDGLDEDGEKEARLIRDLNVILAKYGLDGKKDARAGDPAISLSGTQEDGLDDPRLEKLWHNGEDLWENSPRARTGQALAGEFLHHKEKVHEYNVLLETLSRTEEIHENVLSPSDLSDIKGTRTCTAGTRKLKEKLRSIHPGPGPACAGSGTRATALTLSSEEPQADVTCGTLDATPATHRTKSWHRSREGSSKALRRPRFDDSPSTTRQQLQNCAPSKLAGRHSTCADGQPCEPASRESPLSGGADPGAGYTVRSICGL

SEQ ID NO: 1019725 - protein, 152 aa, Homo sapiens
QTHTDTCAPSHTLFSFYNGVRRPLTAAAGSLKSDTRSRGSVAPASSDPQGLSTPRAPCLRGRSPVAKAFPPGPILRPAGGPPAGPPLRAVFRAGSAALSCARTCADACFHPGVCRHLVPGSSGAFSEAAECQALHTTPSPEPESFTSVENSN

SEQ ID NO: 1019726 - protein, 123 aa, Homo sapiens
PYPPLNIPVGRGIVKGIPFFSPIILLRESVNCNKGITVPRQNEDFLGPARVTNAKRIYWRTVLSGGSLYNIPGGALPKGSKDTFPVFLEFAEEQLRAAHVFICFPKNREEKARLAPTPQLFGL

SEQ ID NO: 1019727 - protein, 30 aa, Homo sapiens
MDTRGRLPGESCARSLRSIPSPRDPVDRPA

SEQ ID NO: 1019728 - protein, 315 aa, Homo sapiens
SGGCWTRLECSGAISAHCSLRLQGSGDSSASASRVGDSGMDIMPQAFLLGSIHEPAGALMEPQPCPGSLAESFLEEELRLNCLEAWKAKAWPGFPEALVGHSFYNLPVGGYACGEPTLDNIAVISHTCQGPKEVLFLGMNPGPFGMAQTGVPFGEVSMVRDWFGHLLGAVADPSPKSILNDQCWDLELPTVRSELVPNSGAFFRNLCGQPEVFFPSLFCPQSIALCFSLAPSGRKLTPAELPAKQREQLLGSVMPALCRQVQLLGVRLVGGKWGDWQSSGHDGLQVLCQSRKGSCIPLPVTQQANKGWEAVARKD

SEQ ID NO: 1019729 - protein, 62 aa, Homo sapiens
MVWPATIASSGCWRYSSMAAGNKFRARPRRMGLVGGISFLLMSMASWEADRAESMMRFLSSP

SEQ ID NO: 1019730 - protein, 78 aa, Homo sapiens
GLCRSLSDTFGSTSLILSFAGGRNQARAATMFRNQYDNDVTVWSPQGRIHQIEYAMEAVKQGSATVGLKSKTHAVWLH

SEQ ID NO: 1019731 - protein, 78 aa, Homo sapiens; identical to SEQ ID NO: 1019730

SEQ ID NO: 1019732 - protein, 314 aa, Homo sapiens
TRGPHSSVSLQLSVRPQPHSPAVPRLAGGSDLQVDKRCEAKSCSSPRAWGSGGSTSMSTPRFRKLLRLDSATWGQFRTRSERSTGQSSANVLTPSLPTRRQRVRARWWSAGQFRANSGTAASPTLAWTARERLRRPAPRLCARDTMASSLSWRQVVRASSSRARAAISEARAARPVHPVTVRERYVLQGFGSPRPKPQAPGDSVARSGPTPQSAAADSAPPPAPGPRLAIVVTWRQFQLLQHLGISQQLGQFGPRELRTHLRGIEATQPGQVKLHQRPEGPANALQEQLAGTRFRTCGSRHVFPGQVQDLKAPG

SEQ ID NO: 1019733 - protein, 259 aa, Homo sapiens
INQSDLRFQRKVFAFFFKSSLYDLSNLELLSRRTSYQERASDSQNYKCHKILTVPLVLYTSLSQPHAQEGPDHYGCSMLTLLRSRSRSSRMAFMVALVRFSSSSLLHSMAVRLSFSSLSPASSFSHRDLSSARLGYRSRPSTPSISSTVLIARSQCSLAVVSCSMCLSTSATERLQLLFFLPQTTFSSPVSTLCSSEFRSLQLSMSAVTMVDWFSGIETEVWSWSMLRESSLTSCWLWLSSDRSSEYSSSSLMVVPCRR

SEQ ID NO: 1019734 - protein, 241 aa, Homo sapiens
INQSDLRFQRKVFAFFFKSSLYDLSNLELLSRRTSYQERASDSQNYKCHKILTVPLVLYTSLSQPHAQEGPDHYGCSMLTLLRSRSRSSRMAFMVALVRFSSSSLLHSMAVRLSFSSLSPASSFSHRDLSSARLGYRSRPSTPSISSTVLIARSQCSLAVVSCSMCLSTSATERLQLLFFLPQTTFSSPVSTLCSSAGIETEVWSWSMLRESSLTSCWLWLSSDRSSEYSSSSLMVVPCRR

SEQ ID NO: 1019735 - protein, 96 aa, Homo sapiens
AINAIVRSRVGVAGKHPEFSLVFLMAGVTGNDSLHQSAHSMRKQNVVPTVLALGSDVDMEVLTTFSLGDRAAVFQEKDYDSLAQPGFFDRFIRWIC

SEQ ID NO: 1019736 - protein, 159 aa, Homo sapiens
PILQRRARRRRFPEATRSWSSGDRSWRPGAPAGLAEAREVAGRNGRTARAPCVPRTSGPVHAPDGCGLQHLGPGWGGGVQGAGGAADAPGRRLRPRCGAGTALASPEQARGILLCCCDFFKNFPCFVALFIRFIARDFAIHFLFLLSWPLLASLAFLPF

SEQ ID NO: 1019737 - protein, 278 aa, Homo sapiens
PILQRRARRRRFPEATRSWSSGDRSWRPGAPAGLAEAREVAGRNGRTARAPCVPRTSGPVHAPDGCGLQHLGPGWGGGVQGAGGAADAPGRRLRPRCGAGTALASPEQARGQQGRRRDARRKYLPVRCPTSSGYARMCPSAIISYLLHALAAPLTASSIHTMIQTALLDAFDGHRVIALFNPRNPGYEGHAGTLLDGPLIHHCACMDQPWPLLYPGATLFFQISMSFGCWPVTWLAASKVRVSPEGSESSQDDRTCPGNPVLRIYYTSRPALATLWLR

SEQ ID NO: 1019738 - protein, 142 aa, Homo sapiens
PILQRRARRRRFPEATRSWSSGDRSWRPGAPAGLAEAREVAGRNGRTARAPCVPRTSGPVHAPDGCGLQHLGPGWGGGVQGAGGAADAPGRRLRPRCGAGTALASPEQARGQQGRRRDARRKYLPVRCPTSSAMLEHCLTDP

SEQ ID NO: 1019739 - protein, 159 aa, Homo sapiens
PGSNQKNHPLRVGGGLCWGQKFCTRNTRIIDVVYNASNTEVVGTKPLVKNCLVFIDSPRYRQWYESHYALPLARKKGAKLTLEEEEFLTKNRFKKIQKKYDERKKNAKISSFLEDQFHQAKFFACIASRPGQCARPKGYVLEGKELEFYFRKTKAPKGK

SEQ ID NO: 1019740 - protein, 102 aa, Homo sapiens
MRLPLVRFKVGKLIPEEKTMIDDNPRAKKIQKKYDERKKNAKISSFLEDQFHQAKFFACIASRPGQCARPKGYVLEGKELEFYFRKTKAPKGKYNPCLVFPQ

SEQ ID NO: 1019741 - protein, 86 aa, Homo sapiens
DEESLECLCRLLTTIGKDLDFEKAKPRMDQYFNQMEKIIKEKKTSSRIRFMLQTCWIREGAMWVPRRGDQGPKTSDQIHKEAGSSR

SEQ ID NO: 1019742 - protein, 179 aa, Homo sapiens
MASHRLLLLCLAGLVFVSEAGPTGTSESKCPLMVKVLDAVRGTILATHVGPCMCPERLAGWTPGSHLPLGITSESGELHGLTTDEEYGERIYKVEIDTKSYWKALAIFRFHEHAEVVFTVNDSGPRRYNHLRSLLSPLLLIPPRLCVTNPTGMRDFSLPVDLKDEGLGFHVTKKYSHFY

SEQ ID NO: 1019743 - protein, 185 aa, Homo sapiens
MASHRLLLLCLAGLVFVSEAGPTGTSESKCPLMVKVLDAVRGTILATHVGPCMCPERLAGWTPGGAHFGSWGKTQLEVWESLALGLHKLGREEHLVRTGHYSQRLGNKNTQNSLPGKRPLWAFFPISHGRNGEGWVISQGQTTPGAPAATTICQPAEPPTPIPPRLCVTNPTGMRDFSLPVDLKD

SEQ ID NO: 1019744 - protein, 160 aa, Homo sapiens
MASRGRCLFGEVVHDWRPCRSPRWPRQPRELPRGHRRWHGCGHGLLGLLPQDLELMAPPPLGPGQEGPCPCPHYRPGLRGWRNPSPLPRATGPWVPALPPRFGSSRGPHCGDKKGMEWGKRRSRRPSSFCCPGVGASPLWRAGGRRWKPQGLAFLKLVLF

SEQ ID NO: 1019745 - protein, 176 aa, Homo sapiens
TCALWDIKTGQQTVGFDENSGDVMSLSLAPDGRTFVSGACDASFKLWDVRDSMCQQTFIGHESDINAVAFFPKGYAFTTGSDDATCRLFDLRADQELLMYSHDNIICGITSVAFSRSGRLLLAGYDDFNCNIWDAIKGDRAGVLAGHDNRVSCLGVTDDGMAVATGSWDSFLKIWN

SEQ ID NO: 1019746 - protein, 176 aa, Homo sapiens; identical to SEQ ID NO: 1019745

SEQ ID NO: 1019747 - protein, 176 aa, Homo sapiens; identical to SEQ ID NO: 1019745

SEQ ID NO: 1019748 - protein, 110 aa, Homo sapiens
MFPFSMEYDQRHHWCLFAFVALFYLINRMLFWEVDNRRDVRLFHQLGWKRKHIIGWFRQEMAVLLLLSASISLPGAWALQKWGRFGADFYLWFLIVLLAAAFILLISFRS

SEQ ID NO: 1019749 - protein, 84 aa, Homo sapiens
WFRRFLVRGGAFVPDWLRGKAEVNQETIQRLLEENDQLIRCIVEYQNKGRGNECVQFQEVVHRNLIYLDTIADASPTSTGKAME

SEQ ID NO: 1019750 - protein, 84 aa, Homo sapiens; identical to SEQ ID NO: 1019749

SEQ ID NO: 1019751 - protein, 121 aa, Homo sapiens
CVFQLRLKIREVPRRSCSHQSHGAACEAEAPPTGPPPNWHHCCPCPYSQPHVTLGQKQWWGSQGSVKSLSQLQDKFEHLKMIQQEEIRKLEEEKKQLEGEIIDFYKMKAASEALQTQLRTA

SEQ ID NO: 1019752 - protein, 158 aa, Homo sapiens
SFSISVTHSVNKNSYIGKIHSKKTWQITLSACQLALPSLLFPPPPPFPPLPFPALIHPDSRSTSLSHPPLFSAPPRHPPPPHAPSRTPAHPPLLPSPPDSHLRPPLWKSQLRLQGPQYLALFQGMTEQDLFIPFGKIVIAALLLNLTFYKKDQEAAKC

SEQ ID NO: 1019753 - protein, 146 aa, Homo sapiens
DADDLLHVRQVLVLVVSLAVNRALRGPKPESPGHYCGGWRSPLNLGPALTGAAAERPLHPTIATQATLRNSKDAEKQDKERGPHPEGPAALYAGYSPPVSSEALKGHLGTLTCPPPPKCAGLRPLGREPGYVTREGGSGHGLAGQM

SEQ ID NO: 1019754 - protein, 49 aa, Homo sapiens
GQQEDDVTGRCVTVHGQLCLAGKAWAHDLRLRAEDVLHVIDELLRYTSA

SEQ ID NO: 1019755 - protein, 139 aa, Homo sapiens
AEGDRTMAARQRQCRGAAQLVGAGGGGLTALGRFTCPVCYRGVREAGTGALRTRLVLCMPAGMSEAEEACLWGCVAVALDTVGDPRPVEARRGQDRKRHKKTSLAMACRYRTFFPDPRIRFPPLANIVSKKPEFNQWGC

SEQ ID NO: 1019756 - protein, 210 aa, Homo sapiens
AEGDRTMAARQRQCRGAAQLVGAGGGGLTALGRFTCPVCYRGVREAGTGALRTRLVLCMPAGMSEAEEACLWGCVAVALDTVGDPRPVEARRGQDRKRHKKTSLAMACRYRTFFPDPRIRFPPLANIVSKKPRITIMRMGGQASIEEMAVLVSSQRKVVTGPVYTFALVLTVLRRSCGSGRSCWNHCNIDSIVTAYQILGVWSEYDASNA

SEQ ID NO: 1019757 - protein, 225 aa, Homo sapiens
ARGELPPIKEGCITEQVREFYGLESKKGKKGQHVGCCGSRTDLSADTVELIERMDRLAENQATASMSIVALPSNFQESNSSDRYRKYCSSDEDSNTCIHGSANASTNVRTNATTTASINFSTSATTTESTNFSTSATTTASINFSTNATTTASINVRTSATTTKSINSSTNATTTESTNSNTNATTTERPTPALMLLPLKVPTPTLVLLPPKVPTPTLVLLPPKV

SEQ ID NO: 1019758 - protein, 279 aa, Homo sapiens
MELLSSLALPGFSLPDPWAGGTEAEQPQQPPKESSSWWVEPLTAEGRASLRCPAASRPTARMLTLDANPLKTLWNHSLQPYPFLEILNLHSCHLIIRSTFQEKGHLLTLVLGDNCLSENYEETAAALHALPGLSEAATCHGNALTEDMAALMLQNLSSLRSVSLAGNTILRLDDSVFEGLERLRELDLQRNYIFEIEGGAFDGLAELRHLNLAFNNLPCIVDFGLTRLRVLNVSYNVLEWFLATGGEAAFELETLDLSNSCCSSRCCPVQQVADLLLDK

SEQ ID NO: 1019759 - protein, 203 aa, Homo sapiens
HTFWALLASPKMEHKEVVLLLLLFLKSGQGEPLDDYVNTQGPSLFSVTREVMLVGSEAENECACKDVNEDKMNSPARGDSMYHSQEEQHMCDNGLKTGSPPIIIEDEQMQFYFELVNVSFRVHRLVNWKMNYRGDECPESEIEVGITMIKNGVSTFVAPKTLESDVFPFIFGFIYGKGSLWALEGIVSRTPLGLQKPILFKGP

SEQ ID NO: 1019760 - protein, 86 aa, Homo sapiens
HTFWALLASPKMEHKEVVLLLLLFLKSGQGEPLDDYVNTQGPSLFSVIQRIACLRVLRVHASRQDIVASDTYVQGRLIDIPALRRG

SEQ ID NO: 1019761 - protein, 102 aa, Homo sapiens
SGSRRRSHRAGRPPGGSYHCLCQRLNLQYSWLPSDTLGGVALAQELACLVTYRQEERLESEPPALALQLAALAGCDMSLVLASCGMLLKPLSTAANLRGNRL

SEQ ID NO: 1019762 - protein, 73 aa, Homo sapiens
SNRARYRYVLDRELVALFWVPVVVHHQMLIRIIPVPILMVKIVISAEHNAITILTKQNSLSPLWRRRSLCAFV

SEQ ID NO: 1019763 - protein, 103 aa, Homo sapiens
MWVETPGPLQGTLQSCFQAGTPAERSQSQRVAGLLALIFPLLGGSRGDLAPLLCPPDFPSKGFRRLLPFPNLSLCRISAKSQSHFQAKVLGHKDNKDIQFMKK

SEQ ID NO: 1019764 - protein, 91 aa, Homo sapiens
MTSPHLLGAGACHGQPPLSPCTGGAAPPTASGGQVPPPPPRGHPLPQGPPHVARLVVNGPGWEQPLAHPPTLLTMQFEFQATAPAGPLPQP

SEQ ID NO: 1019765 - protein, 91 aa, Homo sapiens; identical to SEQ ID NO: 1019764

SEQ ID NO: 1019766 - protein, 87 aa, Homo sapiens
ELAHRPPSSGCTMHVNGKVALVTGAAQGIGRAFAEALLLKGAKGALVDWNLEAGGQWKAALDEQGEPQKTLFIQCDVADQQQLRDHF

SEQ ID NO: 1019767 - protein, 87 aa, Homo sapiens; identical to SEQ ID NO: 1019766

SEQ ID NO: 1019768 - protein, 363 aa, Homo sapiens
MAGPGPTFPLHRLVWANRHRELEAALHSHQHDIEQEDPRGRTPLELAVSLGNLESVRVLLRHNANVGKENRQGWAVLQEAVSTGDPEMVQLVLQYRDYQRATQRLAGIPELLNKLRQAPDFYVEMKWEFTSWVPLVSKMCPSDVYRVWKRGESLRVDTSLLGFEHMTWQRGRRSFIFKGQEAGGPGDWKVDHDRQVGCMLETLGAHSCKEPETLLAAMRASGGACGSRSLSYRLHHLETRNVAFERNKCGIWSWRSERMATVNPLTGQVDHGPTWTRFTPHPRTLGIRNSARQEKTTAEKHPPVPARQTDSQHGTESRAQQTKTPQHSRQQRKEVPYTQQHEAAKPTHAPQPEDRHHEHHGAR

SEQ ID NO: 1019769 - protein, 269 aa, Homo sapiens
MAASQAVEEMRSRVVLGEFGVRNVHTTDFPGNYSGYDDAWDQDRFEKNFRVDVVHMDENSLEFDMCVDWDAAIANAFRRILLAEVPTMAVEKVLVYNNTSIVQDEILAHRLGLIPIHADPRLFEYRNQGDEEGTEIDTLQFRSPESDASQEATNAAKDSSDPKELYVKPTIVYTRQYDMDPHWGTRLSLFPEGHISRHRCMHEYPRSLSAAGQEIELLIAVCQGHWKDHCKFHPVPQAVTGSCRIHPVYPVKGTQLRVGRSSTRGFQGR

SEQ ID NO: 1019770 - protein, 250 aa, Homo sapiens
MAASQAVEEMRSRVVLGEFGVRNVHTTDFPGNYSGYDDAWDQDRFEKNFRVDVVHMDVRRILLAEVPTMAVEKVLVYNNTSIVQDEILAHRLGLIPIHADPRLFEYRNQGDEEGTEIDTLQFRSPESDASQEATNAAKDSSDPKELYVKPTIVYTRQYDMDPHWGTRLSLFPEGHISRHRCMHEYPRSLSAAGQEIELLIAVCQGHWKDHCKFHPVPQAVTGSCRIHPVYPVKGTQLRVGRSSTRGFQGR

SEQ ID NO: 1019771 - protein, 226 aa, Homo sapiens
MALRGRAELVCLSGPHPVPDPPGAPDGLPDHDFCVSCPPVMEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRWTSLQSERSRNVSAPTSSSSRGSLRHPCPPRTLHSLL

SEQ ID NO: 1019772 - protein, 236 aa, Homo sapiens
MLERRETHGLRSETLTKVCDLMCAGGVRAVPLRPWLARTAAAGTRRWRRWLLDALPGPQGPCPPVMEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRGGYSGFGQFAVRSPECFGLIRS

SEQ ID NO: 1019773 - protein, 189 aa, Homo sapiens
MALRGRAELVCLSGPHPVPDPPGAPDGLPDHDFCVSCPPVMEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQR

SEQ ID NO: 1019774 - protein, 207 aa, Homo sapiens
MALRGRAELVCLSGPHPVPDPPGAPDGLPDHDFCVSCPPVMEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQKGGGPPPSKSFLDQFAE

SEQ ID NO: 1019775 - protein, 105 aa, Homo sapiens
MSIPLLHTRTSHCCSMSSQQRKQPCIPPLKFKQRQVKQPCQPPPKEPCIPKTKEPCHPSVPEPCHPEVPEPCQPKVPEPCHPKVPEPCPSIVTPAPAEQQPKQSH

SEQ ID NO: 1019776 - protein, 184 aa, Homo sapiens
MEADEVGGGCCLFTSGPRKADGASKGLQGLKKAAESHFLPPLAPVSLAVQPLPPGSPPGRGPPRVRTGLACCGPVWLTGPCSSVQQLIHSRGTSFHPGPALGAESHPPSSFPCQLHRVWVGGSLTPRSGTGPGSGEDGQGPFSRRWGVKRARSGVGELAQHHPCGPHCSSNCIIKVIGLATWFH

SEQ ID NO: 1019777 - protein, 38 aa, Homo sapiens
SRTPEAVGLKKRDKKNKTKKLKQQQQQHLPQQQQLQLS

SEQ ID NO: 1019778 - protein, 242 aa, Homo sapiens
GPRRLSESSEEVAAAGRWLLHLPNAKTAQMRSPRIAQKIKGPPRSRVRRIAAGTKPEKRRSASSGSSSTRSRSSSNFQLSAPAPALAQAVAPALPQHSSLLRKAPAPPAAPALDSSSWLSKSFSGADTTTGGAPAPNPNHLKSRMTKRSRKQGVRPILPKPTKVHMGDSPWNVTRITSWRYFPPYGENLKLIDMAVERMHPQSVKEYGYVEFEDPDERREGLKHMDGGQIDWAGDQCDACGP

SEQ ID NO: 1019779 - protein, 69 aa, Homo sapiens
IAIRVASPKLVMEEAPESYKNVTDVVNTCHDAGISKKAIKLSPIAVIKGETLGQQGCLTPPTLFEVEVD

SEQ ID NO: 1019780 - protein, 290 aa, Homo sapiens
PRPAGGCSGPGRRVCGPGAEAATRDAVRTLLCLRSAGPAMAVPPPRLPLISVSVSAPAFYAPLKKFGPVVAPKPKVNPFRPGDSEPPPAPGAQRAQMGRVGEIPPPPPEDFPLPPPPLAGDGDDAEGALGGAPPPIEEFPAEEEIFPPPPPESVALHIATTAQGEGEQFDLEIDFSLLDDMTKNDPFKARVSGYVPPVATPSSKFSTKPAAGGTALLSPWKSPSSSQPLPQVPAPAQSQTQFHVQPQPQPKPQVQLHVQSQTQPVSLANTQPRGPPAIISGSSPKFSVTP

SEQ ID NO: 1019781 - protein, 222 aa, Homo sapiens
KQNGLARKLPRGGGVAEASPEATERVRKMPKGSSGEEEEDIIARLREEGIQKRDDTGMAEESSRTFKMGPRPRSTTGTLHSDDGGHRAGLTSRARGKLHEMLIDLARSVNACRVWETIVCTMRERGDCPDSSVTSKSVWSCTRLVVKSLRKIAVGKDPLEGQRTCCRCCTDAVNTSSLGHARPGRPAAEAPEPIIYPHGDAEGGEPWHRTHQDPWAIDRRRR

SEQ ID NO: 1019782 - protein, 278 aa, Homo sapiens
LSLAGRTPRPRAPPPGSAAATRASLPCGTPSEPGGTLLFFWGRLLFACLFLSGDFCSFPISVFGAHGNPPSSVCRPFFLFWFTFFEILRQGFFYFLPRPLTVLELLGALCRLFNVYRSGLPAAPPPRLAAHCARGAPRLASRAVRGPALCRGLQLEQGARARGSPRSRRKGLLDPDSFLRRADFVFDHSLSAGLRPRAFGAGDGEKTEAVFQLYFLWLGCVVLWAQGTAGQPQPPPPKPPRPQPPPQQVRSATAGSEGGFLTAEYREEGAAVAAASAA

SEQ ID NO: 1019783 - protein, 224 aa, Homo sapiens
EFPDPDSLDFFKEKLGKPGHNAAACFVQGLPGLSPELASPAQGLLASPELVSPAQGPLGLSPELASPVQGPLGSALWPHLVHPGISCALPAPAWASLGTSVLRPTSLSKTPSRGLCRTASLSVPIAGFSHQSSNSYFTIKLKSSSPQLGAAGCLVLGNQGQEAVADINLGDSAPSPEGPAGDRPGPWYSPGGPVLTSYMTPDLQKKDFAGGDGMTQDTIEIERC

SEQ ID NO: 1019784 - protein, 328 aa, Homo sapiens
ITFLANNREKRASPWTEVKHEDTNWLLHPVEGANREILGIIVSYKVKVKLLSRGGDVAVLPFTLMHPKPKENPRIGKFQENETPVDTNLIELDTNDDDIVFEDFARQRLKGMKDDKEEEEDEYRLSTAQQQIDGPALPPHGSGSTLVHSDAYSVFFLFWFFPFVFQFLPGGPVGFQITVTEASGSQDLALTCTTRIHGPTAHLGSIPISAISISPPFHACLPEKSDQGLWTLELDLRWRMQTGEDCGECRDTGVVGMTGLDGVGMRAQDTREDVHGPRWLTKFWQLKDDRVEGHHPFWLGGAELWTDSQCLFEVLTHQRPSAFTLIPT

SEQ ID NO: 1019785 - protein, 76 aa, Homo sapiens
SAIMAGGIPGQSYSRVHITIRVYDLEVESGHPDGAAVIKGSLVQQIKVLRDLSSDRSNPGRFYLLKIPPCPKGQEN

SEQ ID NO: 1019786 - protein, 195 aa, Homo sapiens
MPGHELLVRTCSRIKPWIYPFVRIVDAYSARNNKVSRFPGVALELVGPVATLSLAQGIMDALPIYRELSYYLVVIYNARARVLNRLDSHHLGQGPHCAHTVQLERGRRGNRGQDSNFHIPTALVETSHGLETVGHSRGSIPLRFQGSSSTFLTVRPIDANHCVRRNGGSHCSYTKLCGDAQIFPHSDSLVSPYDD

SEQ ID NO: 1019787 - protein, 142 aa, Homo sapiens
HLPYTDHCPSFRRLDLKNLARWGRYRQREVRALSIHTQLYLGEQGRLEARRRQATGEDGSAAREGPEDGGTESRRQHFRAGSSSGGRRRGGCTGGGNGASNRAEGTPNGSAMLEWKHLQVQDHHRSSCSSTKAKPWRTHGTA

SEQ ID NO: 1019788 - protein, 241 aa, Homo sapiens
MQNLPPVSPYNSPCVPRLGHLPQLAPIIFSSSFILLPEASVSSPSHPNILRLYNYFYDRRRIYLILEYAPRGELYKELQKSCTFDEQRTATVRHRRSQMLYHSHKKVINTHIPENLLLLKALKIAHFRWSVHRPPGQSVGTLDYLPPIRHNKVDLWCIVLYELLVGNPPFESASHNETYRIIKVDLKFPAFVPTGAQDLILQTVSGITPRNGCPWPRSQPTPWVRANSRRVLPPSALQSVA

SEQ ID NO: 1019789 - protein, 103 aa, Homo sapiens
MNHEQLQCVTGVAQLLWGFRLQGGKDFNMPLTISSLKDGGKAAQANVRIGDVVLSIDGINAQGMTHLEAQNKIKGGTGSLNMTLQRASVTQSLSRFLFKRKHK

SEQ ID NO: 1019790 - protein, 177 aa, Homo sapiens
GGLHHYDEFGVLIDNVERDRLRLRPGLRRRGHIDEKVLAFLHAVGRVDQNLGRAVSGARDAALIDQGLQSGAGQRLFSRLAPKGLGEILVEAVPAASGSTVTVWRWPPISTSSEDIMPEDTVQTAEMEMVPSLRTRRMLVAVVIVTAIVLVAGFAFVIATLVKRTSHPQTSTALVGP

SEQ ID NO: 1019791 - protein, 159 aa, Homo sapiens
MEEGGDFDNYYGADNQSECEYTDWKSSGGPPFPAISHVGFSPGPPREKVWCSGTVFSESAGKKEGRFSIILSLSQPGAVGCTTRWVYVCPPGAPYHRYPGDLLYGPYMGNPLSRPGMANPQSFGANNNGGGFWSTGAFKALRTGTLGPIRCRGQGVAKM

SEQ ID NO: 1019792 - protein, 65 aa, Homo sapiens
MGPLGTFCKLSSYLIFVKMASVFCLNGLSLESYNGNREASNARLLRVSGAVAAVLWVLAALLAMP

SEQ ID NO: 1019793 - protein, 96 aa, Homo sapiens
GDGVLCLRESALCSLPYASLYATFPNFRGSLSGAPCSPHAFPRDLLGSDSEPFIWEKSTFYERSFRALLERKPPALRARGGVFPLKTQGPPFCALS

SEQ ID NO: 1019794 - protein, 375 aa, Homo sapiens
GDGVLCLRESALCSLPYASLYATFPNFRGSLSGAPCSPHAFPRDLLGSESEPFIWEKMQLLGAIHYSCHCMEKKQACTESPVSFVLFQLRNAMAATSSYMCALLMRIIKSYTDLELDINFIALFYMTRLTYLRSHNIYLYDKNNRRICAFIINYSWDLILFSTSRLGLLDLGQYIHGISKYLCHRTTKTNTDTPPPRLLSKTYKMRRQSGTHSQDGAQLGYTSNAIEVTQPLNNSFRGTRPPGTEQADNVHSTWTVHPSDSEHWQRSPTRQSRSPQQHAGNTSRNNEGQKPASPPEDQGETGLTKKGKVETVSNELRLGSSGAQEENRGVMTADDREGDKARKRTERHDQARDKKVSKHGGDTRRTHCAYDDASQ

SEQ ID NO: 1019795 - protein, 204 aa, Homo sapiens
NTSPGSMNNFSSTPNCFKVTVELSCDKFPPEDELPQEWENNKNAFLTYLEQVRMGIAGVVRHKDTKFGIADPVIAVEWDYPYVTTRVGRGLLGFLSPGEYMVTASAEGYHSVTRNCGVTFEKGPFPCNFVLTKTPKQRLRELLAAGAKVPPDLCRGLERLRGQKDLYLRFKSPRAGWTWQNGKGKSKKGGAKLGKGGPLSFRAP

SEQ ID NO: 1019796 - protein, 191 aa, Homo sapiens
MLVTHQVQRLCWSAAAKRPLAAWQLSLALLPLQVDCSPSPTVIINFVFAKARQVNLMEMETTTPASLVSDVVLTSAIPQAKHSFYQAHCLAGGRKFHRLSLGSFCRNNPYSSGQGANVSIQLAAKNVYPNKQGRPTDPLDPLEMDLGHSAFHDFSKQRGVVILSKSWRQCQCPATHHVPVLEKPLCTPLCW

SEQ ID NO: 1019797 - protein, 42 aa, Homo sapiens
VHLLFTLSEDYVISLDEPRLPLQLDDAVRPEAEGEEEGRAIM

SEQ ID NO: 1019798 - protein, 97 aa, Homo sapiens
MSFSDTSFLSFSNAGLGGSSQMTLHQLWQWLVLSKCLLEGEDGVHVYPPQLTLPVSLVDVSPNTLFFFSFFFFLSFGSFLFLNWNIFLTQRGSIFHK

SEQ ID NO: 1019799 - protein, 187 aa, Homo sapiens
MDFAGNVKKRSIGAKDNTLDEDSEGSDDELGNLETRKKKKRGLFFLKESMDDEEFAEVDEDGGTFMDVLDDDSESVPELEVHSKVSTKKSKRKGTDDFDFAGSFQGPRKKKRNLNDSSLFVSAEEFGHLLDENMGSKFDKIGMNAMANRDNASLKQLRWEAERDDWLHNRDAKSIIKKKKHFKKKMY

SEQ ID NO: 1019800 - protein, 118 aa, Homo sapiens
MARGVAQVGLNHYIYSLCPCAAVEDTAVTDCALYTMGTRLLPDLCLVLLGLGFEVQRTQQAQQDEMPSPTFLTQVKESLFRYWESAKTGAQNLCQKTYLAAVDEKLKDLYSSVLKGEE

SEQ ID NO: 1019801 - protein, 241 aa, Homo sapiens
SGLLLHTSLALPHHWHQAPDTRSAARRMATHHTLWMGLALLGVLGDLQAAPEAQVSVSAQSSSQDKFLGRWFSAGLASNLELAPGEEGGVVPCCKSVVAPATDGGLNLTFHLPQERDQVLRPEAMLLQPAGSLGSYSYRSPHWGSTYSVSVVETDYDQYALLYSSGQARALCEDFLHGHLSYSRTQTPRAELKEKFTVFCKAQGFTEDTIVFLAQTDKCIDGTIGLPMGLDSLEIPVPSQG

SEQ ID NO: 1019802 - protein, 122 aa, Homo sapiens
CTEALALLWLDRACGIYHGRGAHSHEEPLGPALAGERLAVGERWACANGGRQHSSAGNFNISRIYGKWYNLCIGFTLALAEEEHGQDDSEHAGAGRRRFKAEISMTRTWWRKGVCEETSGAY

SEQ ID NO: 1019803 - protein, 141 aa, Homo sapiens
MKRATCVIPTLSIVLESSWSVGLVFQSAGILSSGGLPSEMEAVWGLLSLPSVAPCPSPVPFHVCLVSSAFTVHHQGDAAPWTLKDTSLPAEQLSPFRRLPPSPPLGSASLSHWSAHCRLSLSLCTFLIVAADLRSQGHLGA

SEQ ID NO: 1019804 - protein, 265 aa, Homo sapiens
FAMRPGAPGPLWPLPWGALAWAVGFVSSMGSGNPAPGGVCWLQQGQEATCSLVLQTDVTRAECCASGNIDTAWSNLTHPGNKINLLGFLGLVHCLPCKDSCDGVECGPGKACRIAGGPPALRVRARLDYRGSRSGLQVCGSDGATYRDECELRAARCRGHPDLNVMYRGRCRKFCEHVVCRPQSCVVDKTGSATAWCVERRPALSPPAPARSFAATTTSPTSPRATCARPPASWAAPSACATRAAAQAPLRSRQVGESAEEENFV

SEQ ID NO: 1019805 - protein, 201 aa, Homo sapiens
LLICGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGTTEKSCTQPSEHWGRSVDYVQVCDSDTMLDPASSVEMVKV

SEQ ID NO: 1019806 - protein, 125 aa, Homo sapiens
NFFAKGWRPAALGGLPRLPWSFQQLFGPAAAPTSFETCTFMLAASCLPVGALGMEEAKKGVPGLLYLGSSPSGCFMDFGPTHSQLFWVAPRSGASRPPGGLTFCFAKFGENRTINQMQVGAARPF

SEQ ID NO: 1019807 - protein, 65 aa, Homo sapiens
MASASPFMILPIQSSVVSVDTLYIFHTLLTLHLITLEPLVVAQRTPLHRRALICWGFCACAFPSC

SEQ ID NO: 1019808 - protein, 82 aa, Homo sapiens
DSKNRSPIVSGKQLKEDDVYNGDHGPGNDIYYKAANVLHTLRALIGDEAFFKITRIAVYGRPDPKPGNFTTRYLGTKDYIKI

SEQ ID NO: 1019809 - protein, 86 aa, Homo sapiens
MGCLPRTLGWEPGTPRTPRPPVQHRSYQEGTGIQGRTPAFFSVSPLFFRGLPQCFPASLQAWRPVLITPGAFCRQGCPTQHRHASG

SEQ ID NO: 1019810 - protein, 279 aa, Homo sapiens
RAVGRGVFFVPASQWPGLLRLVTPLSLKKALGARAPPPQRPAVLRHNRRPRPRSPHRTRPPRAMAAPGSARRPLLLLLLLLLLGIMHLCVNSNVYGDNNGQPDRVHNGQLLCCLLSELTDTKSGPKNIDPLTCHQMPQLVLNQQAPVDKENTSDPSLVNAIGKRTYTQLSNFHENMHHVYSRPAPMSQVYNFVKTQHLFPNAELQKKSRLVESITENPGPDISIKNTRCVKEHPGSTMNQRDPKRSNDAPIQGIPIPTRASAREKTRVNQTRTPQNKGP

SEQ ID NO: 1019811 - protein, 311 aa, Homo sapiens
GDPGAQGIDLEGQLEGAEVCEDRLLRSRPWRGSWGIAPGQKSAWAAPSLPEPARPGRGEMPLWARCRCGPGCGARPGLGAPSQARPQEPAAPAVSSADVDTSGGPVYACSSSGSPYSSPLKMVYFLSPIFLLPHEEVDADCVPGLQRQDEAEDAQGARAGLALGHRLILQALRLVATGVYAGHALVGAGQHGLHFVVPSQHRAQQVASSQWRCEHACLWIIIASIIEQDSVEGDRCLVQTGANSEQLKMPLGAQGLLVPPPLPVHLEDLVARWGPLARPCLVILEVSKGWGSCSPGGPGGQPLLQASEVFK

SEQ ID NO: 1019812 - protein, 98 aa, Homo sapiens
RPPEAEGKSKGGRIEVKQQQMECVHGQVGLTRGCCEPLVRVSPVPSRAIHDLRANVGHPDSSLIKSLILYSSSPFLPPSFLLPIHFIQQIFNLASTMC

SEQ ID NO: 1019813 - protein, 39 aa, Homo sapiens
MCRMNESLGFSLSLHHSATAGPALARLSQPLPTFSYAGG

SEQ ID NO: 1019814 - protein, 159 aa, Homo sapiens
MPSRHASPRGPWYPSSILHRRPCSSPLRGPMMHPSVPSQKTYQGSYGFRLGFLHSGTGKSVTCTYSPDLNKMFCQLARTALCSCGLIPHPAGPRRAMAIYKQSQHMTEVVRRCPHHERSSDSDGLAPPQHLIRVEGNVRVEVIWMAEPLSTCVGGAYNR

SEQ ID NO: 1019815 - protein, 80 aa, Homo sapiens
QRFVRDALFHPVRLARAQVALGAARELRLALEHEPRAHHTGIRRQERGELVANVHEPGARLRWIHFGVRRQIIPLVEPGE

SEQ ID NO: 1019816 - protein, 102 aa, Homo sapiens
GTPPPGFFPPKKNPGAVPPPGFFFGPGGGLLFSPGDPFSPLALFGGPFKPVFSKKRGGGGAGFPGFFSPPGPGGGVFFGGPPPPLGGPGGLAKKKKSFFSPF

SEQ ID NO: 1019817 - protein, 209 aa, Homo sapiens
MRRRRGQSGAADSPGPGAAPASRGLRSREVPPAATMNPEKDFAPLTPNIVRALNDKLYEKRKVAALEIEKLVREFVAQNNTVQIKHVIQTLSQEFSTCHQKPPQADKGAYIGSGPDLLPSHWAKELKGLYLQGMLDRAQWLTLLPNDGKTARLALTIACEGPHTTIVKVGREQLCLPPLQRCLFDRAVSKHEQLDTKNPNVKKTEFGES

SEQ ID NO: 1019818 - protein, 69 aa, Homo sapiens
GKSYKTQTSDSLGNFSFSPPLGTKLVNIQANGYYVDEITGRLSTSVINLQATVDLGEMPTPTVNVLTSQ

SEQ ID NO: 1019819 - protein, 51 aa, Homo sapiens
MLALLRQTFPNTIEHKKHIKAEHADMKFHECDQCKELFPTPALLQVHVNVP

SEQ ID NO: 1019820 - protein, 113 aa, Homo sapiens
PWGGGSQGTKFGILGLAGPAGALNGPQGPEVASSCPKPALAPPKAKGPTMAPQPPGVAVPFRRVPLGPTFRLGWKGRFGPGEVTCFWRGRAAPQSRDRCPNTGFPGGSAPPQT

SEQ ID NO: 1019821 - protein, 118 aa, Homo sapiens
RLLLAKRSANREACEDETPTTHKHSKPARKLLVGVGWNLSSYQFRVSASSPILVTSVQGSLSNKKELVATVWSAESRVQVQIWALHLLVVSPRAVTNLSVPVPSFANEDDTSTYLVEL

SEQ ID NO: 1019822 - protein, 103 aa, Homo sapiens
ARSGSTFGWTGAAVALVLLARELREARVLAVLGKRGVDRVGATLHLVVVLRLADLVALRLRLERIVRTGATGRGRRAAGKAGARELVLDRFLLCKGELLDLHA

SEQ ID NO: 1019823 - protein, 179 aa, Homo sapiens
SGGRRGGGAAAGVIVLAGLGRALSPSALRVSVRPASSQPLTPACVADSSMLAGRLCAVRLDVSRLSGTGVVGAEEEQQRGGGACVPCALELAEAMAYAYLFKYIIIGDTGVGKSCLLLQFTDKRFQPVHDLTIGVEFGARMITIDGQTDKTSDSGIRQGNESFRIQSQGRITEVQQELY

SEQ ID NO: 1019824 - protein, 283 aa, Homo sapiens
QAEQVLGLGTSTHSGRFRGQLQQWLLQICGKCSSDDSLDPCCRKILPDGGLQVVEEQRPLAKEELIAELQDCEGLIVRSATKVTAACHQRQLTNTPRWWARARAQRGGRVLDLGRPQHEGTAASLGSLNTTSNGERAFSACSNSTWQLTHDVPGPQGRGFSPMCIGFRSVQGRANMRQRGRRCMVEPELNGKTLGHSWVWAGLGEEVATRMQSFGMKTIGYDPIISPEVSASFGVQQLPLEEIWPLCDFITVHTPLLPSTTGFLNDNTFCPVQEGGCVVVNCA

SEQ ID NO: 1019825 - protein, 155 aa, Homo sapiens
QAEQVLGLGTSTHSGRFRGQLQQWLLQICGKCSSDDSLDPCCRKILPDGGLQVVEEQRPLAKEELIAELQDCEGLIVRSATKVTAACHQRQLSRWWAGLAQCGECGSGGEGLGFPWEPCRRTLWNDHVPGLADSPRRLLMKDGWERKKFMGKELP

SEQ ID NO: 1019826 - protein, 82 aa, Homo sapiens
MIPSFEIQQAILLWDTADRWASLARDALVHARLPSFAIPYAIDVLTTGSYPRLPTCIRVSSLLAPMFLKTKGFGTGLDCIIK

SEQ ID NO: 1019827 - protein, 56 aa, Homo sapiens
MAGHHMLMASWLHRAVNEVRAAGLYLLSAPDLMPVTAGPLLFKWQLSGGRDESLRA

SEQ ID NO: 1019828 - protein, 117 aa, Homo sapiens
VFSYRDELAFGIVVDREQLDAPWPLLDAVRSSLAELTAAVRNHQRRDAEFVQRQPDMFPENSFGVLRADLVAHDADGDLAVVAQGRHHQQAAGLLDVTLHDVVLDTPTDHVISLVDA

SEQ ID NO: 1019829 - protein, 301 aa, Homo sapiens
AVRRWQLWEEAVWKAEELKPGPIATFRAASLTLTAVPGSETGRMGRLRPESGHCVEPPGAEIRMYRFMRDVEPEDPMFLMDPFAIHRQHMNRMLSGGFGYNPFLQASRNGNIARDQAVQAARMQQRVELSPPLEMLGNVGVVSWNNVWGLMNMIGNMEITTGGNCQNFSSSVISYSNTGDGAPKVYKTSEMRSAPGGIRETRRTVRDSDSGLEQMSIGHHIRDRAHILQRSRNHRTGGQEERQDYINLDESEAAAFDDEWRRETSRFRQQRLEFRRLFSAGGRRAEGPPRLAIQGTESPSR

SEQ ID NO: 1019830 - protein, 35 aa, Homo sapiens
RHEAGRSPPPADARATRRGVGGGGAPAPAGLPGGG

SEQ ID NO: 1019831 - protein, 194 aa, Homo sapiens
LTGKVCCYWLQSNPTPKNGPGPTKTKTAGPDQTEMTIEGLQPTVEYVLSVYAQNPSGESQHLLQTTVTTIPAPTDLKITQVTPSMLERPVDTIQMFSSTWIIELRLTPKEKTGPMKAINLAPDSIIRGCDSGFMVATKYEVSVYAPKDTVDQQTSSGSSHHSGESQHTKKGYVVTDCYHETHHHHVAGEPRLRR

SEQ ID NO: 1019832 - protein, 107 aa, Homo sapiens
HTGKSHKCLECGERRQSTHLIRHQEFIKIKCCRLGVVLTPIIPALWEAKAGRSFEIQEFETSLANMVNPVSTKNTKMSRAWWCMPVSPAIREAEVGESLEPRRRKLQ

SEQ ID NO: 1019833 - protein, 362 aa, Homo sapiens
LELLAIKPEADGSEREIGRVWQKLRVRFRWQPDTCDLLGFCPPFSLLLRSGEPLDARQSRVLGCPTCRMTSLRLKDDLKEESVADQVIILGDSGVGKTSLLNQYVNIDFCNQYKATIGADFLTQEVMVDDRLVTMQIWDTAGQERFQSLGVAFYRGADCCVLVFDVTCPNTFKNPEIAGEMSCLIQASPRDPEYFPFVVSGNNDGARITRTKCAQSGPQAWCYSKILHSPYFEEPSAKEAINVEQAFQTIARNALKQETEVELYNEFPGTVNWTTSDGQVLADKLANAEGQDTVWHTSPFRNPGTPVSAPRYSPLHLPTTILALQFGVQDTPVKRVTPISLTVTPSTHPRLNYNRCHSLRFH

SEQ ID NO: 1019834 - protein, 126 aa, Homo sapiens
HSPTVISGDPNIGCKWHEGPPEWIFYWIAPYYACCGSLTIKFRDEGFAWSAQSLKVLMPKQLLVEIHWEDSMSEQPLTGAALKFAGLKDLAEWIARSLRVLRSQTAAYKDGVTTRSQSQLTEHLSI

SEQ ID NO: 1019835 - protein, 125 aa, Homo sapiens
HSPTVISGDPIIGCKWPSAPPSGSSIGLPHGMPGAALPPVKTASCGDSLGGQHVEGGTHMRWCRTSLKHLSLLSTLTGAALKFAGHKDLAEWIARCLRVLRSQTAAYKDGVTTRSQSQLTEHLSI

SEQ ID NO: 1019836 - protein, 127 aa, Homo sapiens
DRRPAERSSRPIVGSLMLATNPFRAPGILAAGREQDQIGGGDALLGVGGLWGRVLGQIPPDGNDAVGHAMGGRVPSGVALAVGDVRDSPGGSARNLQSLCGDEPVCQQTGAGSIPGAVGGACAQTNN

SEQ ID NO: 1019837 - protein, 108 aa, Homo sapiens
WPGENVKAKIQDKEGIPPGQQGLIFAGKQLEDGRTFSDYNIQKESPLPLVLGLGGGIIEPFFRQVAQKNNWDKMICRKWYGCLHPRGVNCRKKKCGHPNNLGPKKKVK

SEQ ID NO: 1019838 - protein, 49 aa, Homo sapiens
PKTTLVRRFYGAGLGLRNQEADISLHYLFPVLLHSVIVDVKLKSYSCFS

SEQ ID NO: 1019839 - protein, 128 aa, Homo sapiens
QRYWSEVGNNKFGRSMGLVDPGSKLLGVRYCCRKTNKLNIFRSINNRFFPNSAPISIIHVMTFIYDNKGNIAQVATNVTKNGAIQHVAKNFGSHYNHRSITVDRKITREQTNFFIPVLLLQVIKLLVR

SEQ ID NO: 1019840 - protein, 284 aa, Homo sapiens
PRIGGGSGSRMQPRSERPAGRTQSPEHGSPGPGPEAPPPPPPQPPAPEAERTRPRQARPAAPMEGAVQLLSREGHSVANNSKRDYHDAFVAMSRMRQRGLLCDIVLHVAAKEIRAHKVVLASCSPYFHAMFTNEMSDEPAMTHVTLHDIDPQALRPSMDDTFAYTAEIVVGEGNVQTLLPAASLLQLNGVRDACCKFLLSQLDPSNCLGIRGFADAHSCSDLLKAAHRYVLQHFVDVAKTEEFMLLPLKQVLELVSSDLNVPSEEEVYRAVLELGEDVDARSSM

SEQ ID NO: 1019841 - protein, 336 aa, Homo sapiens
PRIGGGSGSRMQPRSERPAGRTQSPEHGSPGPGPEAPPPPPPQPPAPEAERTRPRQARPAAPMEGAVQLLSREGHSVANNSKRDYHDAFVAMSRMRQRGLLCDIVLHVAAKEIRAHKVVLASCSPYFHAMFTSKYPAWAALGAPWVPRVSSCNPAVPRSMTMSDEPAMTHVTLHDIDPQALDPAWNDTFAYTAEIVVGEGNVQVRAPSPGSRCPPTLCLPHLPLGAPETLLPAASLLQLNGVRDACCKFLLSQLDPSNCLGIRGFADAHSCSDLLKAAHRYVLQHFVDVAKTEEFMLLPLKQVLELVSSDLNVPSEEEVYRAVLELGEDVDARSSM

SEQ ID NO: 1019842 - protein, 122 aa, Homo sapiens
TFESSQPAILDFQCSKGGENLSVGQRQLVCLARALLRKNRILVLDEATAAIDLETDNLIQATIRTQFDTCTVLTIAHRLNTIMDYTRVLVLDKGVVAEFDSPANLIADRGIFYGMARDAGLA

SEQ ID NO: 1019843 - protein, 102 aa, Homo sapiens
HGIPPSGLSGRCWWGIKMNTLQTRTRAPQELFVPPETSGPTSEKMLVSFHGSSLRNEATPQYGLEEEAGNGRWQQSLSLECWPLWTSHPFGTPSLMTLAVER

SEQ ID NO: 1019844 - protein, 70 aa, Homo sapiens
LSEEPEPSTMMRLACFERTGEALAKFVGPKPRGECSKPEQLVVTFVPGFKAGVFWAIVSHPADFCGICVE

SEQ ID NO: 1019845 - protein, 159 aa, Homo sapiens
LLELVTAQRVQQVVAEVRIQVQLVAQRIGRAGQLAAADHPLEAAGQAVAMRLAAVGAAAVEAAQAIDQALVHRALRNLVGGVEAGVVTHRGEMKAARPVLPRIAQHHAAVEEVVVLPIGAVVVLAFNAVEQATAGQGRGTRGEAARVPYSHAAELQQLL

SEQ ID NO: 1019846 - protein, 204 aa, Homo sapiens
RPPPGQRAPLGLTDSDPPRGAPGSAHAPPSPLPHQGSPGLPAGSCPRTCSFFTFRSFYLDCRCFSPAGALLSSPPTFCPRFPLFSSCPPPPSLLLGLSPWKSPPHRDPSVNRCHLIGPQTIPGFQHKLGEETREGGERKVGIALGNSCLRSLLAEYFALARSLHPHPSPRSSPTPEDVAKERRARVALPAWNVLCSSVGGWRRC

SEQ ID NO: 1019847 - protein, 221 aa, Homo sapiens
MIGGLFIYNHKGEVLISRVYRDDIGRNAVDAFRVNVIHARQQVRSPVTNIARTSFFHVKAVQHLAGQQSPSQNVNAAHGLPNSSIQMCDVHGCLLWQDQRRKNYPRTILCSIYELLDEILDFGYPQNSETGALKTFITQQGHQESASEKEEQSQITSQVTGQIGWRREGIKYRRNELFLDVLESVNLVMSPQGQVLSGHVSGRVVMKQYQEWVPECKFGLN

SEQ ID NO: 1019848 - protein, 81 aa, Homo sapiens
SAPADTTWSDAPHPWRRYFSRSADYLVVGLPVLILLFIPLFAIFGASSLMMKLLSNAFVCQFLLVCLFRFSEAFLLSTWGF

SEQ ID NO: 1019849 - protein, 177 aa, Homo sapiens
FEKMLGREVERQVRYQVARKTLQLLDEAEGVAQRVRDTLRALDDMLNTHEAEVDRLRAYIQAGREFLDENPEAGAAKAGVIEFDKPRERFARKLANLATLMASHEMSVTQMKLTRAQAVDMLDRFSETASVLVPVWRQHTLALITTKNMNPAMVAEAAKAHQALMRSLSQSLEGINQ

SEQ ID NO: 1019850 - protein, 239 aa, Homo sapiens
RIMAAAALGQIWARKPLSVPWLLCGPRRYASSSFKAADLQLEMAQKPHKKPGPGEPLEYGKTFTDHIIMVEWNDKGWGQPRIQPFQNPHDCTQPPPDLQYSLTAARGHEGRHKGKDTDRCAHLTTLAQHGPECCAQHNAAMMPAESIDKPGARLECIRRLIEVDKDWDPRMTAAPDILCAASAHGNEPSLEMSRSQGALHDDKHCPKRDAYNTWRNPRPEKTLTGHDTKHKHTGAWHET

SEQ ID NO: 1019851 - protein, 182 aa, Homo sapiens
IQAPFREPGFVCLPRGGPHAFPGGFLFYPPPMGGGNRVSPLGVGGLASPRHPREVPPGGFMGWKGLGNFGAGGAPFPGTPQGGSALFGFFTKSLKRFKKKTGRLLKGRCPGGIFGGKGRPPPLGSLLPPPGVQMGLRGAGRPWGLLRNPPLKRGGPPPPRKNGFAAPPARAPEGGGAPPAGF

SEQ ID NO: 1019852 - protein, 94 aa, Homo sapiens
WSRLPFLSCDSMICNEENCSPVRRPYSCMTSPNPLNTWTTRFSGQSGNDVSTRKRRSPCSSVRDSASGTSPIKSLMAWSILKRLIVSSSSAGTG

SEQ ID NO: 1019853 - protein, 67 aa, Homo sapiens
NKTGRNASIHTLLDALERMEERHAKEKIQDLLVDSGKFIYLEDGTGSAVSLERKTLFTRGFLLGVRS

SEQ ID NO: 1019854 - protein, 67 aa, Homo sapiens; identical to SEQ ID NO: 1019853

SEQ ID NO: 1019855 - protein, 268 aa, Homo sapiens
QIIYRHEQANVDLLKPKQIGGIGWRCQGITDVGKILIEKFQLKNLSELQTSFHLVSQRHSTPQNKNAVSVHSNLNSEAVMNSLTQTFATVEVGRWNNNKKSPIKASDLTKFGDCGGSDDEEESTVISVSEDMNSEGNVDFECDTKLYTSAPNTSQGKDNSVLVVLSSDETPPSLEAAENETQELYVLLKIVAKGSHFKWTAQEVCFVTDALSVNDIYSSVWVLIHTILNLGTRKDQATEVAIDGTNTDDGHEDERQVTRRIQSDHDRT

SEQ ID NO: 1019856 - protein, 198 aa, Homo sapiens
QIIYRHEQANVDLLKPKQIGGIGWRCQGITDVGKILIEKFQLKNLSELQTSFHLVSQRHSTPQNKNAVSVHSNLNSEAVMNSLTQTFATVEVGRWNNNKKSPIKASDLTKFGDCGGSDDEEESTVISVSEDMNSEGNVDFECDTKLYTSAPNTSQGKDNSVLVVLSSDETPPSLEAAENETQELYVLLKIVAKGSHFK

SEQ ID NO: 1019857 - protein, 108 aa, Homo sapiens
LVKREKRPQFFRFGDPALVYLVSAHPPGVGRFSPHPPLGGFSVLEKTTPIWGGFLQTLAQKGSGGGKVPQFAPKAPKGLMNFFPNPPPPPFYQGGEDGFQTFFFHWPL

SEQ ID NO: 1019858 - protein, 52 aa, Homo sapiens
ATPNCCIRYPNSIINGYKPSPGLVCGDGFTPFPLAKRSRPSWLITSAFVAAA

SEQ ID NO: 1019859 - protein, 77 aa, Homo sapiens
MLPLIAAAVRRALYEQLIGISQLLVLRWLPSTSLVKLIRIMIKKNRTLSSLLTQNQPHNGLSQSDPAAEPSRVVGHG

SEQ ID NO: 1019860 - protein, 112 aa, Homo sapiens
LGKVNEIAKHKASVEDADTQSKVHQLYSCWSPIASTLPELVQRLVTIKQLHEQAMQFGQLLTHLDTTQQMIANSLKDNTTLLTQVQTTMRENLATVEGNFASIDERMKKLGK

SEQ ID NO: 1019861 - protein, 150 aa, Homo sapiens
MMTRAQPGWGPPGGRLRSGEPRSLEPMLSMPIGPMVTGTVGTMPPVPRSNSVTTPLPWFPALAGVPCPPCATVSPTLPQLGQAQGGGGDQHHIEAATPASHHFPPSRCQTGPSVSLGPLGICLCAVMTFLVSMTHGNTGETGCPSPQQMQ

SEQ ID NO: 1019862 - protein, 226 aa, Homo sapiens
MAALTTLFKYIDENQDRYIKNLAKMGGYPECVCDGQEKRGEYQEDDWKIDCCRCYSSLVGSVELVDIGKQKLPDGSEIPLPPILLGRLGSDPQKKTVCIYGDTWMCSLHALEDGWDSEPFTLVERDGKLHGRGSTDDKGPVAGWINALEAYQKHRPRRFLTIVRFCLEGMEATQALRAYDELDSLPVKDTKGDGSDRGKSPGITYGLRGEEGTTKTSGTGARGRHD

SEQ ID NO: 1019863 - protein, 89 aa, Homo sapiens
FAVTAVGKEHALPLDSFKCTELNKGSTGAPDCDEVVTVAHAAAVLKILTGHECTIIKIPAGHSHAGAANVAQLPGFFFLGDFSYQLPTP

SEQ ID NO: 1019864 - protein, 81 aa, Homo sapiens
AADGRVLGMVDRALTDLGLHLRADLEDDLARVLALLLRELLRELLREALVDLGDVRRVLEDDADDRGLCAVGDAHLSRRAW

SEQ ID NO: 1019865 - protein, 317 aa, Homo sapiens
SRHTSSGHYLLSLQLLLPGLLLLRHHHLYPQEELGSGLQGAPGAEEEVEESSPLQEPPSQAAGTTPGPDPKAYQLLSARSACLLGLLAATNALTNGVLPAVQSFSCSTYVCFSYHLVFGSHCFQSPFLLHGCSVFFCSVLSFCAFFLGVYLMALAVLSPCPPLVGTSAGVVSRGAFLGAVSLLLFSYVKVAASSLLHGGGPAGIAGSRRGHPGGLSARRCCYVPPDQHLSLCSTAERTVQTPCDSLSLGRWGPRSSSHLSFPSMLPPCLSACSPGGPHTGTLVDTYTLHRRSWLSRVGKGKEHGLEPGTSGGCRVSP

SEQ ID NO: 1019866 - protein, 294 aa, Homo sapiens
SAGERRRDRAGRRGWRGRRRLKRERGRERDRGFPSCAWPPSAAARPRPGGVRAAVHGRGVLRRGTRPAPPALLRLLPRGGRPPPAPPRARPPLAAASLPPLRLPRLLEPGGGLWRAPRWIAPLLSMGNMRLPWIVLNSEFGISARPPASSAPRVFFFFPFAFFPFLPPGSPFLLPPPLCSPSPPPAAEKWGRVSASRFPPHRARGEHVGASRARRPASRGPFPGVSTDDSAVPPPGGARHFGHYRTGGGAMGLRAPVSSVAGMGMDPSTAGGVSFVLYTPPPGARRLREGARGE

SEQ ID NO: 1019867 - protein, 108 aa, Homo sapiens
GHEVLRGSIDRSGRVLQLIEGFVPDAAWLDDVETLTYLHSCISTKRHRVRLPEIPMHLDALLVDEPLAGGLEPRLGAQHLRTLSVVGFPTATFPGVLDELNQLAFPYR

SEQ ID NO: 1019868 - protein, 151 aa, Homo sapiens
IRSELIDPGADGLGRRATKVWVDGVLAFDGSASPESTPAFWASGATFEESLDSLHLCLAPASPFASQAVVTVRVVSRIKGGGAVLDETYRFTAEDRTAPKLVASVAVSPRAIRLAFDEPVTAPETNSITITPLGAPVVPVVVMSVNVTASV

SEQ ID NO: 1019869 - protein, 76 aa, Homo sapiens
VVRYPVIELGNVAHTCIRLLVQEPEMEELIGAPEFQGCSESCVGPLHFHAGVKEENLVLEKEIFGNHHGTHAFHKF

SEQ ID NO: 1019870 - protein, 107 aa, Homo sapiens
EVLFQQSKEHKIADSRELAASAEPKPQRLRRLEEPSIPPGPNPASEKTRIQQEQKSIAKNARRVNKTTAYALGPPVASNFEIPQNVTRPSATRRIPVSIGKPKLVEQ

SEQ ID NO: 1019871 - protein, 70 aa, Homo sapiens
VRAMLSQLHWDHVNTQMLADGKMPVVTGNGGDELDVLAGPGFLSGNTVNESEHHQIMHDRQTGIVGSNDV

SEQ ID NO: 1019872 - protein, 100 aa, Homo sapiens
MTPALLAWGALAGPETARVRVVNDDILEVGTLLLEDSVVRALWHELLSSGGASVLWVLDAAGKLVLSGGIDTHTHMQFPFMGSRSIDDFHQGTKAVLSGG

SEQ ID NO: 1019873 - protein, 198 aa, Homo sapiens
SGVARGAEKVVTPPGCRRESLNTSPNSPQGQSSLRPTPHLRQLPGPHSCTGVWGGGAKDQYSQTGTHTGARERGQGPPRTGGGPNRQDTTAGQPRHHAGQAGTEEADGAGYTTEEHWVWGVSSQQSGARNSPQPAQERPRQCFPPGAPCSPAPRYAALAATSAPPLTISSFCHHYGAPVFPGPALMAHLWFLDMTLVY

SEQ ID NO: 1019874 - protein, 77 aa, Homo sapiens
DIEISVKELRTILNRIISKTKELRTKGFSLELCRSMVNLMDRDGNGKLGLVEFNILWKPLAEGPSMLPELTRTMRQQ

SEQ ID NO: 1019875 - protein, 295 aa, Homo sapiens
VTVVLLLLLLLLLATLSTLRRSRDSGGYYHPALLGSLWGFTRLLLPPQSCYNELNWGITLNYMNSTMTTSRMVACRRDSWWKASSKCGESVSPEQVPVRAEEAKDSDTEGDLVLGSPGPASAGGIAEALLSDLHAFAGSAGWDDMRQGSWVAMGLHVYLHCRGRSWCAIPVTAAHSPCLCFPRCHGWTGPPAHMTMPQTVTSLSVPKSYVYPRSPRERSSTNHRHQATHLKVRTPSGLWKHQARNTEYLRLLKIIKSTDHRECCMCQKACRSRNREASGSGHQLVYTGLSYIDAS

SEQ ID NO: 1019876 - protein, 79 aa, Homo sapiens
ALTTLRLWLINLLTVLLAQLRHKAPCTPTFSHYRNYGHYMGKIIWNYKAGTFPEVAYTVWLSFPVSSRFLEVKYSNLVR

SEQ ID NO: 1019877 - protein, 138 aa, Homo sapiens
TSASITSKPATLTTTSATSKLIHPDEDISLEERRAQLPKYQRNLPRPGQAPIGNPPVGPIGGMMPPQPGIPQQQGMRPPMPPHGQYGGHHQGMPGYLPGAMRPVWAGPNGAPFPGWASPDGNEPCNVRWPLLILLHPV

SEQ ID NO: 1019878 - protein, 374 aa, Homo sapiens
MQLSQHLATKSPTITMMLSTEGREGFVVKVRGLPWSCSADEVMRFFSDCKIQNGTSGIRFIYTREGRPSGEAFAELESEEEVKLALKKDRENMGTQIRCTVIQVSTSVATGIAVLKHHRSAISPAYCHTMASSRLQRHPIGLQQGKSMYKLYYRDWNIVPKWDDTDSWNFQGAKHRGSLCAVVFTGSIADKAESNHKERIGAQVHWRSYKSRPSCKYEKQYDAHVKRLLGYASGKVPYDKAGGMQQGYIGLERRQAGLDRIKVESPVHSTREGSDMTRPSDGQSVTDTATRHPKQIVEKDTHHTRPNVSSTAPEPEKHENDATRAQKQKTETQNQKRTKENTTQQHNRHNTTDSKAPSQPPTHTQRHTKRTNPA

SEQ ID NO: 1019879 - protein, 114 aa, Homo sapiens
GSRFYSLTLAEVVLVVAYRLAIAVGGKKEENYPVSLELHQRMQLSQHLATKSPTITMMLSTEGREGFVVKVRGLPWSCSADEVMRFFSDCKIQNGTSGIRFIYTSSKADQVVKH

SEQ ID NO: 1019880 - protein, 228 aa, Homo sapiens
SSGINAELPLWPGRSRLALRWLSHVRRPSRRVPRMPRGSRSRTSRMAPPASRAPQMRAAPRPAPVAQPPAAAPPSAVGLFCCCCPGSAGLSGPDGNHCSWLWLWALLWGTHWVTPLLGASVEEVMLRPAKAWTSTFNPRSLQGNPQARDTREREELVLSYRSTTQSPGVCPEPGDHQSSDEGFNEVLRTVPDLQTDWPTEGGASAGGDGEIELVITDVNLVYTNRIDT

SEQ ID NO: 1019881 - protein, 153 aa, Homo sapiens
MPRGSRSRTSRMAPPASRAPQMRAAPRPAPVAQPPAAAPPSAVGLFCCCCPGSAGLSGPDGNHCSWLWLWALLWGTHWVTPLLGASVEEVMLRPAKADHCPGASGGPAGAAAAALPRVAGRFLGCAGAGHRGSDEGFNEVLKDSARLADGLAY

SEQ ID NO: 1019882 - protein, 142 aa, Homo sapiens
MSKRKLQLLAHQYMISKEFYISESLPEYFAPYQERFRRLGYVSLCDKETCKARELKYVDAVGQFLKLIFHQQVKKALVAGDPADFSDESNTASREKLIDHYLGHSDPALEYARKDYISPLDDLAFDMYQDPEVAQIIRKDEK

SEQ ID NO: 1019883 - protein, 142 aa, Homo sapiens
METASLCLAGVSYEIGAEDDQPHHGSPLIPERWPVSFHLVLTQENGILTILKPELLARYYFKAMMKEFRCEPSSQMIEVQEGQNLKNTITGYRTAYSCYGTVSTLNGEPEQGVAMEAVGLNDCRISGEETVTDEEGTFRSRR

SEQ ID NO: 1019884 - protein, 243 aa, Homo sapiens
THLLRQSQRTPSPNDYVQRVRTECQAYRGTSTEARARKNEPTPHQPGPCALTPCPEPFNSIDRVFRNETLDATHLAEFHQIEGVVRDHGLLAHLMGVLREFTKLVSRNSLKPANPTEPSMEVFSYHQGLKKWVEVGNSGVFRPEMLLPMGLPENVSVIAWGLSLEAPNDDQIWHQQYGWVGPTKVNLQMVYEQPLLPPGCRAEAPSTGGCVTWATLGQVILPESLLCALFASLASDLVFMRPL

SEQ ID NO: 1019885 - protein, 85 aa, Homo sapiens
FSIRIGVHVARVVLDVVGEVLLQHQAELLKEIVHRLLLGRCQFLGITAAAGADPGAEARVGIHQRGAGLAAAAVGDVGVGQLDDG

SEQ ID NO: 1019886 - protein, 48 aa, Homo sapiens
IEALSQSLSGITFICWNQQPPPLRPFSFCRFQQYALHSPGVQHVDTVL

SEQ ID NO: 1019887 - protein, 157 aa, Homo sapiens
AGGRSRLGMEPLGPSPPPPTITESGPGSYAAAGRGGSAGGHFLPVPRADGDAGTGGELLGGPASRALLSCLRPPRGARASPRPPAVLVGPGRVRALQREVLVAPRLQPGTHWAPACRLRPRTRSVGMGPAASPHPGAPGMWQDPALSTSRAPAPRPT

SEQ ID NO: 1019888 - protein, 128 aa, Homo sapiens
SPCRCRGYPVCSSQVCLSVISWFARFHSFLRPGLIPGNRWRKSAVIRHGGGIAGNYQRLGALLATETGDHRAALANVLRAFFAVGDMPAVGDIEQRLIGQQGLDFLEHRQAADARVDYRDRCVTHRVD

SEQ ID NO: 1019889 - protein, 159 aa, Homo sapiens
GGKEPGCPGEGCRRFQARMPRSSRAPLPLLLSRHPGSCPGSYCYCCIATTVAPEWMLGLPGSQLQSVFLSWCSGGLGEWSHGLNALKAELRDWGGMKSSRSEEMQRSRIPSPSPTPTQTQPTNWRVKIKKSYRKHGANDCEMFRFREVRSRGGAEAGVG

SEQ ID NO: 1019890 - protein, 106 aa, Homo sapiens
WSPWCPFGLGGARNRRDTSPESACVPSDYTPLPPWCRALTPTPERTPLGRDATGGSRRDNPKKPRGTHTHTHTHTHTHTHTFDPLLPSPSAFCDPQVQSCAHVDTQ

SEQ ID NO: 1019891 - protein, 132 aa, Homo sapiens
QLPPGDQGVVLHLLLAARAVGLAHLAAIGVGEHRLDARRHVAGQQRGSAGGGDGGEAAVAQAMGLDQAAGFVVQALEVRRIEDGLVIEREGPLLGGEMGRGAIGRALHGLQPGLHQRHGFIRTVARAAEHEG

SEQ ID NO: 1019892 - protein, 50 aa, Homo sapiens
MPVAGLIRGAVDLLGQLALRCDGRLALLLEAAVGVRLGSQVLLGAHQQDG

SEQ ID NO: 1019893 - protein, 64 aa, Homo sapiens
YSTKHKCLPPATRPHQCPELALSQLRFNSWASVRGEQCPHLLLSSSLTPSHPLASDPFSTVVPY

SEQ ID NO: 1019894 - protein, 94 aa, Homo sapiens
RVPGPPGNLRAGSPFPPPGFVSPGPFPPPFCGRVRAPGVGGAKWGFPFSFGSGVCMGKSFFPNAVGGRGVGAGGRWGSPCPRFWVGLPAPGVTQ

SEQ ID NO: 1019895 - protein, 119 aa, Homo sapiens
ITLGGGGIGFLDEAADLEAFLVQALAFLDIAKAGLGVGGHQAEGHQPALLGQLPGAVHGVGESLHIVDQVVGGQHQQLCIITVQAAHVQGGGGNGRCGVAPEWLKDEVQFDPGLVQQAL

SEQ ID NO: 1019896 - protein, 152 aa, Homo sapiens
PTVGMNGEGHIMERTHRKLWAPFPFHSALDRLSAIQIKPSVTRKPDRVGISQNSYSVRLHFLRFQQKAILWVSHSKVLMAHSPCKRPDNLSHPSSAHIARLAGIRNLFSWLIDMFLTGPLWKMCNLIWLGTGPSRYSHMTENSRAQYELWRS

SEQ ID NO: 1019897 - protein, 134 aa, Homo sapiens
PTVGMNGEGHIMERTHRKLWAPFPFHSALDRLSAIQIKPSVTRLRFQQKAILWVSHSKVLMGHSPCKRPDNLSHPSSAHIARLAGIRNLFSWLIDMFLTGPLWKMCNLIWLGTGPSRYSHMTENSRAQYELWRS

SEQ ID NO: 1019898 - protein, 109 aa, Homo sapiens
GGGPPWEFGNLVFSPLLPSAPCDFWAHRGILLPSPRSSSSLRDEGGPQWGPLPSFDPSSHQNLGQINLFLYKDPASGFLSEQPKMDSAGVKWGFPPPPKKLYFKILTPS

SEQ ID NO: 1019899 - protein, 144 aa, Homo sapiens
QRSLCHRQVLIHLAQMELEHFGKTLGLQGARQVKTRLAWPRGPEPHPVRPLLQSIRSLSCSNFQCAGSHGFCCLHGCHVGFIGSQSLVDAHHLLEVIDARLTHHAVRIGMRMARLVHEARLRAQVGNHRRNDAHLAHGSGEALR

SEQ ID NO: 1019900 - protein, 80 aa, Homo sapiens
EGVGAKDPRATPVSPPPRGSGLWWPPLLQDSMDQKTPVRGGLSSGTTPWSPVPGTCSPSGLLTSQKLFRGKSRDVGQTVP

SEQ ID NO: 1019901 - protein, 274 aa, Homo sapiens
VTAACGGNHGCSQSSALRIQSGKPLPDGAFLSGRPGDEGSAGMRNLKKAAKLPVMGLMMGNGVKQWWDLGLRMIIFVAELTYNYGRRETTSLAMTLWESRSLLDRLSATPGSWSGHLTEVAEGVFETEAPGGYKVLFGRIAVWPQSDPVLKVTLAVSDLQKSLNYWCNLLGMKIYEKDEEKQRALLGYADNQCKLEPQGVQGGVDHCTQLLEELAFLGPQKELPDLEDMMKRENQKILTPLVSLTPGATVQVVILPHEICFVGDEAFRELSKMD

SEQ ID NO: 1019902 - protein, 69 aa, Homo sapiens
RSSLRIPPSPTVLHFIKLKQVVDSILTRLVQQIDSAYEEPLVELVTPVPLRTEEGSPDPAFQQAGSLVV

SEQ ID NO: 1019903 - protein, 83 aa, Homo sapiens
LLGWEGVISMEELFADCREMREIRLHRAICGVSGGCCMSWLLNGEGDIGIIAKEARSRCGTSTPDHVSSFVFPALNKDNNAEV

SEQ ID NO: 1019904 - protein, 46 aa, Homo sapiens
MSWLLNGEGDIGIIAKEARSDVGPVPLTTFIGVYFLSQQGQQCEVI

SEQ ID NO: 1019905 - protein, 221 aa, Homo sapiens
GPPLSPWPPPGGGARPPPAPAPVSSGPSLLSLCGRLVPALPVRSGPGRPGARAPPSCPGPRSPPPVPRVPASWRGGGGGAARGARGEARPCPVFVGRLWGGIACVPLPGGPASPSSPPRTVFWAEAGRGRGGGGGQGPPFRAHPLLRTRLAQASLCLLIGGRSPSPPLPSPLPSPARYGPSGPSLSPSFVWSPLLVWNLFASEAISPCFVYTTALVAFGFC

SEQ ID NO: 1019906 - protein, 101 aa, Homo sapiens
HGCAHRNNGRIPVRAVPKHRRCKIFNLVSRQGKNICGSDSDFVIWDQDAVKIVSAKNHQSAAEYNIFEGMELRGAPLVVICQGKIMLEDGNLHVTQWFTDF

SEQ ID NO: 1019907 - protein, 131 aa, Homo sapiens
ERRARRIRAEARGAGHLERRRLHLLGDVHEIGTPIRVIAVHLLVRLPIGARRGDAARRIRGLFEITRGPRRDVGRQEIIERDGHRTGHAEVPIILIGIRVVRVVLARAFGFYDLIDDAGVERSRRQARVCR

SEQ ID NO: 1019908 - protein, 35 aa, Homo sapiens
EIEFTISPPLSPSSSSSSGASTYFRATLAGPLCTI

SEQ ID NO: 1019909 - protein, 112 aa, Homo sapiens
VNPIAVNSLCDVFTENKRVVSIISTAAFGKVAFVAIGATMVGSITFTREEGDYVQKGEEFGYFSFGGSTVICVFEKDVIKLDDDLLDNSMRSLETLVRVGMTLGVSTKTDGR

SEQ ID NO: 1019910 - protein, 185 aa, Homo sapiens
FGPRAQGRPFRPNGLLDKAASNVIASLTCGRRFEYDDPRFLRLLDLAQEGLKEESGFLREVLNAVPVLLHIPTLAGKVLRFRDPDQTPRDLTEAFLAEMEKAKGNPESSFNDENLRIEVADLCSAGMETTSTTLAWGLLLMILHPDVQREPIWAVQGPREEGYRRGPMNFAGTPGAPSTGLTRIL

SEQ ID NO: 1019911 - protein, 185 aa, Homo sapiens; identical to SEQ ID NO: 1019910

SEQ ID NO: 1019912 - protein, 308 aa, Homo sapiens
FGPRAQGRPFRPNGLLDKAASNVIASLTCGRRFEYDDPRFLRLLDLAQEGLKEESGFLREVLNAVPVLLHIPTLAGKVLRFRDPDQTPRDLTEAFLAEMEKAKGNPESSFNDENLRIEVADLCSAGMETTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFTPTLPGCPGPLCEAGGLPAFLSRPRACLGEPLARMELFLFFTSLLQHFSFSVPTGAAPGTICHPWVIFAFPYG

SEQ ID NO: 1019913 - protein, 185 aa, Homo sapiens; identical to SEQ ID NO: 1019910

SEQ ID NO: 1019914 - protein, 185 aa, Homo sapiens; identical to SEQ ID NO: 1019910

SEQ ID NO: 1019915 - protein, 69 aa, Homo sapiens
LTLRWGASSNPPVPNRGHCAGLAVIAVVVIGAVVAAVMCRRKSSGGKEGSYSQAACSDSAQGFDVSLTA

SEQ ID NO: 1019916 - protein, 128 aa, Homo sapiens
FHVCGKMLSSAYISDHMKVHSQGPHHVCELCKQRYLVRYGPMCGRPAAAGRTAADSGLASMQDPPTGCGLPLGGGRAVPVSSQTTSLPTLVSSKIGCRGRGENGVESLGYRAPLPTSCTHQIRIYLPN

SEQ ID NO: 1019917 - protein, 110 aa, Homo sapiens
TAFGGQLPPVAPGRWARQFFVSLLVEGAHLDQARVHPFIEQLDGFALAGPFNAVDQDDHREALLLLQLILHFQQGFAQRRHLGVIGVFVNGVTDFGGFEHGQLRFKMAQD

SEQ ID NO: 1019918 - protein, 307 aa, Homo sapiens
AVTGPTFAVLQRRQRAESTMSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALGAGEDTKKESEAKWRQTASYPPPPKPANEERRGGLPPLPLHPGGRPREALQWVRSPWGWLTVDIQNPDITEFTITVGSQHLDLAQLIRNAQGRRRSSKADIGAPSGFTLSSQWVWTPRMGFVRVQPSTQKHGKLGLPAGIREDRYTKP

SEQ ID NO: 1019919 - protein, 100 aa, Homo sapiens
CERRKGFTVSVVAHGSSETNFFMNTSAKIVCLAWSPDNEHFASGGMDMMVYVWTLSDPETRVKIQDAHRLHHVSSLAWLDEHTLVTTSHDAFVKEWTITY

SEQ ID NO: 1019920 - protein, 42 aa, Homo sapiens
EGGGPTGSPGGSCRPRASQFVPAIYCLRPSLLHFVFVFHTEV

SEQ ID NO: 1019921 - protein, 168 aa, Homo sapiens
LSEDTQGDAVQKTETFHHEQDHPTFNTITPNLSEFAFRAIHASCGHQSNSTNIFFSPVSIATGFAMVFLGTKADTYEEILEGLNFNLTEIPEAQIHEGFQELLHITSNQADRQLQLTTGNGLFLNEGLKLVDKVLEEGEVDHSEAFTVNFGDTEEGQQINDYVEKGLG

SEQ ID NO: 1019922 - protein, 89 aa, Homo sapiens
AYGKAKHDKYMADMDELFSQVDEKRKKRDIPDYLCGKISFELMREPCITPSGITYDRKDIEEHLQRVGHFDPVTQSPLTQDQLIPNYGL

SEQ ID NO: 1019923 - protein, 119 aa, Homo sapiens
AYGKAKHDKYMADMDELFSQVDEKRKKRDIPDYLCGKISFELMREPCITPSGITYDRKDIEEHLQPGEGCGSGSRATGMVLGPHDGPRPFIVTSRVWVIVDPVTQSPLTQDQLIPNYGL

SEQ ID NO: 1019924 - protein, 83 aa, Homo sapiens
IRGRVDLFFQAQARKAAVERQAVLHVGHVRFGEHRGEWQVDFHFLERFRHLFAFEAMDFFLQKLEVHLVAHAADVAALRAAER

SEQ ID NO: 1019925 - protein, 67 aa, Homo sapiens
HGDAGTPQQPLLHFGHIDARSKMLVGALIIVVPFSVTGLCDADPFQASAVIMSYPPILSTVTPPLII

SEQ ID NO: 1019926 - protein, 70 aa, Homo sapiens
MVAKLRAFHPEAQVNPERINLNWIGLDFINGTPRDNKQAGVFEPTIVEVKRLPFATEAAITILRLDDHVA

SEQ ID NO: 1019927 - protein, 130 aa, Homo sapiens
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAA

SEQ ID NO: 1019928 - protein, 128 aa, Homo sapiens
RLDSLTHLFVWRSASIRNVLGLFESASPESPYFSSSFMARFSIAFIPLQGAISSGRPFTTHPSTHLSSIFTFRWSLALSSRLKRSRHDLSSLQPPPPGYKRFSCLSLLSSWNNRHPSPCLANCVRHHP

SEQ ID NO: 1019929 - protein, 102 aa, Homo sapiens
MGHDVDDPHSFHQSKLTNEDFRKLLMTPGCHLPLHQLLSHVTMRCQGSTMRMKTQLHEGRTHTKELLCQAEAKQRNERERELAEKYRDRAKDTGEMAVNHSL

SEQ ID NO: 1019930 - protein, 111 aa, Homo sapiens
TRCKTTEGDAIGIMSGRGKGGKAWGRVVLAPRKLLRDNIRALQNYPAGLGAVASSAFPVLSMRRLEVCLGLENVIRDAVTYTEHAKRKTVTAMDVVYALKRQGRTLYGFGG

SEQ ID NO: 1019931 - protein, 49 aa, Homo sapiens
MAATTSIDTDRGQLNSNKPRTTTTLTASDRSKPSKSTHRPERARTPPAR

SEQ ID NO: 1019932 - protein, 49 aa, Homo sapiens
SVDGGWVVNPAADSSRGYFLVDEADAASRQFQILPLPPGTYSGIDFLVG

SEQ ID NO: 1019933 - protein, 124 aa, Homo sapiens
MAQEKMELDLELPPGTGGSPAEGGGQRRRLGGLRRSNSAPLIHGPQMTSSPVFQVRGAERHGGTAQLFLEAATACCCRPPLAAQLAPKQTRKGQENLNTTEEESTNGEGADPQMQKKPLGKEKI

SEQ ID NO: 1019934 - protein, 131 aa, Homo sapiens
MAQEKMELDLELPPGTGGSPAEGGGSGGGWVASGGLTASPLIHGPQMTLRRMFQVRGAETPWRNSTAVPRGRHVHCLADRVAPPVPACHSEVDLTPASTQRMRAWCLINRETVHATVRCYDLQSATIKPTS

SEQ ID NO: 1019935 - protein, 294 aa, Homo sapiens
RADLGAQLPQQKHTFIRTHPPPDTPPGLWNPRVLLLSQPLDRQLPSPPPGFLAPWTPTAPLDFLVPEGGRMGRGAVVEGGGGGRSGGRGSVGPGRLGLGRNPSKGENLRGLKGTRGLLWRRLGEPTVGWKEKPSLMLFRTEGATYVKPRKAWLALSLRAVSSGLFTGVCVVKRVSNWLTSSSDCRKGLKGGSTRQRRSSQYMFRKKGCLCTPAASPGPPPIRWLGFRFRNFLTRSRASGCEGGQSQAPELIHGFLPVLCGKGRRSSKHVVHKGPQAPPVHSPRCCHCAPESGPC

SEQ ID NO: 1019936 - protein, 78 aa, Homo sapiens
RGRSLVVHLKTVSKESPRAERGPHSSIVTVLKTGFELRRLAHLSGRRGLMIPDLRRRVPMGVTGLALPSNRAPPPSGR

SEQ ID NO: 1019937 - protein, 100 aa, Homo sapiens
FQSQQNSQGGGTVMITSTSQTKGFVFPSIFLLLPFFQKVMWGGEGGPCGPGAQLPGTRVPGKAHLEEESLPPPKYWAALSLPRDHPSLPVMCTIMTNLFG

SEQ ID NO: 1019938 - protein, 111 aa, Homo sapiens
MEHLYRLSRVIQEILAGQTELGNHVVGAGDDMAADIIRLEDVQHLTRAGPQQFRLGIGGKNVPAPTHMRHRVDARIRYTPRENRNDARHILVQHLGNGRDLLRRHDRRDIE

SEQ ID NO: 1019939 - protein, 56 aa, Homo sapiens
MEDEQLKVWDVIGRCLIIDEGEDDLGRGGIPYPRSQGTPGRGWPVPSLHAPLAYST

SEQ ID NO: 1019940 - protein, 198 aa, Homo sapiens
IARNPPEFAFVEFEDPRDAEDAVRELDGKVICGSRVRVELSGMPRRSRFDRPPARRPFDPNDRCYECGEKGHYAYCHRDSRRRRSSRSRSHSRSRGRRSCHAAGAGDEAQAQHLPDDQDLSPSVDQDQLHPEDLALVLLKDRGIPNSRRGQDPDPGLFHDPEAASPALHLQKEVVPHQEAPAEVQVLKEWTEALKFTL

SEQ ID NO: 1019941 - protein, 100 aa, Homo sapiens
PSRPPPPPPPPPPPPPPRPGPPPPPPPPPPPPAPSPPPDGGLGRGRGGRGVAHPQRQDDPGFPDEAQSPDPPQKEVVPHQEAPAEVQVLKEWTEALKFTL

SEQ ID NO: 1019942 - protein, 175 aa, Homo sapiens
IARNPPEFAFVEFEDPRDAEDAVRELDGKVICGSRVRVELSGMPRRSRFDRPPARRPFDPNDRCYECGEKGHYAYCHRDSRRRRSSRSRSHSRSRGRRSCHAAGAGDEAQAQHLPDDQDLSPSVDQDQLTQRSRSGSIKDRGIPNSRRGQDPDPGLFHDPEASFPIRKPPQKCKS

SEQ ID NO: 1019943 - protein, 156 aa, Homo sapiens
DLQKFKKILVAKSKRDTGDLVCTQVDVKIFDGIPVISTPPCGDNCVAPPTQNPTGTGDNGPDHQCGGTSGGELPKPRSASNFRSCGLPVNVATGAMWHQFIDFSIPGRTPDTEISFVRTYTSSPAQQPGPLGIRWQHNYQTHIERSSVPGSQDLSW

SEQ ID NO: 1019944 - protein, 336 aa, Homo sapiens
PLFPGFSRVLLITRSPARTICGIPAGRGHCRFWKMAKFMTPVILGLSPQAGVPVAVPEQFRGYALPASSAKEIGLERLQDWTGATYQDKRYTNKYSSQFGGGSQYAYFHEEDESSFQLVDTARTQKTAYQRNRMRFCPEEPPQRQRSSEHVAVQPEESCLRSANRRRENAFDCEHKVPETTWGLGTRMGSRNHRNPETLQLQFVVSAEVREGVDLPQFDDKCHLQVSEPQDIECVGPRIRTTKPLNASHVAWSTAKGKAHFRVSPQMTLYPKCKTREFVGMLHLAHDEYRHGFVNVPSGHPLQRNVCSKDGPKRSNGGGDTTSGGTRRNIRAVSPP

SEQ ID NO: 1019945 - protein, 200 aa, Homo sapiens
MTRVCFQQNKNIQKWKGGGGGAGEGSVWFGLGRGHGWGQGKGGVEGGVKCALERWLRWVMFCLSTSAEEAGGTEGVGEVVQAREASSLGFRDVAASRFRSRLRSTLMRSWSSMMGDTGGVASRLRASGTFCGSSLKVEAPRPKPSCAVVATGEGRRVWEVADGGRRVRAPGPDGSPGAFRGRRGWGVAAEVGTGGGSGPA

SEQ ID NO: 1019946 - protein, 105 aa, Homo sapiens
MASGSWQEDNNARRGWAESCASSQGPGCSGQGQGGSFSGHRCPAPGGGPATGLARWPQALRTQGRPRIYGKEGAEHLSLGTSRDRHCPQQPQLPPIKGTDAAPCL

SEQ ID NO: 1019947 - protein, 315 aa, Homo sapiens
LSPREQTVSLLCPRVRRSPPAAPWRATTVPDQQKLQDLKDTANRLRISSIQATTAAGSGHPTSCCSAAEIMAVLFFHTMRYKSQDPRNPHNDPLVLFQVAMQLPILYAVVGVKLVSMAEAALLNLRKIRSDLDGHPVPRQVFTDVWHWSLGQGLGCRVVRDGYTGKYFCIIGHAYRVYCLLGDGELSEGSVWEAMAFQIYKLDNLVAILDINRLGQKWTWPVQHQMDIYQKRCEASGMHHRWLDTSVEELVQALARQAPATAFCRPKGEERDKKELVEPPKRGDTRIASRRICPQEPVVVRPGKPGAEVHRALKG

SEQ ID NO: 1019948 - protein, 153 aa, Homo sapiens
GCRRGSRRYLCCVRVCAGPRLPHHGELPQCLTSRSCRILKDTANRLRISSIQATTAAGSGHPTSCCSAAEIMAVLFFHTMRYKSQDPRNPHNDPLVLFQVAMQLPILYAVVGVKLVFMAEAALLNLRKIRSDVGRAPFRVSTSQWLLGGSGAG

SEQ ID NO: 1019949 - protein, 79 aa, Homo sapiens
VEPGDHHAEVLRLGRGHVTAVRADIRRRHQDAEVRRPGHRVERVEHTFRHRVGRIVDPAHVLAELVQKSVTEAMAAARI

SEQ ID NO: 1019950 - protein, 67 aa, Homo sapiens
MQKSALSFSCLGFWNLGWVPCSCITFSTELLSVALGNHHSSSSRAKMPGGPAGFSMRSMQGCRVKAN

SEQ ID NO: 1019951 - protein, 84 aa, Homo sapiens
HTDCRIDDQRPENRDGYVDSTLRPNKATADTISATVIEYSCVLPPTARAKLVRDALALTGNAWTRPAAAFAIPSARNSLFGLTS

SEQ ID NO: 1019952 - protein, 113 aa, Homo sapiens
MGGFDGQEPGDPDGLLQDHLEKVVLCVHVRVVGDDVERGAPGHHLKHEDSQRPPVHAEPVLLSPQIFGGDVIRGSAESARCVTRAQAFLAHAVVCELDVPVRIQEDVVQLQVL

SEQ ID NO: 1019953 - protein, 76 aa, Homo sapiens
MASNMDREMILADFQACTGIENIDEDYYTCLNNNNWDLVSSLSTGVSTTWKNGILQSAIWKVRPYQDLHLIQKVIQ

SEQ ID NO: 1019954 - protein, 76 aa, Homo sapiens; identical to SEQ ID NO: 1019953

SEQ ID NO: 1019955 - protein, 238 aa, Homo sapiens
MTFLRWLRSKNDVLSRSNVCINGNHVYLEQPEAKGEIKDEQPVLLPIPQGLQKEAFVLFYREPGGWVLEVSLLKRGGLSSDRQLSESSTKDSLKSMTLPSYRPAPLVSGDLRKNMVPANSEATKEAKESKKPESRRSSLLSLMTGKKDVAQGSEGENPLTVPGREKEGMLMGVTPGEDASGPAEDLVRRSEKELQLLSPDRQVLELFEDVRYEPELDRSSLNETQFLSEAPQTNCSPI

SEQ ID NO: 1019956 - protein, 113 aa, Homo sapiens
PSEEFPKTLRAGFDRAKMATPMHRLIARRQAVSKDPVRVHWRAGSGETRVNGLVSDPYWDRRRMSVSQTLFWLPGGSGPGDKSGDRGLADFAEDSRVKSAARDRAGFEDNCRV

SEQ ID NO: 1019957 - protein, 40 aa, Homo sapiens
VLEDPVLDEDKADHGTRQTPAARNKTRVVSYRVPTTKRYL

SEQ ID NO: 1019958 - protein, 40 aa, Homo sapiens
GAKILPAALTTCILTGIQRITIAAQGEQQSEENAITKKLD

SEQ ID NO: 1019959 - protein, 133 aa, Homo sapiens
FSYTKFSREKLDTLVEFPIRDLDFSEFVIQPQNESNPELYKYDLIAVSNNYGGMGDGHYTTFACNKDTGQWHYFDDNSVSPVNEIQIESKAAYVFFYQRQDVARRLLSPAGLFGAPASPACSSPPSFEFMDVN

SEQ ID NO: 1019960 - protein, 93 aa, Homo sapiens
CAGSAKVESLGIALLEAVESDDPTALIGLPLIRTCALLRRAGLEPPGMNKGRIILMPNTLDFGVDDSLDLREVLPQRVIEQAARLTHWAAENA

SEQ ID NO: 1019961 - protein, 113 aa, Homo sapiens
VEVDDLIQVGLIGLTDELSRFDAEQGVQFETFATQRIRGAMLDELRGGDWMSRGTRRQQREIEVAVHKVEQRLGRAPSEAEIAAEMGPPLTEYQELLSKVRGTQLVYLEDMSG

SEQ ID NO: 1019962 - protein, 113 aa, Homo sapiens
RGQVGPLQLPACFSGTSRQAAQALGLISNRHAAADHTQPTCPSLTRGPLSSRAQSGSRAQTQPPGAAHHGCGNFQASAQSPAWGQHGGQHAGRWGLGPARMPPRPPPTSTTIY

SEQ ID NO: 1019963 - protein, 106 aa, Homo sapiens
GAVSGAGMRPEVGAVARTTGLPGGPRTLARDCLQPCPAPWARESATRPPPPSLRVRDRPATLYRTSTPRARARAFPVRPVRSRALPLRPQGAGAHRPTPTSRCMQW

SEQ ID NO: 1019964 - protein, 69 aa, Homo sapiens
PLKEEGGHGIAQVYGELADVEEGVLVGHNRLQGQQLHQGPSALNSDEVGGHQRDGLNLHVPDITVMTFA

SEQ ID NO: 1019965 - protein, 93 aa, Homo sapiens
PLKEEGGHGIAQVYGELADVEEGVLVGHNRLQGQQLHQGPSALNSDEVGGHQRDGLNLHVPDIAIDICIDGIVYMENVSFIDRQIDETMVAST

SEQ ID NO: 1019966 - protein, 246 aa, Homo sapiens
EREPGELTLSQPAGVPEAVAAVDVGPDARTVAPAAAMADSGTAGGAALAAPGPLGLVQWLCPVTTLSTFMMPPRGLQGEVALGVVRDDEGPMLKAAKGNVTGQCMTRKRSYGRCLNLKEWILEQLTRLYELPGKMEIPKLEIDLDELLDMEDVTMPGVARVQEELLDLTVTKPTEAFISGLLDKIRGMQKLSTPQEEVRVPDPGRTVAPTGQFAAPNLRSNSITGDLRPGLVHEQALVPCQGLFLP

SEQ ID NO: 1019967 - protein, 214 aa, Homo sapiens
MNEKDMAEGHPVVLNGGRVKNSWYRQHPQPYIFPDSPWGAPLYERYRLASKGTPVEVVLSDELDRPSEKKDNSIPDYFVSREEQLEEICGGKACGDEMVNAAAGRKRHHGGPLTEALAPCARKEGDLPPTVRGILVSQTLESGPCKKERDLITFMLASEICYRNMHLPLDKNSGGKCSTRELTQRIQKPRGHFLCRGPANIGTHVAGCKPVFRA

SEQ ID NO: 1019968 - protein, 214 aa, Homo sapiens
MNEKDMAEGHPVVLNGGRVKNFWYRQHPQPYIFPDSPWGAPLYERYRLASKGTPVEVVLSDELDIPSEKKDNSIPDYFVSREESPGRNLRMGKPGNEMVNAAAGWKRHHGGPLTEALAPCARKEGDLPPTVRGILVSQTLESGPCKKERDLITYMLASEICYRNMHLPLDKNSGGKCSTRELTQRIQKPRGHFLCRGPANIGTHVAGCKPVFRA

SEQ ID NO: 1019969 - protein, 263 aa, Homo sapiens
MDEDGAVFSHQQKVLRLYKRALRHLESWCVQRDKYRYFACLMRARFEEHKNEKDMAEGHPVVLNGGRVKNFWYRQHPQPYIFPDSPWGAPLYERYRLASKGTPVEVVLSDELDIPSEKKDNVYLITLSPEKNQLEEICGGKGCGDEMVNAAAGWKRHHGGPLTEALAPCARKEGDLPPTVRGILVSQTLESGPCKKERDLITYMLASEICYRNMHLPLDKNSGGKCSTRELTQRIQKPRGHFLCRGPANIGTHVAGCKPVFRA

SEQ ID NO: 1019970 - protein, 95 aa, Homo sapiens
MLHPNCGRSLPPLEPSSSIHPQSPACRRDCSCLDSIFHPVCGDNGIEYLSPCHAGCSNINMSSATSKQLIYLNCSCVTGGSASQRQDRALSPGPT

SEQ ID NO: 1019971 - protein, 236 aa, Homo sapiens
MNTHPFYCLQRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQAIPRIATTIITISMILCVPLFFMGCSTPTVAEVYPPRAIKFYTSQSPACRRDCSCLDSIFHPVCGDNGIEYLSPCHAGCSNINMSSATSKQLIYLNCSCVTGGSASQRQDRALSPGPT

SEQ ID NO: 1019972 - protein, 285 aa, Homo sapiens
HDPVFEADPPVNTAAVNLVPGDPRWIGAWWLGLLISSALLVLTSFPFFFFPRAMPIGAKRAPATADEARKLEEAKSRGSLVDFIKRFPCIFLRLLMNSLFVLVVLAQCTFSSVIAGLSTFLNKFLEKQYGTSAAYANFLIGAVNLPAAALGMLFGGILMKRFVFSLQAIPRIATTIITISMILCVPLFFMGCSTPTVAEVYPPRAIKFLHPQSPACRRDCSCLDSIFHPVCGDNGIEYLSPCHAGCSNINMSSATSKQLIYLNCSCVTGGSASQRQDRALSPGPT

SEQ ID NO: 1019973 - protein, 48 aa, Homo sapiens
GVPASRLHPAQRRRLVLVAPRSPELLDDTARANIVLDSQTTVARLNAV

SEQ ID NO: 1019974 - protein, 115 aa, Homo sapiens
TSGAKFRKGHSASSSSRNFLTASFESLFSSCGLLSHLLASTMHAQPDSPTRRAIRESCVVMPCSASTTRSAMSELSRLRVAYITPRSSTSFSRLAWRRIPAVSTSRKRRPWRSIS

SEQ ID NO: 1019975 - protein, 90 aa, Homo sapiens
VFGYPNITGAQMNRNALTFEDVLDGGADIVVFARGQSGPAFDHRDLGAEPAEHLREFQADVAAADDDQMLWHRVEFEDADIREVVDAAAK

SEQ ID NO: 1019976 - protein, 111 aa, Homo sapiens
MQTICYAISFSATTLEFPQPECNCKVFIFNSFIPSIKASMTSSRHISSNLQTIVLHSIESQFYPLHSIVPQVLGSLVAPFIYQFIHFQVLCPVELACFKKVPIAQALETIP

SEQ ID NO: 1019977 - protein, 277 aa, Homo sapiens
QQEQHIDYRFRCILQNGLVFIGTFKAFNKNMNLILCNFDFRFKPKNSKQAREKKRVLVLGLLGNLFSTEEGPPPKTVIARVPLAGAAVGPEIGSVCWQRNPELVVPMPQAPAGLAGAISVGLVGAIPIMVMTPQEKEVLLQPLLLLTRASYCRGSKPVLTLASGGPPPPYGPQEHPSPGMYVALRLWFEASYGSPNVDPPWKRDSTGHAPSGNCGLLPLGCEAFFDPWPQSMEVAPQRRGLDSSGPRYHRPVCFLCCCSWILMGFSGFPYRAPSPGA

SEQ ID NO: 1019978 - protein, 197 aa, Homo sapiens
PDTVPFALVSWLAVRAHTKGGLRFNAAPASCGQPIFQGSSEVFSLNWPLLPAAWPLACSSKSCRCRMGSFSSVYALHISFFMTNSSEGSVRPSLERCHLAQGSLSVGDTDECRIDASHFQELPNKLVKEPGCGPRWRAFNSFCHTIIKNFAFFSFKEVRFWQLHPQGFLKLFYHVDSPEGGEVNIVGFSPLGILGGR

SEQ ID NO: 1019979 - protein, 67 aa, Homo sapiens
PQQTQLQDHPPYHWESASLLRSEETKENEGFTVTAEGKGQGTLSVVTMYHAKGQRSTSPDNNIRTSR

SEQ ID NO: 1019980 - protein, 174 aa, Homo sapiens
MVKPLASQKARVNQAYFACEKNETWLPTSSLSQNFDDEVIPGTQAPEAPPLPLMCHESFIKGQYIDIHVYLRNGKKNPKFFKKPSQPVQLPVLLKWPPFPSPGPRQAVPPSSSPAQPAQEKAGTDWEGDKMGPSVASCPTLLLHAKTEKAAALPAPSSRENPLEGAPPHSFFLG

SEQ ID NO: 1019981 - protein, 95 aa, Homo sapiens
FGLTPVERSETRLICRGVGSAPVIHVTEKGEPGFAAIGFRAESLADLGRMAEAEKLAVEDLDWPGGGKVVRLTDPDGHLIEVVAGQTPAPALPLP

SEQ ID NO: 1019982 - protein, 53 aa, Homo sapiens
FVTLPLASKRRCVRCSSNCSMDKERAVAAGTARRNAILVIEDEPVMRLMAVDL

SEQ ID NO: 1019983 - protein, 82 aa, Homo sapiens
IVELKRSQNLDLKRIPGSMNFSPVMVHSGSAAGGHYYACIKSFSDEQRYSFNDQHVSRITQEDIKKTHGGSSGSRGYYSSAF

SEQ ID NO: 1019984 - protein, 82 aa, Homo sapiens; identical to SEQ ID NO: 1019983

SEQ ID NO: 1019985 - protein, 219 aa, Homo sapiens
CFTQDLSLWECSTWKPEVFCRFACHDEVIQASQEICMMSAPKITFIGAGSTIFVKNILGDVFHREALKTAHIALMDIDPTRLEESHIVVRKLMDSAGASGKITCHTQQKEALEDADFVVVAFQIGGYEPCTVTDFEVCKRHGLEQTIADTLGPGGMLPGNAPSGCLRYPRWRKYRPAELHTGNAGSFAQRGRYGYTQYHFVYVIFQLGRSRIQIKVNFW

SEQ ID NO: 1019986 - protein, 106 aa, Homo sapiens
GDHQVFEDAKVLVDSDDADVRGVGDGHRVAGVPLDAIPTRLVRVRVSEGVPPVVGDERERKRVGRLVHAPHAGDVIRRPVGDERVGVVPVAGGERALVSEVTGHEP

SEQ ID NO: 1019987 - protein, 151 aa, Homo sapiens
PPSPSIFPNPQPPTSFINFQPITSYTQSFNQLTPFHLHLSFQPFYNFFPYTFPFSSTLSFPTPPTLHFIFFLLNTPTFIFLFFFLFSTIFSYTTSPFFPPQAPPPPSPTPPPSLPFPHTAGVLGPGPPGQRQPGPGGAGTQLCGPHLFLVF

SEQ ID NO: 1019988 - protein, 86 aa, Homo sapiens
VPQHFHGMILNVLTGLLFDSDGYYVALAWTSSALMYFIVRSLRTAASGPDSMGGPAPRQRLQLYLTLGAAAFQPLIIYWLTFHLVR

SEQ ID NO: 1019989 - protein, 159 aa, Homo sapiens
MSVSPHPRFPLWQAGVSGWCTCPTSSRGHRPPSGWRGRCACSSRTSCADHLARVRLVLLHGGVAEQAHVIVHIEAEERPALAPRPGDDEVVEGVVVRQDEVLLDEHELLHAGGRQRKSLRSPAAPSSGLLHRVALRTRTVRRSPDPSQELKTSISSSFT

SEQ ID NO: 1019990 - protein, 121 aa, Homo sapiens
QLLRTHKTKKNPSSSYEFSVTALNTSCKKPRERSAMDYYRKYAAIFLVTLSVFLHVLHSAPDVQDGPECTLQENPFFSSRVPQKLQCMGWLLLYSISHSTKVQEDDVWSKRTVTSESTVLV

SEQ ID NO: 1019991 - protein, 44 aa, Homo sapiens
ETSGTLEQLLLAVVKSIRSIPAYLAETLYYAMKGAGTDDHTGSE

SEQ ID NO: 1019992 - protein, 56 aa, Homo sapiens
MTGSRKALPVQVSHTFGPDSAVFDEDNLVSCAGLVPVMALAEQAGLTRLLDNKIHI

SEQ ID NO: 1019993 - protein, 117 aa, Homo sapiens
MADHTPPPRHQQFPPCGCGDGLKPSHFGVRRFLSESVFLGIRPTEDVVTNSIDEAEDRGHGQPQGLRVVQQALGLQAVGEGHPGHVRKRQREAKTVMCHGGEDGLLVPHGIHVERLV

SEQ ID NO: 1019994 - protein, 69 aa, Homo sapiens
TRQSALSPAAVGDRPIPERVQLAALAVPDRVSPLVALGKLVVDEHRAMQRLMQITHEMQDEGEPLEALD

SEQ ID NO: 1019995 - protein, 194 aa, Homo sapiens
MDPANRAAHLTQRLLTFSRRQPIDPQPFSVTTTLQSMADLFRRYTGEGVSLAFELDADLWPVRCDRNQFENALLNLVINARDAMPDGGPLTVSAANTYLDPAFLRPYPEAQAGEFVEVGVTDVGCGMTPDVLAHAFDPFFTTKPLGEGTGLGLSMIYGFAKQAGGVVTLESQVGAGTSVRIFLPRHQGTTADAA

SEQ ID NO: 1019996 - protein, 207 aa, Homo sapiens; identical to SEQ ID NO: 914986

SEQ ID NO: 1019997 - protein, 214 aa, Homo sapiens
MPWWMRLLLAALAFSRSRRRAGSNSKQRHSLRVSSAAADATVAPSGLMVRLRTRDVWPLSSATLAMVGHFQITSWVLCKAMGLKGAPCNGGDQRMGAHLGMGIHGTQTGPRAHIPEANVWITGAPSCGQDIGLPGTPCYGLDSPWMLGECLQRNPATLSRSTRPHIDQVIITTTGQMWSIWGPAHPHTSWLWPLSVATVVFRYPNIMVVDVART

SEQ ID NO: 1019998 - protein, 80 aa, Homo sapiens
HFEIHIEMRSRERGLLAALAALRLDAVEVLLRHVAGDVIAAEARILEMRHLRIDRAHVVDQRGEVLVDQLVGADFARDFL

SEQ ID NO: 1019999 - protein, 110 aa, Homo sapiens
MCARNGQVQRLLVCCPLSPGPGANARPGSMGYFRPADLAIGVASLGRSFRRLQHEPGRESSSPTYHFHTIDRWRTEATAKKDIITRGFTPFLDGVGLKDARQQHAFRMRP

SEQ ID NO: 1020000 - protein, 117 aa, Homo sapiens
EFAHHLTFMLNRIRFRVTIDEESVRSIRYQYPVAHRMAEISRDVIEERTGMRISDSETGLLTGYHQVFLDSHRACPYLRLAIVTATGRVSAHLMRIQLDKVLPHGTKYLMLTGDEAD

SEQ ID NO: 1020001 - protein, 75 aa, Homo sapiens
MGRRLPTLELEKPWGFPTLIPWKKIPFSPVGVIPKGPDPMAFPNIGPPYKGNGKLYRENFGKNPRILVNLFFNPG

SEQ ID NO: 1020002 - protein, 146 aa, Homo sapiens
MGVVTFQAFIDFMSGETPVSDLAGQVMASFKILAGDKSYIAMDELRRELPPDQGEYCIGRMAPYTGPDSVPGALDYMSFSPALYGESDLYATPPGRPRHCAPCPALHLRRRPSPAWVRFQLPASTRVSWGPRGIDPPCPRSDSLQN

SEQ ID NO: 1020003 - protein, 77 aa, Homo sapiens
EDDRRGSTGGLHAAACAAAMSLLIPVKVPAYLSTQHQHRWAAVAFAITAIKGVGRRYAHVVLRADIDLTRAELTEDG

SEQ ID NO: 1020004 - protein, 228 aa, Homo sapiens
MRDTSRLLQNSSKKIEIPEQNPSKALHMNGYEKFSRRRLACPDGGAEPSWRCKDRMVIDRQSLAAHLPEPEGARTRIAGPAGSQPTSQYKVHLDLWVKSLSPQDRAAYKEYISNKRKSMTKLRGPNPKSSRTTLQSKSEAEEDDEEDEDDEDEDEEEEDDENGDASEDGGDSFEASSEDESEDGDENEEDDEDDNADEDDDEDEDNESEGSSPRLLLLTATPQTLTPT

SEQ ID NO: 1020005 - protein, 135 aa, Homo sapiens
MAMQFIFSDTAVLLFDFWSVHSPAGMALSVLVLLLLAVMYEGIKVGKAKLLNQSTGEPANLHQPADLSQRQTGTLQAQIHSLLAESTTGGICVTLAQSLIHVIQVVIGYFIMLAVMSYNSWDCALVLVLGSAVGY

SEQ ID NO: 1020006 - protein, 74 aa, Homo sapiens
MDQTDAAGITLRDAMQAAGLPGTMEAIQSIKRDPSRYLGFVEVHIEQGPVLDSLDLPLGIVTSIDGSRRYTGEV

SEQ ID NO: 1020007 - protein, 95 aa, Homo sapiens
TLIRLFETLRAQGYEGGYDTVRRHARRWQREEVGRTATAFVPLSFEPGEAYQFDWSHEVVVLAGVTTTVKVAHMRLCHSRMFFVRAYPRETQEMV

SEQ ID NO: 1020008 - protein, 139 aa, Homo sapiens
MEVGRFRGCLRGLGPIWAGLGRDPGTQAGGSQLGLPFTTFWSLAGQTRDATSLSKGKFQELLVGIVVRECTLAVGEIKRVEAGGRGGFVQAARKGKLIFFYEWNIKLGWKGILKESGVKHKGLIDIVPNLSEENEVDDI

SEQ ID NO: 1020009 - protein, 170 aa, Homo sapiens
IAGSRMRYNLHEKFSLTPNQNIDCNNLEEKRVNSHSSKSHINGTETVRYQKQGRNLRNSFRILGLRVAGSLSWFPGKNTAFARLRKTLRPLLLTTFPGLFSIGLYSLCLWYTKREITVTNIAKQPRENHGHWFAILKGEAGSLLRNRNQGARENQACVIPQREAHTSTSQ

SEQ ID NO: 1020010 - protein, 85 aa, Homo sapiens
MSVKTGWLWRLGGQTAHPDMLVTKCCLYTEKQTHPQRRGTRSHRNPDLCEEILAFTGPTPSQRTIKKGPSFCFSEATLTSRNEEG

SEQ ID NO: 1020011 - protein, 84 aa, Homo sapiens
GNSAIMAGGQTGGPYRRQVEAVAVAMTRGNQRELARQRNLKRQSDWVKEKRQDDGLFVAARRQRDSEIMQKKQKRATEKKEDPR

SEQ ID NO: 1020012 - protein, 82 aa, Homo sapiens
GNSAIMAGGQTGGPYRRQVEAVAVAMTRGNQRELARQRNLKRQSDWVKEKRQDDGLFVAARRQRDSEIMQKKQNLLAFGLGA

SEQ ID NO: 1020013 - protein, 52 aa, Homo sapiens
MRRLTGSVYPWAPNRRQCCWTWECQSGTCNVNGGWLNGIPHPWPWQQGLPSG

SEQ ID NO: 1020014 - protein, 62 aa, Homo sapiens
QEYAEGPSIKAVLLGCDRGSVTPCCSSPESEMLTRVMELAGLKGCSQTSALSQSKLGAPCPE

SEQ ID NO: 1020015 - protein, 123 aa, Homo sapiens
MCANLVPRPIYQRHPGPDHMASGFISHRPFARSTISRFKRYKQPSFTLPPTRHEDTNFLRECHTRQNQCFYILQVPECPPGEWDTSSDTREAENMLLTLLCLKDTKTLMVGSYLDHESCGLSF

SEQ ID NO: 1020016 - protein, 94 aa, Homo sapiens
MASGFISHRPFARSTISRFKRYKQPSFTLPPTRHEDTNFLRECHTRQNQCFYCTTYLNVQRGETKDTKSYMPAFDVNDEKNCGLCVYAGSQRRR

SEQ ID NO: 1020017 - protein, 87 aa, Homo sapiens
VAIDLAQELSPSAIIQVQRIPPAHVDETTALSCAGNASVLWKPVSKTRLAVYAVGCDPADHAETVQFRLKILDQPSLNTPGPIKLLP

SEQ ID NO: 1020018 - protein, 97 aa, Homo sapiens
RSGEVRRVHIDCRATGEVSNEEHSLRQYGKAGAIRWKGIRPTVRGVAMNPVDHPHGGGEGRTGEGQVPVSPWNTLTKGYRTRNNKRTQTFIVSRRKK

SEQ ID NO: 1020019 - protein, 71 aa, Homo sapiens
SGLQRQGDLHGVVLRDLKALQGIWSFPCLYLTAKLHEGDVMPPGYQTDLLEARELIEKHGQHELVDRLGVV

SEQ ID NO: 1020020 - protein, 104 aa, Homo sapiens
STRDIPIGQAVDDATLLLLRPDGQPCEVDEPGELLIAGGGLSPGYLGDAELTRERFIDLPWQGRTLRCYRSGDLVSRDGQGLYHFHGRSDDQIKLRGQRLSLPE

SEQ ID NO: 1020021 - protein, 111 aa, Homo sapiens
MHNRYSVSIIKPLRQEAVQQNRQRAHHHLCLLHLLLQYPLSSLSPGLPFLPSPPPARPRPPPPAALARACRPGPRGPPCSPGASASPLGAARALPFCFPAALFVSLPFPPP

SEQ ID NO: 1020022 - protein, 105 aa, Homo sapiens
FPCPTCVVFCLCLAKGVPNTGLATAPRIWLGTEGTRDSSLIPRTPLAQSVVLETVPSPAPVLPPLHLPLQVPRGLPTIEAAKQGEPVPTVEWGGWAWTLNPCNLP

SEQ ID NO: 1020023 - protein, 43 aa, Homo sapiens
MHRASSDRVADVLARRAERSDFLAGVSVKQDGRASSFGGTLEE

SEQ ID NO: 1020024 - protein, 76 aa, Homo sapiens
AAVRLGRGKMATVAELKAVLKDTLEKKGVLGHLKARIRAEVFNALDDDREPRPSLSHENLLINELIREYLRIQAEY

SEQ ID NO: 1020025 - protein, 166 aa, Homo sapiens
MVAMAAGPSGCLVPALGYGRGRRLCFQAVSAFGAEFIIGGMQRVRLLLAEVAYAGSCDLLGQFNLLQLDPDCRGCCQEEAQFETKKLYAGAILEVVDENGKVPSSPSFVRSDKPKLFRGLQIKYVRGSDPVLKLLDDNGNIAEELSILKWNTDSVEEFLSEKLERI

SEQ ID NO: 1020026 - protein, 122 aa, Homo sapiens
REGAAGQVRFGRQTYSLEGRGTLRQGDLQLGRRQWQRGEGQGPLSPARKARCGPALRSVWGDLERLFSKLPPAISSLLSSFCLAPVYPQPQIKTPFFQGHYLFFVPFSFCKKHSQKPVQNPP

SEQ ID NO: 1020027 - protein, 129 aa, Homo sapiens
AVGSDDRMVHALTPSWDTAMCLKVRQKFVGQAPDPAGGKPLAVPPVAGLNVVLAHVAGQLMQILGHDFVRIGRRQRHAHLPQVAALDQCEALPLGQADDVCGFDQRNAGAADAVLCVRRECGGSRRVRA

SEQ ID NO: 1020028 - protein, 112 aa, Homo sapiens
GSMAAKAVVRDVARVQGKSYGLADRLSKMIPFEVGMTLEKAYEQEEILRDFIKVDEEAAEIWEMARKLEGVVRNVGKHAGGVVIAPTKLTDFSPIYCDEEGGGLVTQFDKDG

SEQ ID NO: 1020029 - protein, 102 aa, Homo sapiens
SGVVEDTGPQPSLLHPPARPFGPQAPFGGFFLASTPSPKVLAQNFILKVFFSFSKPPPSFPPALPRGQPCCPEGFLGQKKEMGVGGTELMLGFSFNKLVIFS

SEQ ID NO: 1020030 - protein, 135 aa, Homo sapiens
SAVSNGKQHTRIPLQTLIFRRNAKTPELIPTCNYYFLDRSCHSGCCATCTQWLLHSPSLSPGFMAGNRSNSLMSVGVRKHSIAHAPAQPIQGSTEVFIYEHGLITCSLGLGLFKKLPLPHGIIQLSIRIAYLFLH

SEQ ID NO: 1020031 - protein, 189 aa, Homo sapiens
VAGRRLAVLLPLGDFAKMPPYTPFLGTRALCPSHPPMLWVLSLFLLVLPQELEGLPRPPTAPGCRSVPQGRGNVAQGTPGSWDRAGPGPSQGMEAHRGPSSPTLSSPHCLLSLPTLPARAVQLRWDLSISRAGGRIAVLGLCLEPGGSLLLPPSALPETDPCAACPPCPFVPMSGGGGRPTVPEAGHQP

SEQ ID NO: 1020032 - protein, 71 aa, Homo sapiens
MPALLSVASRLLVLPRVLLTMGSGSPSSQTLARSDFGSGYVPGSGSVDFGTWPNEKVAKEIARAAVEAPIS

SEQ ID NO: 1020033 - protein, 70 aa, Homo sapiens
VLVTVAWDDFQSTWHQGVTIQQESSLVHTYAPSVGVQALCWQSVDVRVCRFRYKIHHLMDLPVRNPVPPE

SEQ ID NO: 1020034 - protein, 120 aa, Homo sapiens
MTSCTSPTSDLPSRSKLEISKTPPVAAVSTPPVPRFWSLRFSRIFGKRLSLLSRGSLMCTPARSPVPRLDGQVKMYPKRSSHMNSQPRSWISLSTSLRPRQNLSNTLFMSPPFSMEITRV

SEQ ID NO: 1020035 - protein, 120 aa, Homo sapiens; identical to SEQ ID NO: 1020034

SEQ ID NO: 1020036 - protein, 127 aa, Homo sapiens
EGGMVFLCQLVFSLAVGWRQVRKVFGKLGQGVPGLGGPALSGRRKEVLQSPGLPAVGSTGAGIRANLVGASLISWSAFLNGGGVPPGGLVATLQSLGAGGSRVVIGKIGALMGYATHKYFDSEEDEE

SEQ ID NO: 1020037 - protein, 101 aa, Homo sapiens
GIGERERQKALLLQVRFVDTREGFHDHGHAAEETRAHGRVLAGGSFAVVFVAHHDPGFARRLVLARDLRRFRFGTREGVLHFARRAAERVHGAKEHVVRDV

SEQ ID NO: 1020038 - protein, 115 aa, Homo sapiens
ESQVFCSCSYDATTHFETTCNDIKDIYKRMAGTAFDFENMKRKQNDVFEKLSSDCGRPQPLLPQPVSVLLEGSSILCFPHHVPITHLIDPLTNILNPSDGLGDGGFSILFLGPPS

SEQ ID NO: 1020039 - protein, 121 aa, Homo sapiens
ARIARVATSSADPCACADSDGHMWVPGLTTFLPMGFGSTCKERCSSNKTLEWSQELLEEEQWSLSPELRQTPGHAQNLSAAGWGPAVSVAAAPGQVSSPQEGPLLLCLSGGPDHVAQQLAQ

SEQ ID NO: 1020040 - protein, 142 aa, Homo sapiens
MPLFQSHLYSRQPCGVRCTGPAYRCRKRDVLPSDKVTWLFSNTDKAPRQGTRGRRGQQLAVAADVCPQLHHSFLWLCHARGFKCPCVHVSALQELAAGVLGGPGLCSSISPAAGSPHHRFLSQKRWDGPHELHNMLRGHVLP

SEQ ID NO: 1020041 - protein, 241 aa, Homo sapiens
DKFQNRKPKEGKVFQEPLFYEAPRSVDWREKGYITPVKNQGQCGSCWAFSATGALEEQMFRKTGRLISLSEQNLVNCSGPQGNEGCNGGLMDYAFQYVQDNGGLNSEESYPYEATEESCKYNPKYSVANNTGFVNIPKQEKALMKAVATVGPISVAIDAGHETILPYKEGIYFEPDCSSEDMDHGVLVVGYGFESTESDNNKYWLVKNSWGEEWGMGGYVKMAKDRRNHCGIASAASYPTV

SEQ ID NO: 1020042 - protein, 71 aa, Homo sapiens
IDRARYLSSHNTFSCLSGMPRCYSGLPLMHTPHETSYHLVCSLVFLMGGSLYESDPACACNACALGLCCYY

SEQ ID NO: 1020043 - protein, 59 aa, Homo sapiens
RVLQAALTSSLCAFHLASPVKIEIPLFHVLNALLFKVDPSMSLTLHVHAMLVHLACAVI

SEQ ID NO: 1020044 - protein, 131 aa, Homo sapiens
MRQGRDKYKTLRQIRQGNTKQRIDEFEALNRQARTKRRGVLIQGAASPATLVVFSAPSLGTPSDPSSFRKQFPTEIFWAVIQGGALFVFPSCNSAKQGLDFSADYFGHLPVLWLGSRDWIGIYGCLLKFWS

SEQ ID NO: 1020045 - protein, 81 aa, Homo sapiens
VVIEAELGQRTIETNSEDALVSSCEALQILCTVLHALRRLTGIVLANSSLDIVLHDTYYVGRTANENNLSVHIVIINVWER

SEQ ID NO: 1020046 - protein, 52 aa, Homo sapiens
MALPGTRGLTGFFMHTWQRLMCVRMRPALSVSAEGEPWKLCSGMVVSRSCCW

SEQ ID NO: 1020047 - protein, 124 aa, Homo sapiens
RGERPYVLEPAQQERFSAGDRGVVCDVPHPCIRGSLKKEKPRLHAGIRGFSGLQKAVLALRDTAGLQLLLRAVAFERGLLLDRGDDVLAGGLLFVAILVEEHLAFQFRLVAFADKAEAEEFEDF

SEQ ID NO: 1020048 - protein, 79 aa, Homo sapiens
GHRDDRSVDNTAVQPTETPASGEPMAPLDFDEKALPAPVRAELRGVPADTAHIIEGHLVAAAELLYEDPAQANAHAQAA

SEQ ID NO: 1020049 - protein, 106 aa, Homo sapiens
LDILQSVPVRAGLGGCLRAGVVPSSSPPTRVKTPACRSCDCSPPVPCVWGESVKPPLKWFSSFSGDIQHASSDSSPTIHGPCNELPPFPLSSVDDGVRAGSCSPAA

SEQ ID NO: 1020050 - protein, 113 aa, Homo sapiens
YKRAGEEVFTLIRTTSSSTVSEQNFYVAKSLAALYPETGWGDDTQKIIRNRIGESRGQFYFDVQEGSNWALQREQQRLREERRVQQQMAELHSRVLERYEQLKAGMKDYEGRE

SEQ ID NO: 1020051 - protein, 113 aa, Homo sapiens
EYHNTPLNITAPQIVAINEERHRGGALGYAASESYSCVLIQAPVALTIHCASWLQAASGTVLNSGEWIRQLVCVLSSPEILSPFSSRALPRFASSKKPASPGSVRFSLHLTVP

SEQ ID NO: 1020052 - protein, 109 aa, Homo sapiens
CPLVPRWKKSPKIEPDSDRRIHIQTTQSKTKMKKGLREQMTKKIQLRTLQLTKMNGKLYSHHLDPVWRGNVKFTSFLFGATCFGLPPNPLLPCTVPCGIMGHRTQWVQQ

SEQ ID NO: 1020053 - protein, 213 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLAEGGPEPRSDGAKPARARASALLHGALPLGQAGGQEAGPVKVFPNGAQDKSAKASPGVKGADLPRNPEEKCPTGLPDRARAQGPWSLLWWATEGPRM

SEQ ID NO: 1020054 - protein, 101 aa, Homo sapiens
PKSGQPEPIPAPSVCHFLTAPRKGTKENFFEICDELGVKRPFSVKVFSGKSERSSFGLLEWESKSDALETLGFLNHYQMKNPKGPNPYTLKLGFSPAQHPS

SEQ ID NO: 1020055 - protein, 133 aa, Homo sapiens
MVEIPSNRMDDESCTIAVFCTHESAVCVEVQSANAFKSSSVMSSVAGPHVKRGSNTTSHLHQAVAKATQQPFDVSAFNASYSDSGLLGIYTISQATAAGDVIKAAYNRVKTIAHGNPSNTDFPAAKNKLKAGY

SEQ ID NO: 1020056 - protein, 71 aa, Homo sapiens
EPLFRMCLIRLANGACRETRLIMRRASTWLLAALLSWVSIVACSGGSGDAGDAAEHAAVSGNVGAPGALGD

SEQ ID NO: 1020057 - protein, 77 aa, Homo sapiens
PRKFGHYGRKDGRIQEKFRKGLLHGDKVPFFCKIRERRGSFPEDAKGLDGLIEVPKGLRDHSSLVFGKTEASEVKPC

SEQ ID NO: 1020058 - protein, 68 aa, Homo sapiens
PRKFGHYGRKDWKLHGDKVPFFCKIRERRGSFPEDAKGLDGLIEVPKGLRDHSSLVFGKTEASEVKPC

SEQ ID NO: 1020059 - protein, 40 aa, Homo sapiens
FPASADSNGHRLQRERTLDGFKKYLESGAHGKGQGIDRRS

SEQ ID NO: 1020060 - protein, 51 aa, Homo sapiens
SSSVPPISLWNTGTERLANYTGGIYAEYQDTTYINHVVSVAGWGITDESKM

SEQ ID NO: 1020061 - protein, 56 aa, Homo sapiens
QSAQEVAAGSGEFLFQGHNERVHKPRDCTNLMLLVQHIEQVQPGQLVITQSHIDHL

SEQ ID NO: 1020062 - protein, 88 aa, Homo sapiens
SGGAMVRLKLKDQVWVQVGVGDYIGIYASIRQDSTFSGFLVYSDWHSSPVFAECPLQSELMLSLLEGGCEADNQVIQEGWPPWNIVND

SEQ ID NO: 1020063 - protein, 40 aa, Homo sapiens
MISSQEVGTLITALGCGIDREEYNIYKLRCHNIIIMTDAD

SEQ ID NO: 1020064 - protein, 108 aa, Homo sapiens
EFYRIRRFLLLTSDPGLGPSSGTPAQGPYERGAHRGQGLEVVRSPSRALPLSCSNSTRSLLSPLVHQSFQFDEDDGDGEDEEDVDDEEDVVHDAHDSEAKVASLKMEW

SEQ ID NO: 1020065 - protein, 231 aa, Homo sapiens
VDQAKIVGGHQRTHPQAVDVICRQAQGQVSTEQARADQHHQGSKIKGSKRFPDLAHRRSERLLAVGVRTTGMIVPGRRVRTAKTRGCRGIFCSCQLATCQTLDSDLRGTRCRRILAPPHPCLPCEPQTRARFGWCLKRLPHSTPGHKKAPPDKSDRGLLTFRPRGQERLCGVPGPVRTANLPLRRGMLYPIELLGLMTANRQGARRRTACMLTAQVNFVMSSVGFLSVGRR

SEQ ID NO: 1020066 - protein, 243 aa, Homo sapiens
NLGHLQQGALQPPLTGTMDQAGGEAMWLEKLREVYRKGRVFANPDSACVIGLKKKAVAFPIEIKDTDEHRCHGNSGTLPAVEDAGKRISMAAYVGELEHVTRRTLSMDKGSEASHAHAPPQPPPMPAQRQGSDGAWAVVSGAKQGASLLSPITLASYPLATLPRPPLQAGDLRDQHCTGPPAGWTEVPWGIHLPAHGDVALSVFGGCCPLALAHPMGTSAVSPCWAHYMGQPLLYLAGRLSGA

SEQ ID NO: 1020067 - protein, 68 aa, Homo sapiens
MIAGHLPATISLGVDQTDDHQQPTHSRINEYECYLLQGFNPTSCILTLYGFSVVPLISPPDVPFLSLS

SEQ ID NO: 1020068 - protein, 90 aa, Homo sapiens
YYPPDVQRLFPNSLHLHYKGKRGSTTGQGELKKVRFDPLFSLNHTCAMFRANVNRLFRKTWCTTKRSDRLYAHLMLYAQYHNEELLKPSA

SEQ ID NO: 1020069 - protein, 111 aa, Homo sapiens
LACKALVNQCLQQTMHIAFIEHQLIGQLGHTRASFVLGQGFQEAPGPLTKVLSNRISHQSLKVHELSHGTGPHHSQTSPYSKAASGFRNKFIRHAGRRACTLEPSTASPVD

SEQ ID NO: 1020070 - protein, 46 aa, Homo sapiens
DLQDLEHCQPVEDAEVGERLQATQDKLSVPFSGTSTSGQVTSLLDT

SEQ ID NO: 1020071 - protein, 120 aa, Homo sapiens
MKETIMNQEKLAKLQAQVRIGGKGTARRKKKVVHRTATADDKKLQFSLKKLGGKQYLWYVNEVNMFTNQGNSDPPLTTLKVPGIPLGQLNHFSPLPGHAETKSSLPEIATQHLKTSLVRD

SEQ ID NO: 1020072 - protein, 144 aa, Homo sapiens
QWPWGTHHASHTIAVWRDGRQVYEKPGAKPAYHNQSQGLVSQLQGQSKDMPPRFSKKGQLNADEISLRAAQSFLMNKNQVPKLQPQITMIPPSAQPPRTQTPPLGQTPQLGLKTNPPLIQEKPAKTSKKPPPSKAELLQLTKTV

SEQ ID NO: 1020073 - protein, 84 aa, Homo sapiens
MCGIVISSSCFVQESISERMPWGYPQITMIPPSAQPPRTQTPPLGQTPQLGLKTNPPLIQEKPAKTSKKPPPSKAELLQLTKTV

SEQ ID NO: 1020074 - protein, 151 aa, Homo sapiens
LYRYLPRNDLLDPNQSGFKTSHSTETALLCITEALRTAKANSLSSALILLDLSAAFDTVNHQILLSTLSELGISGAAHAWIASYLTGRSYQVAWRESVSSPRALTTGVPQGSVLGPLLFSLYTKSLGSVITSHGLSYHCYVDAAANLVVVG

SEQ ID NO: 1020075 - protein, 159 aa, Homo sapiens
SGLTPPGRGHSHQLAALLRTLDPRAPQPELVPMPLSRRGRGSRLAGSRAATSNLPRATALSPKSAGRGALSISHAQLLTRRRHSSEQVPPGSEPRADFRSGKWLQEPATGDARDSRQALRARMSSKHRSVSAATLRFEATSIRGRDPSPPGDRALQFPS

SEQ ID NO: 1020076 - protein, 259 aa, Homo sapiens
SGLTPPGRGHSHQLAALLRTLDPRAPQPELVPMPLSRRGRGSRLAGSRAATSNLPRATALSPKSAGRGALSISHAQLLTRRRHSSEQVPPGSEPRADFRSGKWLQEPATGDARDSRQALRARMSSKHRICSQEEVVIPCAYDSDSESVDLELSNLEIIKKGSSSIELTDLDIPDIPGLHCEPLSHSPRHLSQQDPLSEAIVEKLIQSIQKVFNGELKGELEKLKFLGDLSSLSQALPYDETGKSFIHRHIADIVHPLNV

SEQ ID NO: 1020077 - protein, 46 aa, Homo sapiens
SIYRIPASCSHQVHMRVLLPDCTITPNPLYFVVHILIVTDGTRLGT

SEQ ID NO: 1020078 - protein, 111 aa, Homo sapiens
TSRELAKTMTIDQAMASTGKSESAMRRAAHEGGFTFKSKIVDRERDLKLIERLSALRDAGVSRIAACRKVGISDSLLNRLVVDYDFNFPKRWEKRAWGASATARNSANVKP

SEQ ID NO: 1020079 - protein, 178 aa, Homo sapiens
MVAIIPGIELEISGVIAEAGMGTISAGKIRECCPFRGQGAAGIKGALDAGPTGRTGVIDDIEGPTDDKGSLSIPLWDTGVSHCCSVSSVCESNLARHKCLSSSRDGIDSPKTFLISCQVDVGVCCQPVGGDQPSAGNTELSTLSGLQVDLIQVSHLTLRLQEARANKKHITAAVLPGR

SEQ ID NO: 1020080 - protein, 147 aa, Homo sapiens
MVWPVLGGTWAIPHWCSTLTCEELKRSVGKLPSTVESLHIVQEQVHTLLHQDQCQGWRLSAKDFLDRLSSIDKLKASVSQVEADLKMLRTAVDRLCAYSVNIETNENNLESAKGLLDDLANDLDMLLGEVAKDSQNGLKNCVCMAPN

SEQ ID NO: 1020081 - protein, 147 aa, Homo sapiens; identical to SEQ ID NO: 1020080

SEQ ID NO: 1020082 - protein, 77 aa, Homo sapiens
LAAGFWMADTDAAAPFGKNGSNCLPRHPRWLAPIHPLSLSYWRNCCMNHKALGREAGSRFQAELTSDFTFEHRLNQI

SEQ ID NO: 1020083 - protein, 144 aa, Homo sapiens
TRGTRAAWAPGWRAPRGGERACVCVRVRMRGRPALSETGATKKGRVREREGAREERRRRGSSDALPRGRSPRGAAEAPTRGRPSARRPAPAPAGNDEEEQFRQAGTSGWKPAACTAREGRLGPEILKGKGFSGRFWKHSEICGD

SEQ ID NO: 1020084 - protein, 117 aa, Homo sapiens
MPGMSGLDLLKQLRVMQASGMPYVPVMVLSADVTPESILRCEQAGARAFLAKPVVATRLLEVLADVAANIRPEAGIQSVPALPAGDGVLDTAVLDELASLGMGDGFERKFIDQCLVD

SEQ ID NO: 1020085 - protein, 253 aa, Homo sapiens
PAYDHRLANFEAPVPRARLVISEHILWCVSMGQQVRSRGHWTASIAESRHSMSEMAKCSRAEAEAWYQTKFETLQAQAGKHGDDLRNTRNEISEMNRAIQRLQAEIDNIKNQRAKLEAAIAEAEERGELALKDARAKQEELEAALQRAKQDMARQLREYQELMSVKLALDIEIATYRKLLEGEESRLAGDGVGAVNISVMNSTGGSSSGGGIGLTLGGTMGSNALSFSSSAGPGLLKAYSIRTASASRRSARD

SEQ ID NO: 1020086 - protein, 98 aa, Homo sapiens
MVLEVYNIDACLKVYYNSNPYDLVVLIRSRDTTPPEKDHATEKGYFELRPRKALKRLAQALRIGRRARLGSRTAGRWDTRSCACHTWYRSPLLRWRGR

SEQ ID NO: 1020087 - protein, 81 aa, Homo sapiens
VAVDLGEGADARDVAERGGAQARHIGCIDVAHDGLSERMFGLSFECARERQDPIAIEVADNDVRDLGVPLGEGAGLVEDDG

SEQ ID NO: 1020088 - protein, 76 aa, Homo sapiens
TGDGGPGKGPRCQLNVSYLHSSSGYLDPDVANHLDHVDPPFLGPVPLAGCGIGQRSPTNEVKGAHKIGYRSRRYSP

SEQ ID NO: 1020089 - protein, 101 aa, Homo sapiens
HRDRTGIGQGHQVDATLGLPVLAIQIGVALLFDFLNGLHDAANSIATIVSTRVLRPQYAVLWAAFFNFIAFLVFGVHVANTIGTGIIDPSVVDATVIFAAL

SEQ ID NO: 1020090 - protein, 52 aa, Homo sapiens
AAGGRRGEGWPSRDLIPEPAVNGEGSGSAFLVDERLNPLNFFLSIPNSTIYN

SEQ ID NO: 1020091 - protein, 290 aa, Homo sapiens
RFRTGAPMAEQTLGPVSAASNVTHGKGQHQPPAPLGEDSAWGSADWFRIMELQMSSFLPGDVLGERRVVYTPAVLFAATLYFHEGCLPPLTHGAPGAAAGTNGEVGPLMWPYRGGGVDPGAGASLATCFVHRASPYYKLSELSKELPFTPVFMTMLHLAVIFLFSVLSRALVQGSSHRARVVLSWADYLRRVAPTALATALDVGLSNWSFLYVTVSLYTSDHNPQLTTSDMTFSLIFKLEELRAALVLVVLLIDGGLFMFTYKSTQFNRGGLRLACWGASFIGGIRWTFT

SEQ ID NO: 1020092 - protein, 1864 aa, Homo sapiens
MSQKSWIESTLTKRECVYIIPSSKDPHRCLPGCQICQQLVRCFCGRLVKQHACFTASLAMKYSDVKLGDHFNQAIEEWSVEKHTEQSPTDAYGVINFQGGSHSYRAKYVRLSYDTKPEVILQLLLKEWQMELPKLVISVHGGMQKFELHPRIKQLLGKGLIKAAVTTGAWILTGGVNTGVAKHVGDALKEHASRSSRKICTIGIAPWGVIENRNDLVGRDVVAPYQTLLNPLSKLNVLNNLHSHFILVDDGTVGKYGAEVRLRRELEKTINQQRIHARIGQGVPVVALIFEGGPNVILTVLEYLQESPPVPVVVCEGTGRAADLLAYIHKQTEEGGNLPDAAEPDIISTIKKTFNFGQNEALHLFQTLMECMKRKELITVFHIGSDEHQDIDVAILTALLKGTNASAFDQLILTLAWDRVDIAKNHVFVYGQQWLVGSLEQAMLDALVMDRVAFVKLLIENGVSMHKFLTIPRLEELYNTKQGPTNPMLFHLVRDVKQGNLPPGYKITLIDIGLVIEYLMGGTYRCTYTRKRFRLIYNSLGGNNRRSGRNTSSSTPQLRKSHESFGNRADKKEKMRHNHFIKTAQPYRPKIDTVMEEGKKKRTKDEIVDIDDPETKRFPYPLNELLIWACLMKRQVMARFLWQHGEESMAKALVACKIYRSMAYEAKQSDLVDDTSEELKQYSNDFGQLAVELLEQSFRQDETMAMKLLTYELKNWSNSTCLKLAVSSRLRPFVAHTCTQMLLSDMWMGRLNMRKNSWYKVILSILVPPAILLLEYKTKAEMSHIPQSQDAHQMTMDDSENNFQNITEEIPMEVFKEVRILDSNEGKNEMEIQMKSKKLPITRKFYAFYHAPIVKFWFNTLAYLGFLMLYTFVVLVQMEQLPSVQEWIVIAYIFTYAIEKVREIFMSEAGKVNQKIKVWFSDYFNISDTIAIISFFIGFGLRFGAKWNFANAYDNHVFVAGRLIYCLNIIFWYVRLLDFLAVNQQAGPYVMMIGKMVANMFYIVVIMALVLLSFGVPRKAILYPHEAPSWTLAKDIVFHPYWMIFGEVYAYEIDVCANDSVIPQICGPGTWLTPFLQAVYLFVQYIIMVNLLIAFFNNVYLQVKAISNIVWKYQRYHFIMAYHEKPVLPPPLIILSHIVSLFCCICKRRKKDKTSDGPKLFLTEEDQKKLHDFEEQCVEMYFNEKDDKFHSGSEERIRVTFERVEQMCIQIKEVGDRVNYIKRSLQSLDSQIGHLQDLSALTVDTLKTLTAQKASEASKVHNEITRELSISKHLAQNLIDDGPVRPSVWKKHGVVNTLSSSLPQGDLESNNPFHCNILMKDDKDPQCNIFGQDLPAVPQRKEFNFPEAGSSSGALFPSAVSPPELRQRLHGVELLKIFNKNQKLGSSSTSIPHLSSPPTKFFVSTPSQPSCKSHLETGTKDQETVCSKATEGDNTEFGAFVGHRDSMDLQRFKETSNKIKILSNNNTSENTLKRVSSLAGFTDCHRTSIPVHSKQEKISRRPSTEDTHEVDSKAALIPVWLQDRPSNREMPSEEGTLNGLTSPFKPAMDTNYYYSAVERNNLMRLSQSIPFTPVPPRGEPVTVYRLEESSPNILNNSMSSWSQLGLCAKIEFLSKEEMGGGLRRAVKVQCTWSEHDILKSGHLYIIKSFLPEVVNTWSSIYKEDTVLHLCLREIQQQRAAQKLTFAFNQMKPKSIPYSPRFLEVFLLYCHSAGQWFAVEECMTGEFRKYNNNNGDEIIPTNTLEEIMLAFSHWTYEYTRGELLVLDLQGVGENLTDPSVIKAEEKRSCDMVFGPANLGEDAIKNFRAKHHCNSCCRKLKLPDLKRNDYTPDKIIFPQDEPSDLNLQPGNSTKESESTNSVRLML

SEQ ID NO: 1020093 - protein, 134 aa, Homo sapiens
MITLAGAMSTAELGLTLAEKIRADKVHLISCTGANLEEDIFNLVAHDHYERVPHYRSLSAQDEQALLDKHMNRVTDTCIPEGEAMRRIEDVMLNLWAKAEKEGKRYFPHEFFFQAVRSGELKKHYQIDPKDSWM

SEQ ID NO: 1020094 - protein, 393 aa, Homo sapiens
GRIPGRCLAATEREKRPRDAKNTMILEIWYQVAGETRRPLCRYGAYPLRTGCAPDTDDLKQRAKGVDRYISKYERDKAFSDRNTLIIYLDKVSHSEDDCLAFKVHQYFNVELIQPWSSQGLRLLQPVRKAVPGSTIRKKEDGKLNKLCRDRTVPACADVHDIAFITNSGTDRVTLDTNGWTRPVSHGVDYVYNDPTGQGSACPSDFVRVTFNGPLMQTYSSSVLVTEGATVVIMERHRFTLAPVTWCTQNAPASLAGRQKASIPFTVVVCLLPYVMRAVMNAHKASADIQSAEAHSLCRAELTELRGYVTRTGQRTAHDETLRNSKCPWQLSSRPFRPDDAIGSDHIWGVRLKSLTSSPKFLPQFPRVKAFRVYYSSKNSGSHKDHRQPTDGN

SEQ ID NO: 1020095 - protein, 107 aa, Homo sapiens
MPTETKRERPHQMKKIPHLEGEGQKPAGISWGGKLANLSPNFRWAIPNRHIEHNEARDDVERFVGQMMEIKRKTREQQMRHYMRFQTPEPDNHYDFCLITLNPKSFR

SEQ ID NO: 1020096 - protein, 36 aa, Homo sapiens
MVDDVSFHALSPALSVYPRCSRRQRPYAERLEWRGV

SEQ ID NO: 1020097 - protein, 79 aa, Homo sapiens
RGRHGEKTTEGDLPARCLCCTRVCLLCPLFALSRHILQRASRMAHKQIYYLDKYFDEHYEYRHVYVYPENFPNKDLKLI

SEQ ID NO: 1020098 - protein, 157 aa, Homo sapiens
MTGYAVPPFEGHESTCVELGRLTSSGLAAWRLVVIDPYCAYLGVMYLPGKWNKGWHAAGSDPSWKCICYFVRRSTQGPFDDIAWVSADRGIWPQLVGMTRSSVFQEDPELGSTCSLERSRLDMPILHQAHSPRTVKLCGLESSKEPEATGTSCSDDW

SEQ ID NO: 1020099 - protein, 204 aa, Homo sapiens
MGSNVTNTTDPRSMNSRVFIGNLNTLEVKKSVYGSSFDLDYEFQRDYYDKMYKLPSTCTLNLSLTIAQGCNALKTSAVSGNTSRRGKSGFNSKSGQRGSSKSGKLKGDDLQAIKKELTQIKQKVDSLLENLEKIVKEQSKQAVEMKNDKSEEEQSSSSVKNDETNVKMESEGGADDSAEEGDLLDDDDIEDRRDEHLEFIKDDD

SEQ ID NO: 1020100 - protein, 74 aa, Homo sapiens
FLIGVVPTYDSIGIWAPILLLLLRVFQGIGLGGEWGGAVLMAYEYAPPEKKGYASLPQIGLAIGLCLASGTVAL

SEQ ID NO: 1020101 - protein, 75 aa, Homo sapiens
SRGSVFCLASCILGLPMSVTCTYSPASTRCFANCQDLPVQLWVDSTPPPVSRVRAMSIYNQSQHMTDVVTGCANH

SEQ ID NO: 1020102 - protein, 63 aa, Homo sapiens
GLAQSGGDREERLTRTGFTHERHELHLVVEEEIDGERLFGVAGIHTPQAFLRLHHGYHRVLHE

SEQ ID NO: 1020103 - protein, 31 aa, Homo sapiens
RICRLHMRVTLLTLLPAEPPGFTLADCSPSS

SEQ ID NO: 1020104 - protein, 105 aa, Homo sapiens
KSYLQKITWICCKPPGVCTVILLSGLVEGSIQYLYLPWTLQAYVPYMTEHLAQQSEFAATLLLLWAPLKTGRLTNSFVNGPGQHGKMCCILPPKTPVKYFFLTLS

SEQ ID NO: 1020105 - protein, 105 aa, Homo sapiens; identical to SEQ ID NO: 1020104

SEQ ID NO: 1020106 - protein, 105 aa, Homo sapiens; identical to SEQ ID NO: 1020104

SEQ ID NO: 1020107 - protein, 82 aa, Homo sapiens
VTPPLFVQACSCWASKQPLSEKRKKVDRSRKETKLFYACEFPHRYKTHTNKKSLERDFNKYLKQGKARKISGSTSNLYVQRP

SEQ ID NO: 1020108 - protein, 76 aa, Homo sapiens
PGSHLAKKRNRNRKKGWNKLEQGKTGCQGTWVGDTTLPLTSSMTLINKFNPPRPRFHIHENRIVMDRTSQSWKDQM

SEQ ID NO: 1020109 - protein, 44 aa, Homo sapiens
MAMPDSPTLFVSAMMHTVYVKPVSSCSSHYLGANFCGGSVTLVR

SEQ ID NO: 1020110 - protein, 169 aa, Homo sapiens
HELTLKEEQEEYIREDIEWTHIDYFNNAIICDLIENNTNGILAMLDEECLRTGTVTDETFLEKLNQVCATHQHFESRMSKCSRFLNDTSLPHSCFRIQHYAGKVLYQVEGFVDQNNDLLYRDLSQAMWKSHALIKSFVKEIPDQPGPLQQAHSQGRATLMPTDQDPNYR

SEQ ID NO: 1020111 - protein, 140 aa, Homo sapiens
MPLGITPATSPLRALYHGPPWSKEPSIFPGKSFWPSLASLALQVFHEGPPMVLWALSISDSLAKNGVRRPQVLLKPLRFVVGVLQKGLPSPGVLALTPAFHFVVKVAAPSWLWPSSWGAPSRAAQGLPLPKFKPLWPVAL

SEQ ID NO: 1020112 - protein, 101 aa, Homo sapiens
AFEQRGALVLDVFGIDVAQVDLGTVGDAGMTHRFDQRLVGVQQLHVLADHGDGDFMLGVELGVHHLFPLGQVGAVALQAETLDDEIVQALGVQHGRDLVDG

SEQ ID NO: 1020113 - protein, 55 aa, Homo sapiens
NDVDLAGYLFNVFSVGWILEALLSDLRNFAAHTAQANLGRAVVELVGCLLATGFI

SEQ ID NO: 1020114 - protein, 164 aa, Homo sapiens
FKDHLRVTSVAVKGCQVFLRACAEPKKQWKDFHLAFCLPRVQDPVTRHLLKIGKHIPAKGPPVAAAVEEVGLEQVGDVKVLGTRFKPQERVGSLAAGVTEVAPQKVLDLGIPAGAQPGHHHFCCDQNIGGGSQGLKKGGPFFLNGGPKGPAVGFHKKDHGRFGG

SEQ ID NO: 1020115 - protein, 38 aa, Homo sapiens
SPRAPWAFSQAKENLSLREEDRSPATARSQVSHSKTVV

SEQ ID NO: 1020116 - protein, 318 aa, Homo sapiens
MQSATPRRLPASSQGTVQVLLPRTTGPWLVAACDGSPQDHSPLARLTGDCHINEKVVHYLTMGATLCSAEMLSAFLAPDTWEAKGSLGGLVPALQDAPEEAPGFLNAFSRPCLQPFSRPSEFQTALTFVWSSVPRLAPPSSGQLLSTRGTSAPGAHSAMSGTVLAVTAGRGHHRNLVCRGGGPAQMPEVLQVRDTDLDPVTTKKRTGKVALKAPGNRPETPGVPEAGKAWSGAGTSLCGGWRCGDGDWSCLHTLNQNPPSSPSPATKPARRHGGWRWREASVLDCLSPLLRTTPRVAPSLPHQPRPKASSSSASRPGT

SEQ ID NO: 1020117 - protein, 318 aa, Homo sapiens
MQSATPRRLPASSQGTVQVLLPRTTGPWLVAACDGSPQDHSPLARLTGDWHINEKVVHYLTMGATLCSAEMLSAFLAPDTWEAKGSLGGLVPALQDAPEEAPGFLNAFSRPCLQPFSRPSEFQTALTFVWSSVPRLAPPSSGQLLSTRGTSAPGAHSAMSGTVLAVTAGRGHHRNLVCRGGGPAQMPEVLQVRDTDLDPVTTKKRTGKVALKAPGNRPETPGVPEAGKAWSGAGTSLCGGWRCGDGDWSCLHTLNQNPPSSPSPATKPARRHGGWRWREASVLDCLSPLLRTTPRVAPSLPHQPRPKASSSSASRPGT

SEQ ID NO: 1020118 - protein, 109 aa, Homo sapiens
MSYVPGYWIRMSRLMVSIITSMGIRGVRVPCWSAVMSYGPEQPGVIPRALMDLLQLTREEGAEGRPWALSVTMSYVEIYQEKVRLFSDRGRKRQRVKSDLVVEPVRHNR

SEQ ID NO: 1020119 - protein, 172 aa, Homo sapiens
LTPCTKYTLLSFSLFPRSPFVQSNTGFWLNSAILIGIISVVPLLFLFFFLRQSLSLSPRLQFTGVISAHNLCLPGSSTSRTSDSRIAGITDRHHHTQLILVFFAETGFRQVDQPSFKLLTSGELPALASQKCMGLKSTCSHRLPWTYFHSSCVNHHFHSSLATMPVLIFFMF

SEQ ID NO: 1020120 - protein, 74 aa, Homo sapiens
KSGINAEGPLRPGARHLGAAGTRVGWRLPDVGSLWGRVLRPCFSLLFHSRPRCRSTRPGRSSAALRRSFTSLTL

SEQ ID NO: 1020121 - protein, 74 aa, Homo sapiens; identical to SEQ ID NO: 1020120

SEQ ID NO: 1020122 - protein, 95 aa, Homo sapiens
IAAEGPTCSSKEISSSPDNHQSPAKRLNRTEQDVIANSPSNPQACTSKEWSTPEHRQQSSCFASGNMREIGGFLLNPTAEDFSSFTSSLLQYPPG

SEQ ID NO: 1020123 - protein, 93 aa, Homo sapiens
PCPAAEPRRNKPNKYRAGASCREFSLTASYTEPQERERNSSTFFSEARHQNTTKTAFVPTDASRATTAQKPRCRQTFAKSQHNAPNGAPAGRE

SEQ ID NO: 1020124 - protein, 226 aa, Homo sapiens
MVDLEGFYFGTYEDEVREWIDGRSGLNPVIRFDCSEITADIESFNWVGLNLTDDGFWFEDTKWFIVDRIDSLSAENFRQLITHLHDMETKLVIAFVQRTLNDTITKRSVQAIGSDAELYPRPIPAISDHDDLVEWVVGWLDRHDVGIQRKTVNRMIEFTGNVDQTPLVELCVTLASGFRGRTVSAADVKAQMGIDGKLDSYHLMTTLQAGDAESAIDIIRRADIEH

SEQ ID NO: 1020125 - protein, 39 aa, Homo sapiens
MSHRRRCRSPSPQCRRRTASRNRGRTPEDHPRSDRAACC

SEQ ID NO: 1020126 - protein, 122 aa, Homo sapiens
RARPRSPEGGGEAILSRPTPRNRAERLGEAAEPRSPPSEALDAATVRAFSKLFVCRPRRLEPFFHAITVLRPENALNEELAALEGPIPWGLRRREPEPLLPMVKRPTCFSLLLIGDPGVGFT

SEQ ID NO: 1020127 - protein, 120 aa, Homo sapiens
RARPRSPEGGGEAILSRPTPRNRAERLGEAAEPRSPPSEALDAATVRAFSKLFVCGPRLLEPFSYASSDLLPENALLRRRPHWGPIPWGQRRREPEPLLPMAAKTCVLIRFSDGLPYYLF

SEQ ID NO: 1020128 - protein, 37 aa, Homo sapiens
MAKKTYYLLLLLLIGDSGVGKTCDLCGCSDDAFYYVF

SEQ ID NO: 1020129 - protein, 92 aa, Homo sapiens
MKTLMRHGLAVCLALTTMCTSLLLVYSSLGGQKERPPQQQQQQQQQQQQASATGSSQPAAESSTQQRPGVPAGPRPLDGYLGVADHKPLKCT

SEQ ID NO: 1020130 - protein, 253 aa, Homo sapiens
SGFISLGTKASVGVATGSRLHVQLEDPRAQPGSGWHIAEAAGRAGGACCCNQWPRGCYEWTVHLEGGPRRVNHAAVAVGHRVYSFGGYCSGEDYETLRQIDVHIFNAVSIALDKAAPGEDSHPWASVLLVPYMRYWTTQSVLYRTTTVLLEGRARMTAEGVLASVLYAFESADCLTNDMHKLDTSTMIWTLICTKGRPARWRDFHSGTMLGKSHVCLWGPCRSIWGHSIPINEIYVNRIRVFEHQKLRLGWTV

SEQ ID NO: 1020131 - protein, 249 aa, Homo sapiens
EISPRGPKEVLNGCLGFDWSKNPRAQPGSGWHIAEAAGRAGGACCCNQWPRGCYEWTVHLEGGPRRVNHAAVAVGHRVYSFGGYCSGEDYETLRQIDVHIFNAVSIALDKAAPGEDSHPWASVLLVPYMRYWTTQSVLYRTTTVLLEGRARMTAEGVLASVLYAFESADCLTNDMHKLDTSTMIWTLICTKGRPARWRDFHSGTMLGKSHVCLWGPCRSIWGHSIPINEIYVNRIRVFEHQKLRLGWTV

SEQ ID NO: 1020132 - protein, 164 aa, Homo sapiens
RRTGSGLRRDWERAPQRTLARGSAQSVCEDPARRPPGDPMASEGLAGALASVLAGQGSSVHSCDSAPAGEPPAPVRLRKNVCYVVLAVFLSEQDEVLLIQEAKRECRGSWYLPAGRMEPGETIVEALQLEVKEEAGLHCEPETLLSVEERGPSWVRFVFLARPT

SEQ ID NO: 1020133 - protein, 45 aa, Homo sapiens
RPGDAHEHEPPDRAEVVGGGGDIQEVVHQDGAHEGERGEYAEEFV

SEQ ID NO: 1020134 - protein, 86 aa, Homo sapiens
TCGVAAPLRAGIRDGSETALPYRCPAQGEGQMESPDASQTTWLPKGKAGEAPWCPWWRAPQGVKGFPTEAECRGLAVSPHGPGKAF

SEQ ID NO: 1020135 - protein, 247 aa, Homo sapiens
ERGGRDGEGRGELERAETAAALQSWLVAAARVPVLPAGGAPRVGEGHGSAAPGAMGCIGSRTVGNEVIAVDWKGLKDVDQYENGKHQLTAREQLHWPLTEQTRTDFSWEGINLYHGGQHIHSFRSLMRNSNAYGIGALGNVINSQGSHWSMKDHVTNATAMRQGLVGPTGLSGKGMRERHQLYSHEAQAESVRRDTDAYSDLSEWRDKEAQYLTGVMAPVRYSLEGHSSLTWAIHGLVRTMEGEGRT

SEQ ID NO: 1020136 - protein, 113 aa, Homo sapiens
ERGGRDGEGRGELERAETAAALQSWLVAAARVPVLPAGGAPRVGEGHGSAAPGAMGCIGSRTVGNEVIAVDWKGLKDVDQYQKWKAPAHCTGAASIGHRLSKIELISPGKAST

SEQ ID NO: 1020137 - protein, 49 aa, Homo sapiens
MVKGLRDRAGDAQQSILHDGATDLGLHDDDQLHRTVEPPGDVLSVQDGA

SEQ ID NO: 1020138 - protein, 164 aa, Homo sapiens
MRDSGMIFLLSHYGGARVLSPAQECARPGHGGKYDPVLGTLTNPALALSLSTPGQTDRKTDHRYRDEDTGSDQEFGELQDIAVLWGFPPHAARASRPQGHCLEDQEPGAAFPYSHLLLELPRGHWQMSGEERDTLWKAAMTAPGLLISPGPLGAAKGLCLHIEP

SEQ ID NO: 1020139 - protein, 178 aa, Homo sapiens
GGGLRCLAVWEGLTAVGGGVAVFMCEFARWWYALASLSQSRSPRLPQLRNAGNFCRRAPALRTHAAPAPTQGRPRHSNRAAGASRLPAQTQPGCALRHARRLLRYRPQPGVSRAGRMSRASHTGARGPVPPNAMEEAILSAPLAPTQHDPALDPSLSPPQGSAWASAPHESRPRARGR

SEQ ID NO: 1020140 - protein, 101 aa, Homo sapiens
PPQQGPPDLWLREANATWVTLPFCKSWHTGAYRAPVMVSWTMDSFKSDPFEFCTPRYIPFDKGSLLLITGALWNVCNMFLYSCIVGVHSKLSPAAALCIGP

SEQ ID NO: 1020141 - protein, 96 aa, Homo sapiens
LEVRIEVAPAPTHLVFLRLRDLPVVEIVVDDAVFRAAEVVVQEIDRRAVDRSIAGAVHHVARHRHAVVERGQALAVGGIERHERQPVILRIAERKL

SEQ ID NO: 1020142 - protein, 37 aa, Homo sapiens
MPLDGRGIGVAAVRSEQMEVVGVIPIPRILGGRLIRN

SEQ ID NO: 1020143 - protein, 62 aa, Homo sapiens
HGLGAFWQHARDVVQQAATGDVGHGLDRAGVLDQLQQWLDVDAGRRHQQVGQWFAVQLDAFD

SEQ ID NO: 1020144 - protein, 345 aa, Homo sapiens
DSVSGYSGVEIASSLVVDRQCQRTLVDKRRLGLSTCCGRHYNVQAVGMLCDLRTNSLPRLCRGLIERSPRLFVSILRYTIGVLVLEVDGRYARLHSVGTDAGRSSWFAGAATYKEARLRPKRPRLQTGAGRSLLRRRWVALKLRGQSGFSPSEGKAVCYSEERDGNEQEDAADGLGACAARWLRGGVGRPNRNDPRAHSGGGDEIIRRFVSLSVGQRKASYEVVNWLYRNRWNKRGQLCNAIIKFHVIFCVRGRSQLRLILTPQAGHVILLLMFGELALAKAHTTEEIPSKIKQCSLLTLNTVLPTTGCCIEAEGKARGRLSFGRTAYWGCHGLELAQGMPSEKA

SEQ ID NO: 1020145 - protein, 141 aa, Homo sapiens
MAQALEIGDVVAGNPYEPHPSEVDQEDDQFRRLFEKLAGKDSEITANALKILLNEAFSKRTDIKFDGFNINTCREMISLLDEETQDTMQVPDSSETFWNTEADILDTVRRWPSMNQEGGPHRHQICQCFDLGLLSLRNYEK

SEQ ID NO: 1020146 - protein, 111 aa, Homo sapiens
TRQPDADGDSYDPYDFSDEENAIKTLKTASQETKESELSESRLKAFKVLDVFREAHAQSIGMNRLTESINRDSEEPFSSVEIQAALSKMQDDNQVMVSEGIIWVGGGVGGC

SEQ ID NO: 1020147 - protein, 96 aa, Homo sapiens
MARAPHNALSFRKICERTISSRDYCLIPLKCDLQPPTALEQPFAITFEKRRGKNDGKIREHKAKACRVGMPCPSGHGRGRSESGEEGAVAGLPLAD

SEQ ID NO: 1020148 - protein, 133 aa, Homo sapiens
WCGLVGKTFELAALGTSTRLREHQKGRPTSTNPAQQQSQDTGLEHRGKLDGNQDPNRFAQKREKGVRGDVCVEWEPLTKDLAGCIHGLSNVKLNEHFLNTTDFPHPLKEQPWTEPWAGSRGRRHPWLQWRGQG

SEQ ID NO: 1020149 - protein, 38 aa, Homo sapiens
LPASRRNFSAEHATHVGVVAAYEERFPFGTRGVGVVSF

SEQ ID NO: 1020150 - protein, 73 aa, Homo sapiens
DKTASVLQSVSLEVTRATAGMVLEKLSTFDRVGSNATGDGTKKPFKTSLKALITIRKKPFPTIYVDSQKENKK

SEQ ID NO: 1020151 - protein, 37 aa, Homo sapiens
LTILQLECRDEESNLTKMLMLDKRILCSPPLSCPPIE

SEQ ID NO: 1020152 - protein, 101 aa, Homo sapiens
GQITPLLIIQIWQSPSCDLPLPASIPLPCSSYDNRDEVPDSSASPIRTLVKREDMFTPSVSIFPARAFRSLPALSATWSHSSCSTDHRQPWDLELDASRLN

SEQ ID NO: 1020153 - protein, 101 aa, Homo sapiens; identical to SEQ ID NO: 1020152

SEQ ID NO: 1020154 - protein, 101 aa, Homo sapiens; identical to SEQ ID NO: 1020152

SEQ ID NO: 1020155 - protein, 168 aa, Homo sapiens
LAEVRGRARPSGPGLRTSKLRPALRPLARTTFNSSTMSARRARPGVSPRARAFQRYRDLLVPAPGLGPSLTSQGSGIHWRRMCGVSVVTPGCNQLPTYGVQVENYTLTINDDQCNSSLRLSGELSYVWRLFSQLVGKSAEGTIFINKTEIEDFPRFPHRGLRVDTSRH

SEQ ID NO: 1020156 - protein, 196 aa, Homo sapiens
AVSKSHTSLFRPSTWLYISFVKSNVESEHLHVLSDALLIVALGQDQNPTLLASSAWQSGLRYACAFFAKAQRTGSSKSTGKFGSTHGSFSVGSQKHYRQPEQCLFDLQKSSRLTLVEVRMTFHLVADRLVLKPWLVEDHLQQPVVEVGQPDVTWANPASFDIYHWLPLGHKDPLCHQYLSIFIFRDHFLHLGLQTL

SEQ ID NO: 1020157 - protein, 103 aa, Homo sapiens
MESGKTASPKSMPKDAQTDGTNPERIWGITEYEPRVINQMLEFAFRYVTTILDDALAIQCRADQSFTSPPRDFLLDIAGQEIKPLCHGSSHIQVLSCHLINTA

SEQ ID NO: 1020158 - protein, 238 aa, Homo sapiens
RAGVQERGQELLGCERRRRHVRLSEKLTPGSRSSGACLEVQGSRPGQWNVTADMENEIRGLCLKSREICPEPAHSSGAGGSSSGSAGGHTRAVLRTVRADYSSMAGFPPGEQVAQFLGDYVDRGKQSLETICLLLAYKINVPRDLLPAPWEPRVCQGSIGIYGFYDEWQETLTHIELWKTFSELASTAWPIAGIAGGRRSSGATGGLYPELQSMEQIRRIIAAQDVALTRDWCVTAVV

SEQ ID NO: 1020159 - protein, 313 aa, Homo sapiens
MMAAEEPSGSYKQEPLGSDCEGVNCLAYDEAIMAQPGTEIQQEIAVQNPLCVIAVGSSRVLYNGGMLKHDKQSYRTERSRDLAQKCTRTILKIRPDGNCFYRASGFSHLEALLYDSNGVAASSQAVSRLRARGKTWCPRASLNSTIERFSTKRFMDLIAAGAHASTTSVVDLLASFNDQSTSDYLVVYLRLLTSGYLSVAESKFFDALHRGWHGLSKEFCQQEVEPMCKESDHIHIIALAQALSVSIQVEYMDRGEGGTTIIIALAQALSVSIQVEYMDRGEGGTTNPHIFPEGSEPKVYLLYRPGHYDILYK

SEQ ID NO: 1020160 - protein, 87 aa, Homo sapiens
WIAPIMTMDRAFFSLHTRVETLQQARETFARIAVGRGSAQEQKLRAEGFGDNQVYPFEIGENPAQLLLMGRVDAWFNGIPETQSIWR

SEQ ID NO: 1020161 - protein, 259 aa, Homo sapiens
ALLRRKKTSKSKAITPKRLLHIYNHKKQHSYLQSWPVQEVLSAVRTSNFALDVDLTHYTLSYSRNITHSLLLGHRSPILSSFYCARSSFHYKQSHTCHSAIPSCLQATAGLSLNPSFASHALSWFLAALAICTAMDVVSISSANTVHNHIICATLSKHAIAAQLRSTFPHQGTGITHSVAFTLGNTKSLRASANPDPNQPAHYTVATQAHQPSLAHSQLTLLHGNPSLQEAKPLDPGTHASPLVPTPQLGREATTQPPR

SEQ ID NO: 1020162 - protein, 99 aa, Homo sapiens
ALLRRKKTSKSKAITPKRLLTSITTKSNIHSSVMASPGGLKVAVRTSNFALDVDLTHYTLSYSRNITHSLFLDTGPLFYLLWKVTNLFTQIKCTSEFQC

SEQ ID NO: 1020163 - protein, 113 aa, Homo sapiens
MLMVLSSTVVTALVAESPVVLNWTWLLSLLPREVAHAPRSLIKLTMMAPPNRSAKCVEMKPSRASPREPVPGEIQIDNDALGRLQPRPYDTDTWLALCQHALLIADESRPFVG

SEQ ID NO: 1020164 - protein, 140 aa, Homo sapiens
MADYSTVPPPSSGSAGGGGGGGGGGGVNNAFKDTLQRAQQITAKIRDNTKTSLNSNNYNYKKQKRPLEHKYQPDTKKLTPQNNSFKTHLPPIHHHQSISIITKEYKVPHKIIKFIINRENKHISRIQQKSEYKIHISPHS

SEQ ID NO: 1020165 - protein, 146 aa, Homo sapiens
GGEIGAGVWPRPIRCSPFTSGSLISLVCNIDPGYCGRGGLLGRMGGCYINIDIILFSELRWCYLRLVMGEPSGPGWARLQPKHEPGLDHLSSLVGKTFLTDFVKDKAVAQPLLPATPLGTIHQLPEEVRRIHYVHAFAKGELSSLC

SEQ ID NO: 1020166 - protein, 114 aa, Homo sapiens
ISVFSKEEKIPYLIQAWVDPFNKEDKSKAPFTVIPPVSRLEPSQEKILRIIHTKGVSLPDDRESVFWLNIKNIPPSASNKATNSLEIAVKTRIKLFWRPANIRLIPEDAAPKVK

SEQ ID NO: 1020167 - protein, 187 aa, Homo sapiens
SLPGATQQINIDQIRKLPLPTRKKLVQQYGMLEHFTLLNEVGQLKFFQNVIKETKEPKKVTSWVLNTFLGYLQQNLAVSESPVTPSALAELLDLLNSSTISSSAAKQVFEGLWKREGNTPGQIVSPLALMQQGALALLHSLMAQVIMDVKKKNTRAINKMIGLVRKATQSRADPVMIKEILEKKLSL

SEQ ID NO: 1020168 - protein, 79 aa, Homo sapiens
RKGLRPGVRHPFLGDLRKLITDDFVQKYLEYKKIPRNPPEYELWGLRARHETSKMRVLRFIAQNQNRDPREWKHFLEVD

SEQ ID NO: 1020169 - protein, 479 aa, Homo sapiens
CLSYFVLYLRPGLFLSAFPLSLLSCCSCFLGAFSVPSLFSLVLRALYDSFRFLCLVVSLVPGCLYSVRSFSFPCLPVFHFRVYSLVAFLSPLLVLYLPFSFFPPLRWLFLCSPCFCALVCLLLCLVSLVVLYLFVVSSCVCLFLLLCYPFSLFIYYCVFGSRSRVVLLRVLSCCSASCPACFLVCPCIVALRCLCRFACIAFSPCWSVLVLCHGSSLCRTSSMRWCLPFFPRLRPLAHDRFFVTVMCHPWDGFSSLSLSLSVASCSHDGACGVRCAHVLLALITLVPLCLLTGCRHLMLLVLDPLHRLSLVLCVCPLTVSSGLLWDGLARQSPFLCYWHIIGDVGILICLVVSSQTASGSELDALAVLRSPAAMPHEDAPTLLLVATRLLTVGLDTAGLQSPQFVSLVPLWLRWEGEGGVGPPARKRDRSTPGRIQGVREALPSGPPGGGPDVSPEPSAARMDFALGFAFAASLETVLE

SEQ ID NO: 1020170 - protein, 115 aa, Homo sapiens
MVPIGQRLQPNVGEDDQLVRGRGSGSVQLADLGLPGDSDVQRVTDLDRVTVADHGDEVPMTPATGGLLLGLRWQRYVTEQVEIFGSHHLSSELRSIGHGVEDHLLHLEGELLHHV

SEQ ID NO: 1020171 - protein, 110 aa, Homo sapiens
LKSSTVGPVLLWEKLRLGASAETGVKSLWELHRPEEHAFSSCPLMVSYLNFSPFVNILGGWAVLQGWSKQGLEPLFSSCCLLLMPWPHSGHFAEQMPLTSQDGCPPPCDM

SEQ ID NO: 1020172 - protein, 132 aa, Homo sapiens
LKSSTVGPVLLWEKLRLGASAETGVKSLWELHRPEEHAFSSCPLMVSYLNFSPFVNILGGWAVLQGWSKQGLEPLFSSCCLLLMPWPHSGHFAEQMPLTSQQGFPHPPLNEQVSAATRASSNHPTPMTLALC

SEQ ID NO: 1020173 - protein, 109 aa, Homo sapiens
YFADRVQCVKSEGMLSGPLAVSMGVPQGSILGPTLFSVYINDVALAAGDSLIHLYADDTILYTFGPSLDTVLSNLQTSFNAIQHSFRGLQLLLNASKTKCMLFNRSLVD

SEQ ID NO: 1020174 - protein, 143 aa, Homo sapiens
MTYAVRKLDNTKFRSHEVGYTRIIFFDQNVDTVVLTVEFQGKDSGKLVQVNCQISGFSYIVFIQHVLKIDVSLDLSMDTSVYPIVGDYFLQVKVDGPRSPSYGRSRSRSRSRSSFRITILTQESQYITKEEVRGSRLFSPYSL

SEQ ID NO: 1020175 - protein, 92 aa, Homo sapiens
GPDEIARCRGVCTERDMTYAVRKLDNTKFRSHEGETAYIRVKVDGPRSPSYGRSRSRSRSRSSFRITILTQESQYITKEEVRGSRLFSPYSL

SEQ ID NO: 1020176 - protein, 131 aa, Homo sapiens
RVGEGHAQLDYVGARCGQPLEDRQGGVVVRVAGGDESHQGGAVCFLQLGKTGLQAAHQCFSCWDCCMWCITVCMSLSATAREVDHHQVILGQVRCALEDFGQGMGAFQGRDDAFQAAALVERGQGFVVGHR

SEQ ID NO: 1020177 - protein, 135 aa, Homo sapiens
MGYISMERERALLQVPATGDLSAADSVTAPGKGPSHSHGWSGPRTEANLTSMRLNPTRRKRLSAVTFPDIIRNYKVMAAENIPENPLKYLYPNIDKDHAFGKYYSRPKEAPEPMELDGPKGTGYIKHELISVSEV

SEQ ID NO: 1020178 - protein, 113 aa, Homo sapiens [sequence omitted]

SEQ ID NO: 1020179 - protein, 718 aa, Homo sapiens
MAHHLPAAMESHQDFRSIKAKFQASQPEPSDLPKKPPKPEFGKLKKFSQPELSEHPQKAPLPEFGAVSLKPPQPQFTDLPKKPPPPEVTDLPKKPPPPEVTDLPKKPPPPEVTDLPKKPPPPEATDLPKKPPPPEVTDLPKKPPPPEVTDLPKKPPPPEVTDLPKKPSKLELSDLSKKFPQLGATPFPRKPLQPEVGEAPLKASLPEPGAPARKPLQPDELSHPARPPSEPKSGAFPRKLWQPEAGEATPRSPQPELSTFPKKPAQPEFNVYPKKPPQPQVGGLPKKSVPQPEFSEAAQTPLWKPQSSEPKRDSSAFPKKASQPPLSDFPKKPPQPELGDLTRTSSEPEVSVLPKRPRPAEFKALSKKPPQPELGGLPRTSSEPEFNSLPRKLLQPERRGPPRKFSQPEPSAVLKRHPQPEFFGDLPRKPPLPSSASESSLPAAVAGFSSRHPLSPGFGAAGTPRWRSGGLVHSGGARPGLRPSHPPRRRPLPPASSLGHPPAKPPLPPGPVDMQSFRRPSAASIDLRRTRSAAGLHFQDRQPEDIPQVPDEIYELYDDVEPRDDSSPSPKGRDEAPSVQQAARRPPQDPALRKEKDPQPQQLPPMDPKLLKQLRKAEKAEREFRKKFKFEGEIVVHTKMMIDPNAKTRRGGGKHLGIRRGEILEVIEFTSNEEMLCRDPKGKYGYVPRTALLPLETEVYDDVDFCDPLENQPLPLGR

SEQ ID NO: 1020180 - protein, 76 aa, Homo sapiens
QLGGARSSDHFEAQVDQITGHACNQRLVIVAHADERSTAGRQHFAGTHLGLGKGFAEGVAHAHHFAGGLHLWAEGR

SEQ ID NO: 1020181 - protein, 110 aa, Homo sapiens
MPVLPSSQVVRVSYILPRLHFHGNMAARTRGTTAAKFFPTSLTSKKQFGTLVPILCSPEVGLSHTCTLNSSLSGPPSPASRVFFNLAVCRGEVVTPPPHSPASELSIPTG

SEQ ID NO: 1020182 - protein, 120 aa, Homo sapiens
WTGPSHIPQRLGQIECDYYMKRGECKFGERCKFHHPIDRSAPARNQTLENVKFTLAGLPRREGVQHCPFYMKTGTCSYAVNCKFDHPPPGEVMAAAGKETLTKAEEEGKESEEDAATAEK

SEQ ID NO: 1020183 - protein, 92 aa, Homo sapiens
LDFPWFPARVVCHDILGQTALVDLAGLRDAIADQGGDPALVNPVVPTQLIVDHSLAVECGGFDPDAFDKNRAIEDRRNEDRFHFINWTKKAF

SEQ ID NO: 1020184 - protein, 190 aa, Homo sapiens
ADRSGAGFMDLLHSEQHYPVSYTHICKDLGGVVDLILMGDTHSFVVTQMDKLGGRYHVFTLSIKTLEVFRRIPLRRARRGMTNTEDQTVPMAWLYPSRVWVCHSRCHTIDGFGSEVDAPQCIFHEFAIDPKDAQLNALDSGAARELALLWFDLLHEDVPLAFRFLFAGRLAHLRCARNNRVCGWQGCCCF

SEQ ID NO: 1020185 - protein, 174 aa, Homo sapiens
MELPDSELNRYPRLLILLHLFTPTCFSTQSGNWLKSSRITQDAQEMNALFLYRRTVTGSFKPKIKALSRKWDEIASQEKTGKRGNHLNDFGLLIFHGFSWRMDGTLPEGFSEARQAWVLGNSVAYYQAKLTGEDDEDSPGDDFFSNLGTNGKLQPASLSTAGGGALGCLAVGGG

SEQ ID NO: 1020186 - protein, 206 aa, Homo sapiens
MGAAGEGSQDERSGPGQPAADAPPEPTGPRPAPPTAPRSRSRPHHPRPPSPTGHARPALNAGRGGVPLRPGPALAPPGPPPGAGAMAFTFAAFCYMLTLVLCASLIFFVIWLIIAFDELRTDFKNPIDQWNPARARERLKNIERICCLLRKLVVPEYSIHGLFCLMFLCAAEWVTLGLNILFSSTTSGGTSTVLHMVLRCCVMRGP

SEQ ID NO: 1020187 - protein, 66 aa, Homo sapiens
PEWNKSSTPDGVPTLCCRNEAKQQISISRMWGLKVLLLPVVSFALYPEEILDTHWKLWKKTHKKQL

SEQ ID NO: 1020188 - protein, 75 aa, Homo sapiens
RNVLRIGVEELKSFRDVPSKVTLDECVELAKRFGTDDSSSFVNGVLDKVRHSLRESQRLMAALDPARKKAWKAAL

SEQ ID NO: 1020189 - protein, 286 aa, Homo sapiens
LVGSENHEQRSYEASNQYIAQDSYKPWTHSGSRGGSAPSSDQPASGHHASYDQQSGYAQHHGSYDEQSNYDQQHDSYSHKQQSYHSQRENYSHHTQDDRRDVSRYGEDGRGYGGSTGRRYRGRGGAYDKEVEECPMTEDQVGVTADGCKDMIGGHRELWSQQQMLIQNHDNSDNKTIWVPGLGEGVSTDQVGEFFKTNIGIIKTTKKTGDTIMIDLDTDKDIMEEPNGGGKRCVIVMTPPSAKCRPLTGLMEKNGHGNIIKVSFVTRMILEIHDEDGGSGVWGGEA

SEQ ID NO: 1020190 - protein, 109 aa, Homo sapiens
HEGIVELDGYLRLQVGISGRRPHHLCGTDEPVASVAACGSGGDGGGCGKLGRISHGEDQVTGPVHRRLDEEAVARCRDARRQRQGKPVHGLGEGAESGHAAVAQTREGI

SEQ ID NO: 1020191 - protein, 78 aa, Homo sapiens
NRTPFDLAEGESELVSGFNIEYAAGPFALFFIAEYPNIFIINPLPTTIFLGTTYDALSPELYTTYFVTKTLLLTSLFL

SEQ ID NO: 1020192 - protein, 104 aa, Homo sapiens
STPCGHRNTFSLQQLAPVLYEIVALCITSFACRSPRTQALSVGGSGAGWRQNFINYRPTPRVGGHQRVRSERRDTIRREGVGFGDYGVVPLLVHSSVLIPGYRA

SEQ ID NO: 1020193 - protein, 208 aa, Homo sapiens
MGSRVSREDFEWVYTDQPHADRRREILAKYPDIKSLDETWIPNLDMDSLFMMVLHPRLGGILPLVKDFELENGSHIWGAMRFGELAINPLHGLWAIPWRLAHNGWPLGNWQSNGGNRLGLGHGLRNPSLLGIPLFTFPFNEGIHSGIITRDLVSLSGVECRIFLTDFERGSPGTAFQTSLYGVILQASLLCLSTSVHQQTNYVSGSYH

SEQ ID NO: 1020194 - protein, 108 aa, Homo sapiens
MGSRVSREDFEWVYTDQPHADRRREILAKYPDIKSLDETWIPNLDMDSLFMMVLHPRLGGILPLVKRLWTGKWIIFRAYTFNSYINHSITLTIHKITHNTTFNNYKAI

SEQ ID NO: 1020195 - protein, 129 aa, Homo sapiens
AKRALSRLKLKLNTDIVSSVGTYNLGQKALKPPPIKLYRETNGPVETKTRTFNTQAGGLLLSSDTKRAQIYGRRQIIPEKEGTGELKPVDDPRLMLKGFKARVPVEHHYLRASLFVYPQESLVIGAPLF

SEQ ID NO: 1020196 - protein, 49 aa, Homo sapiens
MTRRVLALIVGLALYGAGDALAIRAGLGVDPWTAFAQGLSLHTGIGVIS

SEQ ID NO: 1020197 - protein, 51 aa, Homo sapiens
MATAAVKLVLPAGPRSRPSILVRSSVMRRPRPGTLAGSRPCNVADVQHCAG

SEQ ID NO: 1020198 - protein, 151 aa, Homo sapiens
WGGEEGSKPLSQLKGPLLGRGIVLGPRGMESIKGVCGRGPGSLGVLFCFLGLSVQPVGTFHVPRGDSSHNTRPRAVVKKLFLVASMTYPRFFDAIRCHLLLFLDPLAFLPFHFLTPAPALPTQFRFLLFGGGKKFLIIGQRDLPLERPSAF

SEQ ID NO: 1020199 - protein, 82 aa, Homo sapiens
GVEDLVEASGAVFLHVAQSVTQRFAFERAIFGGKRFDLREVLGGEHGRKSLASSALSLLTLRRLKKRSIMMEMLITLTTPMR

SEQ ID NO: 1020200 - protein, 218 aa, Homo sapiens
MSRFFTTGSDSESESSLSGEELVTKPVGGNYGKQPLLLSEDEEDTKRVVRSAKDKRFEELTNLIRTIRNAMKIRDVTKCLEEFELLGKAYGKAKSIVDKEGVPRFYIRILADLEDYLNELWEDKEGKKKMNIINAQGVVSSLRQKIRKYNPDFQCAMIDKLQDRSPSESADEDAEKNEEDSEGSSDEDEDEDGVSVEFSGKEIRSPSGESRSSQRLDD

SEQ ID NO: 1020201 - protein, 178 aa, Homo sapiens
MKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETSIAAQ

SEQ ID NO: 1020202 - protein, 294 aa, Homo sapiens
SYKKSPGSTSRRQSVSPPYKGAFGATRSSTRSPSPYSRRAEICQSLQQETVVQLRKKWLLLAGDRPVPMVEGGPASPFRELKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTDYHSRTGDPL

SEQ ID NO: 1020203 - protein, 163 aa, Homo sapiens
GLIMEKVKVQYPRGPRPEAAEEDDGQVFPEVYREPWGFPGQLRAKVHPHVHGPLHGRLEPRVWRLQLGVAGGKSQNVTGEGGPPPPVHFHKSVLKGGVRMYVLPARGLGGWPRCWDKGDWVLPTPRPAPCQPVQFGFRGWGALPLPKVVAAQGPLLQAFGVFP

SEQ ID NO: 1020204 - protein, 131 aa, Homo sapiens
SNGSYRHGVRCTTYITSRFTMSDSMAWSAQSCFVNLSTSSQPVHLFWFQNGFIASEANPVPLTQMPHSPRPQATVTVTRKPCTPHTDSPIPLVTQALATAHPLSASGFATSGQFTHMRSHNMGSFVTCFFI

SEQ ID NO: 1020205 - protein, 153 aa, Homo sapiens
HEAYAGQVLVEVMAWRDVPALHLLVMHDDPVPPNGGDDVGLVEHVLLQLPQDLVALLLVQLARLLVVEVVHLAVHVARVVDGGAVRGQVLEQLQVGLIHEIAVEVQRRVVVALLLPCKVAGLKLLVLHLGAHLPPLVDEEHAHRGCAWARCGW

SEQ ID NO: 1020206 - protein, 244 aa, Homo sapiens
MRPPCCTEPRGTWGTLQALAPSTAGLAQRSGTAGAAAERAPGQTASTPGSCCGLPGLGAHDPYANRRLDTGDRHMRPSARRPPGAQCRSCPFRGWVRSFHGPHTTWLHAACGPVRASHMARTKYNNFDVYIKTRWLYGFIRFLLYFSCKTVHCGALGVRWRALLLPTVPGRRVLLRFQSKLSVLLCCWAAGGVDFRLVNELLTYGIRIPMMDRGLGWCSWTTGTFEGRGAKLMNSQAEGGSTQD

SEQ ID NO: 1020207 - protein, 128 aa, Homo sapiens
MGLYVDLACVICLKRVNLAENRLATLSAWTHSCVTGSAGPAQQVQASGTAVPWVAWRPGFGASTCKGIHSAVVAMAGCETSCTKAAWTWTPPKTLSWRLDSKREVCLSHVRAEDCEKGGLGNIPHHHT

SEQ ID NO: 1020208 - protein, 81 aa, Homo sapiens
MGFCYATQAGLKFLDSSNPPALASQSAITGASGCLSLSLSLSLSSDRVLGPGTVAHACDTSTLGDGQMMKLEFDQLTRCAP

SEQ ID NO: 1020209 - protein, 70 aa, Homo sapiens
HPSPSGRDAMAHWSTLFLAGPTPLPKLKFSGTNMFHCSLNLLGSSLSLPQPPGVAVDHKQLGHHTCALIF

SEQ ID NO: 1020210 - protein, 253 aa, Homo sapiens
FFSSWKLPKIRCFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMLIVLPWESMAHGLFHEWRHCLGGTSVGYAIGISTNFCSPDGQQHCSPRTVRSKLRLLAVMLPGFVLGWDLVGLSSGGLDCS

SEQ ID NO: 1020211 - protein, 129 aa, Homo sapiens
VSLSASAAFEVPGFELVYTSPVEAKLDAPDLSNPTDVWVEMIDGAKKTLDFGEMYAVGKAGEPLDRVIEALSKAGDRGVKTRFMLEKKMLRASDDATIERLKKIKGLELRIYEFAKLGTNGIVHAKYFV

SEQ ID NO: 1020212 - protein, 69 aa, Homo sapiens
ICDRVDGNLALCLSPGITRLPMIGIIDVGKGSAGLISLLRNALPEEKRHLAMSLRLRMTPEFAINPLVD

SEQ ID NO: 1020213 - protein, 89 aa, Homo sapiens
LGLDVGEPTDIGGQRDRLLDQGEGVTAHAVHHDDRCSRSVLVALVEGIQQSLLQRCDQRRELGDLADEVLPLVLLDDRRIVGVGGAEVL

SEQ ID NO: 1020214 - protein, 31 aa, Homo sapiens
MDNSAILYLEAISTIGVTNSMVDQDIPGAAL

SEQ ID NO: 1020215 - protein, 68 aa, Homo sapiens
AAIRVTIGFRRFRSKHQSLLSSINHSWAAVTYPDPFYCYAEPHRAFTTGLPTLSTQRRSVWLLRRDVT

SEQ ID NO: 1020216 - protein, 155 aa, Homo sapiens
FGDSFFFDLFRMGLVSRPLREGGGGPFAGVFSSGVSSEPSSVGFREPFQVEQVSKTNPGGQKKTGLAFGPHDGFYPPGTLWENSWALFPSVFSTWATPALIPRLPQAARQGVRPVPGPGSKGFLCSWKCSRCGKASCSPASITRLWGGGFAGDAF

SEQ ID NO: 1020217 - protein, 78 aa, Homo sapiens
DRDARVGHPRDHRTIRRLGARLAAVRRACVRVRSEARLAAVRADRLAVLSAALRAVADGHETLVRDVFRQRAEVGRGA

SEQ ID NO: 1020218 - protein, 133 aa, Homo sapiens
QAQAQAQAQAQAQAQAQAQAQASQASQQQQQQQQQQQQQQQQPPPHFQSPGAAPQGGGGGDSKPSPPPQSDFDLTPYKTAEHDKDICLTVTTSTIQVEHLASSYRSVLPPTGKRKKKALVSSLCNSRREKSFA

SEQ ID NO: 1020219 - protein, 233 aa, Homo sapiens
QAQAQAQAQAQAQAQAQAQAQASQASQQQQQQQQQQQQQQQQPPPHFQSPGAAPQGGGGGDSKPSPPPQSDFDLTPYKTAEHDKDICLTVTTSTIQVEHLASSYRSVLPPTGKRKKKALVSSLCNSRRDGFPAQDTIAVSELFFKRNISPPDCDGLLSWWENPAASPPKQNFYNWGSVLKGRICYDLIEPCAVWALPYAYPPYTKFGLMDDYRPALPDTGTEPHVAPGFCALL

SEQ ID NO: 1020220 - protein, 213 aa, Homo sapiens
EAFENLGKRSLEARCLPKSVHLHFQRPTPALRRHLFTFELLSQLPKLQSIKCQTEGFMKLKILSFISIASNLGKMTVPLCIGSTDKASMEVRYQTFVFFGFLPCSLFLFLLLFSLLFFLQFLLLHLLVPSSVGTDLLLPMLIQDPMAFRTPVAPDAQGYSLGASDGVDNIRQTVETMGSCFTVSYSEERGENTSYRMEEKSDFMLEKLETKSV

SEQ ID NO: 1020221 - protein, 35 aa, Homo sapiens
WQYQQETEEAVKGPQIYTGKKLPKSTRMKKIPWAG

SEQ ID NO: 1020222 - protein, 89 aa, Homo sapiens
QQREALLFGQHFLFIAPFGGQLIFFFYLDENVPVAQLHEAMIPGNHVEPAFDVYHFVFCQFGNGFQEYLLHRVFGCFFIFEVFHTNTQQ

SEQ ID NO: 1020223 - protein, 131 aa, Homo sapiens
EARAVWKITSQSWVTSATLYPTHEQLPKLGRRPGAPERKCSRGALYTSFSILGTLVLAGQATTAYFLYQKKGRVDLTRTFQNLEVENLRMKLSKAPKAVSKKRKGTPLLMQALSIGDLSQGPMRNGTKYVL

SEQ ID NO: 1020224 - protein, 268 aa, Homo sapiens
MREIVHIQAGQCGNQIGAKFWEVISDEHGIDPTGTYHGDSDLQLDRISVYYNEATGGKYVPRAILVDLEPGTMDSVRSGPFWAPPKGKKFFPLQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNAPSPSNQSGRAILDETYCIDKEALYGLSGFRPLKLTTPTYGDLNHVTSGVTTCLRFPGQLNADLRKLAVNMVP

SEQ ID NO: 1020225 - protein, 257 aa, Homo sapiens
MREIVHIQAGQCGNQIGAKFWEVISDEHGIDPTGTYHGDSDLQLDRISVYYNEATGGKYVPRAILVDLEPGTMDSVRSGPFWQIFRPDNFVFGQSGAGNNWAKGHYTEGAELVDSVLDVVRKEAESCDCLQGFQLTHSLGGGTGSGMGTLLISKIREEYPDRIMNTFSVVPSPKVSDTVVEPYNAPSPSNQSGRAILDETYCIDKEALYGLSGFRPLKLTTPTYGDLNHVTSGVTTCLRFPGQLNADLRKLAVNMVP

SEQ ID NO: 1020226 - protein, 226 aa, Homo sapiens
PESDPSPGPRARGRDWAFHHNHILAQDQIDPSRFGQKVGLGREECPSVRRVEPGSSARSVPSIRRGAEKPFLPKKEKMKLRREQWLQKIEAINLVEKHREDRRRRAPVVVGDLHPLRNALPLLGFKVGSGGQAPSRESNKPRPSKFSRMSAAQRQQFFEEKRTRFQELLASPAYRASPPGGHWANVGPANAVGKWRPVFTRAGGMPQLLRTHVGQVKRAGPSRTMA

SEQ ID NO: 1020227 - protein, 246 aa, Homo sapiens
MRRGERRDAGGPRPESPVPAGRASLEEPPDGPSAGQATGPGEGRRSTESEVYDDGTNTFFWRAHTLTVLYHPHLYAWLCRRCWRKHLKTRPTTPREVLWPVFWFSVCFGVTQAKDKPFSRPHTNLLKILALHRVVVYELVLILYTLPDYSGRPAVSKSMLTPSWECHLPERDYSENCLIYDPDNETDPFDTTSGTQWMAWYPAHYSLAGTWKTLMIRDGDVLNISEMYEYLDNAGAQCQLSDAWTG

SEQ ID NO: 1020228 - protein, 67 aa, Homo sapiens
RTLRQRTPPIVPSSDRYFHSAQCTANIQQVTGLILWQIKKLQCSPAILVWISIIRELRTYFRASVSS

SEQ ID NO: 1020229 - protein, 122 aa, Homo sapiens
ALEKWEMQIFDRLFPRISEIVREIDRGWGEDMNKRGVDGQTIEYMAPVADSWYGFRKDKIDELALSLKVFELTDPRILITGSRQYDRPGIIQGAILSAKIRADGGLGRSAGFGPNLRFPIGV

SEQ ID NO: 1020230 - protein, 119 aa, Homo sapiens
IHFLNSRLAPFFDKKGPNSPFWAPGFSDPHGGGGKKKGMGFPPEAINPFGKGQTLFPRELRGGALIPRAFFPPRDPGSPPKGPPRFQGGPPVFFLPRGQNFFLGPVNFPPPKKKKARFF

SEQ ID NO: 1020231 - protein, 137 aa, Homo sapiens
TRAHAVHRAADRPATGQTPPDAPTTIPRSCQRPFRSRAAISGVMEAWTLTISDSVFRDTSKAVAASVMVSFSGSSQSSCRISPGCGGLCRRMVCFPWWDESESKRRRLPQRAAPLFQKKAPFKPSPPPSETARSTPG

SEQ ID NO: 1020232 - protein, 35 aa, Homo sapiens
MGKEPGSYRSGSEETPKRLPVNTISRCQLWPARSR

SEQ ID NO: 1020233 - protein, 115 aa, Homo sapiens
RYFWKGSTGAYKKLKNPSTCLKGFQFGKERKNSKKKIQGIGPIKERYWMNTFRFLKYGEHFDPLLEQIVKHVFWTCKQMLLQTNIACDSLRCYFEGVPGLFTENSNILTFKWTNG

SEQ ID NO: 1020234 - protein, 400 aa, Homo sapiens
TYTRLRDGTRPQHAKQTGNTHVITFFNNEVQTQPCYWDADDTTGDTAASCLDEPGDTEEKPTISFNLYNSLARFPGSENTVREIMKATIILLLLAQVSWAGPLSTEQAYLDLYARRLTAPGIRPEVPDDRDIRSHSLGPDVAPFRMSTAIFRRGYKCNDRRPGHHNMWANGIIPPLDTKIWLRTWQHNTQTIHPAHHEDRTPFTGTLERNHSTPLGTPLIDTIYTFSKQVKRPAQAFNTHHSGGKLANRPTIGSKQIQRKEHARNKNAPKKLIQEQPMPQLTTRRCRNTGEQGIDINGALRTHMTAAKTRRAQQRLTTDPANAEVRAPRTSKSTHTNKKWRHTDPTHIDKASTRTEQKLRCHNDGYATTDHATPHTAQLELLDDEPHAPREEANNKSGDV

SEQ ID NO: 1020235 - protein, 170 aa, Homo sapiens
MGAFCRRTGSGALCRLLGAGAAGPQAPWGRADRTKPSMRRPGVWGPGVQVLGLPVWMCLEPLRQAAFTDGAGQGSRAGLATWRWIWVVAAQPSQACPLGAFSRGCWVSWQARPVGSARRLQRRVGLRSGAEAPISAVWTRSPELSLQLPPTSLAESVSRPSPDLFLGTLQ

SEQ ID NO: 1020236 - protein, 182 aa, Homo sapiens
MQTMPCQDARQVNWWGPFVASGQGGGEGSVMQAVADSSDLLSFAVVHQCCLAGSPRGYLFPPNFWDLDPGQPVGVTGAALCGTVGPSCLDNGGWWPGVCWSPLWGALELLIFFSVVNVSVGLLGAFAYLLTYMASFNLVYLFTVRIHGALGFLGGVLVALKQTMGGLCGPASAPARQCDAHA

SEQ ID NO: 1020237 - protein, 138 aa, Homo sapiens
REFRARHLLTLRLSPVSRRPVPCRPAVLRPPRHHGLCCRAPGVGGGCLGNEFSILNHQGLFVFRNGNLPIPGERIPDVAALSMGFSVKEDLSWPGLAVGNLLSSSSGYRHGDGEGSEQTGSTPRQCSFAYPFGESSSF

SEQ ID NO: 1020238 - protein, 149 aa, Homo sapiens
REFRARHLLTLRLSPVSRRPVPCRPAVLRPPRHHGLCCRAPGVGGGCLGNEFSILNHQGLFVFRNGNLPIPGERIPDVAALSMGFSVKEDLSWPGLAVGNLLSSSSGYRHGDGEGSEQTGSTPRQCSFAYCLLEKWQVSLFSSLEPGWL

SEQ ID NO: 1020239 - protein, 260 aa, Homo sapiens
LKAVARGCPHSHVKRYASIVRVSAPSLAGVEQPRHAAGDRNWSRVRLRELVPEPGVWRLGARLTGCHVPNSVSISILRLPGSTHVYPLSLIMFIERPAHTTESHIARVMVPDPIQHTQSLSEESSSLRSSRVAHPEIRAQGAPSEATSSRAILKALQDEWDAVMLHSFTLRQQLQTTRQELSHALYQHDAGLPCHCPSHQGSHCCPRSSGYPETTGWLIVPQAVSSSNQVLWVRVSQLDLGELLGMTQENFRSSRKACEQ

SEQ ID NO: 1020240 - protein, 118 aa, Homo sapiens
MPPPRGPLVILKALQDEWDAVMLHSFTLRQQLQTTRQELSHALYQHDAGLPCHCPSHQGSHCCPRSSGYPETTGWLIVPQAVSSSNQVLWVRVSQLDLGELLGMTQENFRSSRKACEQ

SEQ ID NO: 1020241 - protein, 141 aa, Homo sapiens
PRVETPDKPELRTVCRMTAQCSWDSEMSQNTKADWEHRLKAGGGGQMPRSRGRAVYRTPLGQSMRAEPATDEDRQPSTCWFQEMLAVAFRGEGSTCHARTETRLQQESLCECICMETGKSRDNIHIGATGKTLRTILTAFL

SEQ ID NO: 1020242 - protein, 159 aa, Homo sapiens
MGALERTISHTCMSVDPQTDSWFHHPEFNRTLRFCDAVVRYLVAFSLELTVRSPTPLGPTGTWGPNEARVTFRKPMGLTPFQDQSLLLPPFTLGFKRFRHFLNPILPVGIHRKYTRVYCSLGNTDSQIGFAYEGSMWLWKVINKGLPLRVNRRSPGDAT

SEQ ID NO: 1020243 - protein, 100 aa, Homo sapiens
MLWGPREKVGSLNAKALLDPGTQPGRLAVASGVSPLVRVLLAFASKPLTRISFAGTWKEGKGTPPPNPCWLGAPNWVNFPIPPPKAQTGAPQLSRRVSSG

SEQ ID NO: 1020244 - protein, 216 aa, Homo sapiens
GNRSSRLLVALLAGRRSAAERVSAQARPKPWYPARCGPQSAAMGAFARLLRAVIMGAPGSGKGTVSARITTHFELKHLCSGDLLRDNMLRGTEIGVLAKAVIDQGKLIPDDVMTRLALGGRKAEALDRAYQIDTGINLVVGFEGVKQRLTARWIHAVGGERIMGLTLPDWGSDDLTGKPLIGVEMINPAVSGTEGYKTDGGVLGCGGRGLGTLCDG

SEQ ID NO: 1020245 - protein, 120 aa, Homo sapiens
GNRSSRLLVALLSRPAQCCRAGERAGQAKALVPCAVRASVCGHGGVRACCCRAVIMGAPGSGKGTVSARITTHFELKHLSSGDLLRDNMLRGTEIGVLAKAVIDQGKLIPEDCDDSAGPS

SEQ ID NO: 1020246 - protein, 149 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPFPEADLRTPVALAFKPTPVSFQPFCHHLHSPPIPLSTLNQAHAGPQRAK

SEQ ID NO: 1020247 - protein, 34 aa, Homo sapiens
PSVVEHVVGVLGYHTGWCGFLDVRTPGLHALVCG

SEQ ID NO: 1020248 - protein, 98 aa, Homo sapiens
GDTQEHRFAHRGTAAFGQHAGVLFVELRTVDRFTDDEGRIAHLVHLHPAEHLANDRFDVLIVNLHTLQAVHFLDLIHEVTSESGDTAYAEDVVRVDRS

SEQ ID NO: 1020249 - protein, 101 aa, Homo sapiens
MEAAASCAFANGSALLYEVVDAYAANGAHAVEEHVGFKIKINVGAFGKKSAWLGAAVGLLGARNAGSFWGGLEGGAGFTLKMRGDLRANALSQYGETRCLY

SEQ ID NO: 1020250 - protein, 113 aa, Homo sapiens
RHQIDGRGLFQIVVGEVALDGLAAVGRGEVAAHPKAAAGAVDQLVRIERIDLHVGDPAAHPFAFAPGEARRAMGLLAQGRPMRPAVPGDEDVVRLRPPVVEGGGDDGAGMGGI

SEQ ID NO: 1020251 - protein, 51 aa, Homo sapiens
IEDPFDWRATYARLTILTSLSAGDEESNLTKMLMLDKRILCSPSLISPPIE

SEQ ID NO: 1020252 - protein, 43 aa, Homo sapiens
MERVRKVLLYVRGIIRVVVGLDHNPIRNDVLEPLEQALPAQPL

SEQ ID NO: 1020253 - protein, 364 aa, Homo sapiens
APCTPVLGGQRGWLCVAQSGWHVCGIEHGCLVAWMWTTELIWPDLCCISQGALQRLHLVWWKMPQSPLARVELHSTCQTISVDLSAGSPLVWLTGCPVAGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSVPNPQNPKRGGGVNPQYNPADCQGRLAMYNTDQFSPYAAPHHPQGTYTATDTQHTQELNQPWWQTQSTSKGVPEITQLHPGHMLSQTLTPVRTNRAQYRAKTHRHRRPPYEDNKYTNKKTWNAIPQSPHEERYETTQPPGPRAYKAIETRKHHNAEQK

SEQ ID NO: 1020254 - protein, 355 aa, Homo sapiens
APCTPVLGGQRGWLCVAQSGWHVCGIEHGCLVAWMWTTELIWPDLCCISQGALQRLHLVWWKMPQSPLARVELHSTCQTISVDLSAGSPLVWLTGCPVAGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSVPKVNPQYNPADCQGRLAMYNTDQFSPYAAPHHPQGTYTATDTQHTQELNQPWWQTQSTSKGVPEITQLHPGHMLSQTLTPVRTNRAQYRAKTHRHRRPPYEDNKYTNKKTWNAIPQSPHEERYETTQPPGPRAYKAIETRKHHNAEQK

SEQ ID NO: 1020255 - protein, 475 aa, Homo sapiens
RTPEDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRHGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVA

SEQ ID NO: 1020256 - protein, 111 aa, Homo sapiens
AGELGAQPPGEGKDMPEDGEALRCGAPSSITISLPGTDPDAERRRQLALKALNERLKRVEDQSIWPSMDDDEEESGAKVDSPLPSDKAPTPPGKGATPESNLITFEATPPL

SEQ ID NO: 1020257 - protein, 134 aa, Homo sapiens
HEDAQAAMSIQLFSAAARAAQRHRGPVGRSEQHVQARRRRIVGEGARLFQRLAHVRLQLLGHRRQRLRAVGVRRFDQEVAVAVAQRARRVDDRRHAVARTHALDRAAGPQQLAGEAQVLPAQHAGQGPQGAAFG

SEQ ID NO: 1020258 - protein, 80 aa, Homo sapiens
ETLAVLDLDHSYLFIQGPPGTGKPINAAHAIVALLRAGKRVGVSSNSHKAINKLLGEVDPLAAKASFRFSGVISPTILYA

SEQ ID NO: 1020259 - protein, 160 aa, Homo sapiens
TRIVARMALVPRTLEARGLDATPLIQHKLRQVGTPDALAAVAILDTILREEVGHVAIGNHWYGWLCTRDGLDPVAHYAALVQRYEAPRPKPPLNEAARRAAGFSEAEMLLAAARLNRLHPHCHPRAIGGSSLQCQQRYATPLPPALAPAGGIRIARYPAH

SEQ ID NO: 1020260 - protein, 48 aa, Homo sapiens
LGAAVGLADAGVLGDVVHAFDDDAVLLDEDLEDLALLAAVSAALGLGA

SEQ ID NO: 1020261 - protein, 255 aa, Homo sapiens
LVCSLSDVYQMEKDIAMEQERNARYRTPKILEPTAFQEPPPKPSRPKYRPPPQTNLLAPKLQFQVPEGLCASSPTLTRPYGVSISRELTAHPDRLHRHNVFKRHSMREEDIHPITSSLEEAQQRVERLKRSNMRQILDEQQKQMVEDYQWLRQEEKSLDPMVYMNDTSPLTPEKEVGYLEFTGPPQKPPRLGAQSIQPTAKLDRTDDLVYLNVMELVRAVLELKNELCQLPPEGYVVVVKNVGLTLRKLIGSVDE

SEQ ID NO: 1020262 - protein, 191 aa, Homo sapiens
LVCSLSDVYQMEKDIAMEQERNARYRTPKILEPTAFQEPPPKPSRPKYRPPPQTNLLAPKLQFQEEDFIQPSSREEAQQLWEAVVWLRQEEKSLDPMVYMNDTSPLTPEKEVGYLEFTGPPQKPPRLGAQSIQPTAKLDRTDDLVYLNVMELVRAVLELKNELCQLPPEGYVVVVKNVGLTLRKLIGSVDE

SEQ ID NO: 1020263 - protein, 98 aa, Homo sapiens
LDTVILDVEVQGQRLVGIVGQLWGPKGEGPRFLHGHRLHELEQVTAHVQGGTLCLQKPLNVLCGFPTATSTTHPHLHGVQVLALEVHICLTVSSVRNP

SEQ ID NO: 1020264 - protein, 232 aa, Homo sapiens; identical to SEQ ID NO: 919423

SEQ ID NO: 1020265 - protein, 81 aa, Homo sapiens
TKERRLGEIQAQEADPSFWNDNIRAQKIQKEKAAISATLNEFKSLRGKVDDAGALIELATEDPGDKSLLTELGASIADMQP

SEQ ID NO: 1020266 - protein, 348 aa, Homo sapiens
GGCDADAGVRMSYPGYPPTGYPPFPGYPPAGQESSFPPSGQYPYPSGFPPMGGGAYPQVPSTGYPRELEATLRLEVIQAPGGYPGAPDMRMGRAPSPYSPVSVTPMCTQDFEEVPTQGGMHGLFLACTPQRTFTVLMEEEVQSHGSIYLVAFAVMDRCRFISNPVMDQIASYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEIWCTKNTHQDIRRNGQMYQSEFGRDCKTWTLRSALHQDILERLLVSMCQWKSVMRTRV

SEQ ID NO: 1020267 - protein, 338 aa, Homo sapiens
GGCDADAGVRMSYPGYPPTGYPPFPGYPPAGQESSFPPSGQYPYPSGFPPMGGGAYPQVPSTGYPRELEATLRLEVIQPLEAILVPHSQGELHPIPEFLRAKDLESHQVEQAVGGYPRGDAFSRLDGGGSKRTRFQYLVAVLEDRMPFSVIREDEPTYPSQIKYRFCCLPIPVFSPVRVAYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEIWCTKNTHQDIREIVRCISQNLDETQDMDTQVSMTSGHS

SEQ ID NO: 1020268 - protein, 329 aa, Homo sapiens
GGCDADAGVRMSYPGYPPTGYPPFPGYPPAGQESSFPPSGQYPYPSGFPPMGGGAYPQVPSTGYPRELEATLRLEVIQPLEAILVPHSQGELHPIPEFLRAKDLESHRIKQAFLDIHSHLHSLIKVIQHKFHYLIDFPKRQIPSRYPRKQPTYPSQPATVTQVTQGTIRPAANFDAIRDAEILRKAMKGFGTDEQAIVDVVANRSNDQRQKIKAAFKTSYGKDLIKDLKSELSGNMEELILALFMPPTYYDAWSLRKAMQGAGTQERVLIEIWCTKNTHQDIRRNGQMYQSEFGRDCKTWTLRSALHQDILERLLVSMCQWKSVMRTRV

SEQ ID NO: 1020269 - protein, 119 aa, Homo sapiens
MREPPLLLDTIGGPQGIHGPLCEKEFTSSLPPEGPSLPSCGVLFGTLDYEEKDKMDELGLWGSACTTLGAQGPQHPPGQEILGYLSAGVQVLHKGYSSKPPVFHSCPQLKGVENSQMEK

SEQ ID NO: 1020270 - protein, 87 aa, Homo sapiens
LNPGYEPETVPHLNNTADTIRNKKSKDTTACGEEDWARIFRVQRELATIHAVCPLGSQSPLDGSRKIMKGTSREHDKDEVYTVLHGD

SEQ ID NO: 1020271 - protein, 73 aa, Homo sapiens
IDSSNHLSDRQIRVIRSLWYGIGVGGVLIAGFIILYPGHTDLWGIPEWIAGIQSMPSRRSRSGGRRDRGDRQV

SEQ ID NO: 1020272 - protein, 293 aa, Homo sapiens
MCDDGEPSQQAHSSVQDVQWLTWLLDVPCTIRFVADSQKIKEPRMSVFIRGISLVQLMHQCEIWRELFSPLHALNFGIGGDGTQHVLWRLENGELEHMRPKIVGGLGGHQSITDITARAGDWVASRPLCNLVNEQTATRPGLCVLGLLPAEANDSEYHFGRRTREVNRAGTGVHCTWHPRDPLPRCRALALCTHYGSNQRIMTCMITLQSEPSGLTDLFAGICSHLSFLRLMGPRTQGKGGPLCGDRDLRIPGWLSHKINCPSSEAPQIPSKTNINTRATRRTTPGGNTLQIP

SEQ ID NO: 1020273 - protein, 302 aa, Homo sapiens
MMCDDGEPSQQAHSSVQDVQWLTWLLDVPCTIRFVADSQKIKGKKKTPPPQPRMSVFIRGISLVQLMHQCEIWRELFSPLHALNFGIGGDGTQHVLWRLENGELEHMRPKIVGGLGGHQSITDITARAGDWVASRPLCNLVNEQTATRPGLCVLGLLPAEANDSEYHFGRRTREVNRAGTGVHCTWHPRDPLPRCRALALCTHYGSNQRIMTCMITLQSEPSGLTDLFAGICSHLSFLRLMGPRTQGKGGPLCGDRDLRIPGWLSHKINCPSSEAPQIPSKTNINTRATRRTTPGGNTLQIP

SEQ ID NO: 1020274 - protein, 97 aa, Homo sapiens
PEDPFDWRHLHVHQGQSGLKHGNRGKRQALKSASTDLGTADVVLGRVLEVTDLPEGITRTEADKLFTQLAMSGAKIQWLKDAQALPGGGGGDNSGTA

SEQ ID NO: 1020275 - protein, 102 aa, Homo sapiens
MQSPAFSIAADVKDAKGAQSNENLSDSQQEPPKSEVSEGPVKPFNWDQNVQSMETQIDKAQAVSQPVTPCELSLYLLNLLNLQKPGGMEGGTAEATSSLTGR

SEQ ID NO: 1020276 - protein, 107 aa, Homo sapiens
PSPTIPPSVSEEDLKVLFSSSGGVSKEFKFFQKDRKMALIQMGSVEEAVQALIDLHNLRTSGRTTNGAGSPSSKSHQSRGTGPTRPGHPGDNFHHSREKPRLENRLK

SEQ ID NO: 1020277 - protein, 97 aa, Homo sapiens
HVIADTAVFLCTLNRLVNILLPRVKAAVERILWGLHRRGHKVRELVVLKPGRLVVQIAVPLFKVLLHGGFQRVLFLAARRLRRESVKLCASLFQAAS

SEQ ID NO: 1020278 - protein, 83 aa, Homo sapiens
ETIQTEYTVYMDELSSFIVAKPNIPWVFLTDPKLATEGYFGPCSPYTVYSCGAHSSGQEPEMRILTQWDRSLEPMQTPVVGRL

SEQ ID NO: 1020279 - protein, 79 aa, Homo sapiens
YDKDNDGRLDPQELLPWVVPNNQGIAQEEALHLIDEMDLNGDKKLSEEEILENPDLFLTSEATDYGRQLHDDYFYHDEL

SEQ ID NO: 1020280 - protein, 72 aa, Homo sapiens
VSPTPREGEEADHLRSGVRDQPDQHDETPSLPKIQKLAGHGVGDKYVMLSPTPTEAVSPMTWGSGPEDPPSF

SEQ ID NO: 1020281 - protein, 141 aa, Homo sapiens
TRLESGAGGGRDAELRSWVACLVRPLTDHLEELGNPTWYARFAAQAMTDPAYYNIIVKGALSSPSLVQVVEGINRCLPDLPAEVHFERNVMARNLLMHTCADRERALAAGTSTSHRSWRAAASGLIDAIVGLWLAPVTPYE

SEQ ID NO: 1020282 - protein, 114 aa, Homo sapiens
VSFMNWDPDDQLHASCLSLATAPSLTTLSFYGDSISIISLQSLLQHLIGVNSDATCCILSAWRVMRTIHGTLPLERLAYLHPRLRELLCELGRAQHGPGFVPSPVLHCGDQNLL

SEQ ID NO: 1020283 - protein, 342 aa, Homo sapiens
QHLPTEFIREGDDDRTGCREIRHNSTGWLGMKGPWGQGPENLAGDWFNHNPFQAKLGAEAHQILQGRGKVDQKIHEAGKVLPVENAPSSLLKQLNEQLNWVSRLALTQGEDQYYLRVTTVASHTSDSDVPSGVTEVVVKLFDSDPITVTVPVEVSRKNPKFMETVAEKALQEYRRKHREEGDVDVAFAPTGASESSSPQDELQPPRESSARDQVTRPQASGRQLRPAFAVWILHSGTGGVVLMGRTELLLHASDSIKLSWEAGKRGAGVGGGRGGGGRGGGGAGGGEWKRMEWGTVFELAWERPWGPRLKRLGAGPLARAGMAGRAGRRAVRRGGGAEMGGG

SEQ ID NO: 1020284 - protein, 142 aa, Homo sapiens
DDTAKVNAAITTVSPQIGFTFIEHGKDANGVVSWTGQSSTDPSLFANVVILPATKMQQQTISVAVHSTGHIKATDENAFIATVHAQYHAAKASPSPTDTCSAAEHRLDAGDPLRDAPEVGVTGIQDDEPGDQHAANPDAVPQ

SEQ ID NO: 1020285 - protein, 152 aa, Homo sapiens
SRPSNALDNPEPFLHTNVVGTFTILEAVRRNGVRLHHISTDEVYGDLELDDPQRFTESTPYNPSSPYSATKAGSDMLVRAWVRSYGVRATLSNCSNNYGPFQHIEKFIPRQITNVLTGRRCKLYGSGHNVRDWIHVEDHNSAVRRILEKGES

SEQ ID NO: 1020286 - protein, 337 aa, Homo sapiens
REQAALDLYPYDAGTDSGRHPRHPAGHDRNQPPGQPAAEGPAHRQGDTAAAATEPQGQPRPQAGPAGDKEVDSASVPETPLDEVSLWSSWGLCGGHCGRLGTKSRTRYVRVQPANNGSPCPELEEEACVRSLITGRKTRSPAAPGAPRSHGVSGAPVQAHAAGGRGHRGLAAPDRGEAAPTISALKGPLVAGTVHWGNSLLLSQPCFLGAPVSRLALSLLLLPGYKSYPKVSQLRLDIMSPYKLLLLQEIVLHRPGALVPTWLQDTSDLVALAVLSPLSRGTHPSGGPLENVNTLGRHSESVKCIPWYMDLSAVLNTDLSSVAHNNNTHNHNTNNNT

SEQ ID NO: 1020287 - protein, 241 aa, Homo sapiens
PTRGRSLWTGQSWEERSAPRTHRSRAHYSSISPTSYLPLAGGQAVKHRRQEELEPHWPARGRRTSGFKEELRGSGWDPHRCRPCQTISALKGPLVAGTGIGKQPPPFPTLLLRGPRVPSCSQPPPPARIQVIPQGLPATSNIMSPYKLLLLQEIVLHRPGALVPTWLQDTSDLVALGCAEPTLPRDASKRWATGECEYTGAAFGKRQVYPMVMDLSAVLNTDLSSVAHNNNTHNHNTNNNT

SEQ ID NO: 1020288 - protein, 306 aa, Homo sapiens
MPSSVSWSILLLTGLCCLLPVFLADDPHGDAAQQTDTSYHDQEHPTFIKITPNLAEFAFSLYRQLSHQSIRTNIFFSPESIATDFAMLSLGTNCWHWTDEILEGLNFNLTEIPEAQIHEGFQELLRTLNQPDRQLQLTTGNGLFLSEGLKLVDKSLEDVSVYHSEAFTVNFGDTEEAMKQINDYVEKGTQGWVADQVKELDRDTVSALVNYIFYKGRWERPFEVNDTEEEDFHVDQVTTVKVPMMMRRCMFDIHHCQKLCSWVLLMYLRNATVIVFLPDDGILRHLVSASLHLPRLLITGTYDLGV

SEQ ID NO: 1020289 - protein, 286 aa, Homo sapiens
MPSSVSWSILLLTGLCCLLPVFLADDPHGDAAQQTDTSYHDQEHPTFIKITPNLAEFAFSLYRQLSHQSIRTNIFFSPESIATDFAMLSLGTNCWHWTDEILEGLNFNLTEIPEAQIHEGFQELLRTLNQPDRQLQLTTGNGLFLSEGLKLVDKSLEDVSCTTQKPSLSTSGTPQRPGNRSTITWRRVLKNIFYKGRWERPFEVNDTEEEDFHVDQVTTVKVPMMMRRCMFDIHHCQKLCSWVLLMYLRNATVIVFLPDDGILRHLVSASLHLPRLLITGTYDLGV

SEQ ID NO: 1020290 - protein, 33 aa, Homo sapiens
MGEEHEQQMNKYGEEAPEFSNGCSVTGLPQFTG

SEQ ID NO: 1020291 - protein, 80 aa, Homo sapiens
SGKLSLVSEGLQCPSLGDAPYESLMGPWEWAEKRRSKEGQKRGATSYTSAVGFLSPTTLKKSPRVTFTIHVVNERFLNAY

SEQ ID NO: 1020292 - protein, 149 aa, Homo sapiens
HEGPDERPASPIEPTKRRRSVVIDVNVIETSSLGDRSYLATDGEVAVVVDPQRDVDRVLALAGRLGVRISHVVETHVHNDYVSGGLELARLTGAAYVMSARDDLAFARTGVVDGDVLEASPRLRLRVLATPGHTFHHLSYVLEGPDGPQ

SEQ ID NO: 1020293 - protein, 101 aa, Homo sapiens
FNRSYSSPSTVTSCIIYYIKLLYLSPIHQCSSVFLIFSFFVLLLFIQHHPPSASESRCFLVLSVIASLFVKLGQELEDTLSVVIQVGNLTVKEDPGFSEHI

SEQ ID NO: 1020294 - protein, 164 aa, Homo sapiens
MGAGIAQVSVAKGLKTILNQMPPSLRSDRGQQQVFKGLNDKVKKKALTSFEQGFHLQPTCTGQLCITKVLKRPHMVIEAVSAGPSVLQHRVLKRKSQAEDSSITDILCTITHLTLPNQCKLACLSATQHLRTVIWHATTIYSRGQDAARWQIINERENLPKDTT

SEQ ID NO: 1020295 - protein, 102 aa, Homo sapiens
MPPSLRSDRGQQQVFKGLNDKVKKKALTSFERDSIFSNLYWAALHYQGFEKADMVIEAVLCRTILSGTVWMDAHSRRVMLQIADPLPSNIIGSPITGTRLLV

SEQ ID NO: 1020296 - protein, 89 aa, Homo sapiens
WGALVARLHVSASSCSSLPATLLANHSLGELDLNNNCLGDRGILQLVESVRQPGCLLEQLVLYDIYWFEEMEARLQALEKDKPSLRVIS

SEQ ID NO: 1020297 - protein, 100 aa, Homo sapiens
RTQAVDDDDPQGERDLATQVGRAQNAREGAEHVDVLQNGMPARAARTESQVIPQPPQSRRRRLRGNANRGRSMLRPLSATYLTLPPAATVFCSAEPETLS

SEQ ID NO: 1020298 - protein, 181 aa, Homo sapiens
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYNGGGTAKPPQSSRCWDAVKYLIDLGNCNTGIFSQRNLLYYKLDEGLPNHDLRLLASPRMEEPGQCALQ

SEQ ID NO: 1020299 - protein, 234 aa, Homo sapiens
VIVLAEDDEGVLVSDSDDFGATSAMENPGIGKRLQIGDSPLVSSGSPRVPEAWAGCDDLVVQKSWGNPQAPFSTWCGRLRTLGLRGTTWLYGFQPLHLGKKWPCGKPGDAQWTVLLRERSRTEDGDYLLQSTTTGPPTCSQLRGTPLSTTCARGTVLCGTCGQPADKASASGSGAQVGGPISSGSSASSVTVTRSYRSVGGSGGGSFGDNLVTRSYLLGNSSPRTQSPQNCSIM

SEQ ID NO: 1020300 - protein, 234 aa, Homo sapiens; identical to SEQ ID NO: 1020299

SEQ ID NO: 1020301 - protein, 147 aa, Homo sapiens
MEKAGPGPWGGGGAGAGARAWSGDRRWGGGLGAGGSAGGGGGGGGGGGDERGGRWGRVERGGGYGRAGGAGRGRGVTGGREHAGGTGERLRRVAGVAAADGGGDGGRRRREGVHGRGGTGGWREWEGEGGVGGGGRREGGGWEGRGG

SEQ ID NO: 1020302 - protein, 77 aa, Homo sapiens
RRYKVSLKRPLVLGFTVFPRNLWLLVECSRPPSETPNPASVVASSVVHSLIGILQFVLVGCNIKLPHEGQRLEVVVQ

SEQ ID NO: 1020303 - protein, 117 aa, Homo sapiens
TRPVRAYIAAMPDWKRPIGARLDALIERAVPGVHKAVKWNSPMYAVAVGAGWFLSFHCFTRYIKVAFFRGAALTPPPPEPSKSGDTRYLHIHESGLLDEAQFLDWVRQAAALPGERM

SEQ ID NO: 1020304 - protein, 48 aa, Homo sapiens
DDTRYLRRERVRGGRYGCRIDTRDRDRRVVPNPTEDRARTDRLHPRRE

SEQ ID NO: 1020305 - protein, 91 aa, Homo sapiens
MSPRSGFGAESADGCGRSLGAGQADDVMTGGEQFFDDGRADSSAGAGDEYAHELLLLSDETMVPSPYTSDGTKVASLKWGHGSLGTRRART

SEQ ID NO: 1020306 - protein, 297 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSIMLISVMLHSLWLVIHLDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 1020307 - protein, 280 aa, Homo sapiens
MLYLIGLGLGDAKDITVKGLEVVRRCSRVYLEAYTSVLTVGKEALEEFYGRKLVVADREEVEQEADNILKDADISDVAFLVVGDPFGATTHSDLVLRATKLGIPYRVIHNASIMNAVGCCGLQLYKFGETVSDTWRPESFFDKVKKNRQNGMHTLCLLDIKVKEQSLENLIKGRKIYEPPRYMSVNQAAQQLLEIVQNQRIRGEEPAVTEETLCVGLARVGADDQKIAAGTLRQMCTVDLGEPLHSLIITGGSIHPMEMEMLSLFSIPENSSESQSINGL

SEQ ID NO: 1020308 - protein, 159 aa, Homo sapiens
MLFSPRCARCRPTPTRAIGDKHHRHARRRLKGPEPDKRISCIRSSQSRVRCESSSMLREIVLDTETTGLDPRKGDRLIEIGCIELVNRIPTGQEFHRFINPERSVPAEAEAVHGISTAFLVDKPVFSKVAGEFLEFIGQDALVIHSATFDVGFLNMELE

SEQ ID NO: 1020309 - protein, 110 aa, Homo sapiens
LWKTGRRATSPQKAGLHGLGELPCRCSRQAQPLTRRELLLTSRSLGRLSPERTSSREMRLWPSRRSSYRSLMCLWALMRCLLTHLVKVFFCTRSRSSAMRMTARSAGSRT

SEQ ID NO: 1020310 - protein, 413 aa, Homo sapiens
GGAAVLVVLLSWWCCCPGGAAVLVVLLLTQPRLHLQLGHDALKTLQPLKLAAELLLPLQDGHVQLAPLLLHIQRVVARGHLELACLHRSLQGLVDALGPVLVGLLGWELHLLKLQELRPQDLNLLEAGGEPAFLKGGRVVSHPLKQQQHQLPVLLPAQLQLVGPHPILHVRHAGHGVIQRRDVGDDGLLVGLRDIHVLRVQEPRHSQVPLRHREGLVQVLQVGLPVHLVHVDEQGLVPVDDGIEEAAVSPAGGEVVASQALVPLHHSLRHSSSFSLAVMSSDCPLTWISEIWKLQNDGPDEAKGQLGVAVSDVIIPDVHQLHLAVPEVVQGNLDILQLVETHPPLLPGQAVPREDLQQGDEVVAIAEVFIQVTDVPLGLDEVLVDPLGEGFLLHTIPLICDANDRPLSWVQDT

SEQ ID NO: 1020311 - protein, 206 aa, Homo sapiens
QGKPDLGHTEGSAPSHSARRTTAGRSGGRTSSARSPSAEGVDPIVHRSAHDVASVDRPEAVHISRRQQCLVVVVEILLEDAAYEDRIGPPSACFVCQVSGAVDDVAHVDDIVDSAAAESRLDHEHSAVVDADADLQGVDPLLRVVVVEELDECVRLIGNAKHIVDVRLLRGLVHSPDAVPNDIHFPNVQIGVQHRHHLRDERAIYL

SEQ ID NO: 1020312 - protein, 155 aa, Homo sapiens
DLQTPQSQEVELRDSKDDDDIDLFGSDDEEESEEAKRLREERSWHKYRIKRKPNKPALVCQDLPYLLCETLGMMRDMAIRRSASASIQARRLMSGAHTKLVPVAIELRQLQHTACMIEGLIKGWKQDYCLEGARSPAFEGLVCKSNEMWLLSNKI

SEQ ID NO: 1020313 - protein, 172 aa, Homo sapiens
NVTDYRGKSLVSCFHPLDFTSVCPLTILAFGVQSCRIQISYLSEVVRMLCCFTVDPFGLWLIPLKYKERLGPIKIPVLSDLTHQISKDYGVYLEDSGHTLRGVFIIDGNAILRQITLNDLPVGDQRMRHYVWFKHSSTVSNTQASRPAGWNPGSQTIIPDPGGKLKYLDNPH

SEQ ID NO: 1020314 - protein, 110 aa, Homo sapiens
TRRLEARLSVRPELMATNGFLHAATVIALADTSCGYATLAHLPEGASSFTTIELKANLLGTVREGGIRSVAQAQHLGKSTQVWDAVVTDEGTGRKIALFRCTEMILYPKE

SEQ ID NO: 1020315 - protein, 101 aa, Homo sapiens
TDASSTGKRPRQRPQPARQQGLRHGALSRKSRCSSSVQIAGGQRAPLDRLTMVRVPLAKCGDIHAVKVISFRTWRIIILESSQPKNGAFHGINAVEGLDLV

SEQ ID NO: 1020316 - protein, 106 aa, Homo sapiens
MTRPGKQVLMSNMQTIQAGVPGGLLVGHPWVHPLLGGSSAERKAELCKACNHFPGSFKGTKQAQSNKLSFYISNSFLECAQNQGDIKLCKGFNEVLNKCRLATDLA

SEQ ID NO: 1020317 - protein, 225 aa, Homo sapiens
THCKVINWETGSEGHRNNCHRPSSLSVDEAGQGRPPGWGLGREGSQSLEKVIGFHVPMFSVCGLDQTSRRSLRSAAMLMFQDATVEALGHQKWSREYSRLTFGALHRHGGSVLEILGRQSLKAASSMTSLSGNTRLISPLPRASSAIILRAVKASTTRLWFPMTLGRRCSPTAAKPTFTFFTWKKASWAQYRMLQAVDKVHSANTAPMDGSYYGLWAPDDVEGLV

SEQ ID NO: 1020318 - protein, 60 aa, Homo sapiens
MRGHGVAPGEQRKENGQDKSSRSLGMQQLPERCLVPQEAQHDSGPCCPGDSPDTGPHQAW

SEQ ID NO: 1020319 - protein, 80 aa, Homo sapiens
LNGATLDNRDGGTVGSTKALTLEVAEVDNRGGEISSSEGLSLLGTRLDNSDSGKLLAGTDLGLREAQVINQNRGLLFGKG

SEQ ID NO: 1020320 - protein, 138 aa, Homo sapiens
RGDVVPHHVDLAGQQILVRRRAALVRHVQQVDLGELLEELATDLRAGAGAGRCEGVLTGILAGDGDQLGHGLCRQVEARHEEVGHRPQHGDAGEVLAGVERQLGVERRRDGVAGHGVEADRVAVGRRLGDRIGADIAA

SEQ ID NO: 1020321 - protein, 172 aa, Homo sapiens
MAIAVVLAATRLLRGSGSWGCSRLRFGPPAYRRFSSGGAYPNIPLSVSPYLRCTRMPSVFAHRLQWHEAIEFRKPKVSHIGVMGLRVVISEYTFWTVLYSRNSYQFRIENMKRQYLSGIAHFLEHSASYALHARMLTAKRMNILLHVGIQAWGVSVTARPLNDDNTMYAVSC

SEQ ID NO: 1020322 - protein, 89 aa, Homo sapiens
MAIAVVLAATRLLRGSGSWGCSRLRFGPPAYRRFSSPRYRKGNATSGIRNHFDVIRRTVHGQPSIKTADIVGVVGVLRLEGWFCSRASV

SEQ ID NO: 1020323 - protein, 132 aa, Homo sapiens
MPVTCAFEFAISAGNEFVIEPVFQGARLFQRFLKTARHVAVGLLEAIVCGRGLTYLVDQITATGRTANSQSAQQHEAQRRKRDRDDQHRQCARYAGDARQYHGLGAGRFVVWTFVDLGGQVIEVLQRVRNGF

SEQ ID NO: 1020324 - protein, 235 aa, Homo sapiens
FELFPVISGMYRAPPHTSYPPYAFGDEAPHSLCNGIPVDTKHLQQLRLPTSWYPVNCQVGDSDARFAHYCTGHSLTNATFIIMVLHGEDPALGGTSAVENYFFVQGLFEGVQHADVDFFFLQQFGSGQGLVQGHPSPDNGHLVILALQDHLGFFDLEVLIVVIDDGIWAVGPVEADTLCIGGQFHCFCSNAITWDIKVDVGIDRNIARSSRAIWEGPSSPMETPQWEPQRLMLLS

SEQ ID NO: 1020325 - protein, 31 aa, Homo sapiens
MPPSTSSTEAITHTGPRSTPRHPIRVRGVIS

SEQ ID NO: 1020326 - protein, 121 aa, Homo sapiens
EDRVRRAPSQALDRPDQGAGDPPTPALSAFSLQEVPLPPGTSDVGAGTNRVGRNPSVPDVHPPRRDAPSIFRDSLSPYTGALAPVINQQLLCTGELTNIPQSRTAPSPILGVPSNPGPSTA

SEQ ID NO: 1020327 - protein, 85 aa, Homo sapiens
SRHSEFIVTVREWLHTRLDEYAFRGLPRYWCVLARGTCRVPHAAHGVGLPYCSPVTDRNTEVSTCWKRTVASRSQVLSQSSGTVQ

SEQ ID NO: 1020328 - protein, 136 aa, Homo sapiens
RGVNCGLCLGDGDAIGIARIVLVSLFSLLQGELRILLLAVRDVTHGARYRFTSRLRGGHHIGLLAQYISQIRVLAHCGVRGSGIPVQRRQILFLICRIGNCDGAGRNPGLRETFLATAVTLRDHGADATSVFPRSR

SEQ ID NO: 1020329 - protein, 87 aa, Homo sapiens
RHQRDVALLHALRLQQVVNHVGLAVERGPDALELPLVAQEQRLHAVAHVVAPALRARHAELGQVLDGGVFRQHRVEHLAADAGAGVA

SEQ ID NO: 1020330 - protein, 79 aa, Homo sapiens
MKATSVLCKPTPKNSSVHFLHGIPVSAIKLPLLDSSVSECILPRAFCCQMMVAPLPPPFQPFHHVCFPGYLSWIVYVDQ

SEQ ID NO: 1020331 - protein, 133 aa, Homo sapiens
ACSSLSFCVRSPPSSRASPLILPPALSPLCSLSGRVVSFVVTIALSVRSPHWHLLYVRHLSRARPGSSLNDVRFVQLHFEREGFVVSLSISFDACFSLTWRTAGVYVACLHRLLFILTQGGFFTVLVCAGRLG

SEQ ID NO: 1020332 - protein, 110 aa, Homo sapiens
DNEDRGSSKLQSRNRRSKKSRSGFLRLPSGLRMFSICWLRLLEGGVHNGGHRSRTTLESVSPVVAVTIVSLLLRWLGQEAEVETSAGRTRGTRRSRRAGGTNRTSITSAT

SEQ ID NO: 1020333 - protein, 81 aa, Homo sapiens
DAETGKTTAASRYASNHHCEHYKDHHHDAEAHPALHSGGPEVQSNISHELSLREYRNNSQAGRGQPDRCHTEQGEQDPDSA

SEQ ID NO: 1020334 - protein, 155 aa, Homo sapiens
TGGQFAQPIAQRLESALVLFDELSQRAVVRHARQPPGERGAPPDAQVVNPFVIDVLAPPESFERLDLLTDERKVVSDVDPFPAGGCHAAADTLPRPRLHAAPRQGREIQAETGFLAAGADTFISFIRLPPMIFALSSSLKSSSSTKLIGSFKPSG

SEQ ID NO: 1020335 - protein, 69 aa, Homo sapiens
YVDDADDTPDQSGIEDRGDDVHHECCRDDQEHRYHDEPVVDVLTLHRATSPCLASGRRFVYIPLGPLGL

SEQ ID NO: 1020336 - protein, 136 aa, Homo sapiens
YVDDADDTPDQSGIEDRGDDVHHECCRDDQEHRYHDEPVVDVLTLHRATSPCLAIAWVSMCSPTDNCAEIERGVGVPLRSPENSVAPDTTELGTRLSGGYRRKIHSDDTGGHQLRSDPTGQGVGVGLQQQACLTGT

SEQ ID NO: 1020337 - protein, 104 aa, Homo sapiens
RAPGSRHRLPPVGLRLRANAAGCSCQRLHGLGVDPLLERLQADALQRLDEGFVAFPVAYEGGDDAFDHLGDFLGAEGRADHLAQGTVTALGPAQGDLEPLAAVL

SEQ ID NO: 1020338 - protein, 286 aa, Homo sapiens
PICTARAWCTLMSSLPTSSLGPRGRCKLGDGLLVELGTAGAGEVQEGDPRYMAPELLLGSYGTALDVFSLGLTILEIGMQQWKLPHGGGGLAAVRQGYLPPEFTPRSVLPSLRFCTLYMMLEPDPKHAGQQAEALLELRCVDGSRGASGDVLWCMAAEALSRERWALWQALLALLCLALGMGWLYPCQLATAPGPAEPPRLAHHPAVCSWTAASPANWDDDSLGPSLSPEAVLARKLVSTSTPRSRCTPRDALDLSDINSEPPRGSFPNFEPRNLLSLFEDTLDPT

SEQ ID NO: 1020339 - protein, 110 aa, Homo sapiens
ELRTCGWASWLTPVIPALYEAKVGGPPEVRSFRPAWPAWRNPVSAENTKKIGRAWWCMPVVSATQEAEAGETLEPGRQRLQWGKIVRLHSSLGNKSKTLSQKKKSLLDYL

SEQ ID NO: 1020340 - protein, 102 aa, Homo sapiens
ATEPRDHGTCWTPGGQEGEFRPLDPRGAPGRWAASESVHTRRAFLDKPWGLGKTLGRDGPEPEFFPVTGCVAFMEPLLGAWRCTESCAQVISSSSQLSPFHR

SEQ ID NO: 1020341 - protein, 183 aa, Homo sapiens
EERPPTPWGSKMPFGELMFSSSCGWGVFSASGSRVAWVSHSTVCLADAKKMAANLAELRLALTFITNNSLVAAGHCFPVLFTYDAAAGMLSFGGRLNVPKQSSQRGLTARERFQNLNKKASSEGGTAAGAGLNSLHKNSVSQISVLSGGKAKRSQFCTTAMDGGMSFWDVKGLESALKDLKIK

SEQ ID NO: 1020342 - protein, 121 aa, Homo sapiens
ILVLATSMWMAFAIDFPLPMASERGQLDKTIVECLKNVNKCWFLSYIKPSEPICGSDQVTYSSDCHLCSKILFEGLNITKLYDGQCVKLLNVRQRIIKPTESPDCQVKHNGCLFKYIPFNY

SEQ ID NO: 1020343 - protein, 205 aa, Homo sapiens
SRCCPFLFFRRREDGGHFRSEACLPKARRPSFNNKKRVLLGETGTWRQAPDGTTRPSFWASMTPNGGLLDAAALIIRTTCNNCPSFPTRVNSGAIFDEAETTILYETIEMTNDCNDGPRRDHFRLIPVTSIYLAISHSVIRYQTAFEMQCAEEMNMSVHLSPCFRDVQIGDIVTVGECRPLSKTVRFNVLKVTKAAGTKKQFQKF

SEQ ID NO: 1020344 - protein, 99 aa, Homo sapiens
MDVLLRPAAPKDSAEIAAMSRDLIETGLTWSWTPARVAASIRHRETMALVAEAQGRVAGFAIMEFGDETGHLNLLAVRPRFQRQGVARRLVEWLESCRT

SEQ ID NO: 1020345 - protein, 118 aa, Homo sapiens
RGGHCGAGPQIVQPELPARHVDQRGDQPALQRPGGVDHRGADRHGHRELTIAGAGAHADVPEQLRQRRRARVLVGVPDAQRPAAEVVELAGVDGGAVQFRTQPVQSLRTHHGVNDDGG

SEQ ID NO: 1020346 - protein, 163 aa, Homo sapiens
SACPEPSEGRAAPLGSLSDMNPSVPKFAVVVQPSPIDGMGVFAAEPIPAYKKIGELRGESISVREARRRAKRQQRIMIVEVSDKRAIDASQSPDAMRYNNHSCSPNTVLRIRRGRVEFYALRPIAAGEELTANYRPHESTLRAVANATLGIWGNLTGTESIWI

SEQ ID NO: 1020347 - protein, 56 aa, Homo sapiens
PRNWDHVSALHTDHSMMPAGTSYDRIRRVKVSELACINTRCLTGTVGVINAMGTHL

SEQ ID NO: 1020348 - protein, 306 aa, Homo sapiens
GTRECGTLAGKGRLSPRALARPLRVWSVFSRHPCTARGNVPIAAEARGTPVQQRLEPWSLATAPIPPPAPNAFVFCAPIIQRRLRREEEEEEEEPPKQAEPDGALTFESPPKGSQKGERVELRVDIHPTRRHGEDDLLELQNTSIDDPISAAGKTARKRSLVSHEGAHLSRPPVRRAPSNTALPELQKRTRSVKHKTARTHDGIILALGATPQYPGQLPGMRTDDGHAQATQATEDEPKDGRPTQNRTGRMIPNHGRPQNEERANTRDQRTGTRAPKDTGGRTGGEGTQKAGTIRLRDANNGPRTQ

SEQ ID NO: 1020349 - protein, 109 aa, Homo sapiens
MSRSSILADSGGMMLVKWPKQFDVIVTDNLFGDMLSDIAAMLTGSLGMLPSASLGEVDVKSRKRRALYEPVHGSAPDIAGQGLANPIAMISSFGMALRYSFDMGDLADK

SEQ ID NO: 1020350 - protein, 75 aa, Homo sapiens
RRSICRRKRKEELENMMLLTPDESVFAEPGGNSWRRQGNQVEGGCSVVSVHETSISAFASPFIHLAFIERCWCTG

SEQ ID NO: 1020351 - protein, 123 aa, Homo sapiens
MVRDAYVNQLMLMGIAVTDGRLAYANAADAFVGWISNSKPVEHEDSLCLSCEPEIQKTIYLWLGHYIRASRSVLRLDVVQVTRETLTLLSVTRNDVGPYECGIQNELMCVTTCDPVILNVLYC

SEQ ID NO: 1020352 - protein, 424 aa, Homo sapiens
MELGRRCSTMSTEEIIQRTRLLDSEIKIMKSEVLRVTHELQAMKDKIKENSEKIKVNKTLPYLVSNVIELLDVDPNDQEEDGANIDLDSQRQGARCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQAPKGVLMYGPPGTGKTLLARACAAQTKATFLKLAGPPAGADVHWSMVPSYVRDAFALAKEKAPSIIFIDELDAIGTKRFDSEKAGGPVEVQRTMLELLNHAGCASMPNTQVNGNSSHKHVVDILDPCPPPLCVPALTCKIEFPMPNEEARARIMQIHSRKMNVSPDVNYEELARCTDDFNGAQCKAVCVEAGMIALRSGVPRSSPTRTTWKASWEVQAKKKANLQYNAEHT

SEQ ID NO: 1020353 - protein, 406 aa, Homo sapiens
MELGRRCSTMSTEEIIQRTRLLDSEIKIMKSEVLRVTHELQAMKDKIKENSEKIKVNKTLPYLVCQASSSSWMLILMTNEEDGANIDLDSQRKGQVCCDQNLYTTDVLPSCDWRWWMLKKLKPGDLVGVNKDSYLILETLPTEYDSRVKAMEVDERPTEQYSDIGGLDKQIQELVEAIVLPMNHKEKFENLGIQAPKGVLMYGPPGTGKTLLARACAAQTKATFLVRDAFALAKEKAPSIIFIDELDAIGTKRFDSEKAGGPVEVQRTMLELLNQLDGFHAQHPMLMCNSSHKHVVDILDPCPPPLCVPALTCKIEFPMPNEEARARIMQIHSRKMNVSPDVNYEELARCTDDFNGAQCKAVCVEAGMIALRSGVPRSSPTRTTWKASWEVQAKKKANLQYNAEHT

SEQ ID NO: 1020354 - protein, 72 aa, Homo sapiens
KKKKKKKKKKKKKKTKTMAQWEGTLHLSSRELSFIVHFCHVFEACSTEDQYSTKTNESYQNDMAKVDAAANL

SEQ ID NO: 1020355 - protein, 44 aa, Homo sapiens
MIEIGARVPDATLYEYFETEAGGCALGPNAFSVAEYGKGRRIVV

SEQ ID NO: 1020356 - protein, 70 aa, Homo sapiens
PIPATQSHTSVYAISSQGGLKAWGGMWHGPHWDLINMSDPGPGLSKSLLESLDVGQVSRDVDRLTDYGLK

SEQ ID NO: 1020357 - protein, 66 aa, Homo sapiens
RGLYAFDADCRAAEVEWTLGASSAVTAVLDDTGHDASFPIMRSVHEVLRDRADAIAVRRRMALPLV

SEQ ID NO: 1020358 - protein, 93 aa, Homo sapiens
MWGLMPFLQSRHSMKQVKKSVLLWHTPHEMYELVTQVERYPEFLPWCNKVEVLAREGDSVTARLHLAYAGVKHAFTTRNRNEADRSVRMELVD

SEQ ID NO: 1020359 - protein, 43 aa, Homo sapiens
AHQARYWRGCSFDEDERWTNNFREYNLHRVQLMNSAILLDSPI

SEQ ID NO: 1020360 - protein, 263 aa, Homo sapiens
MARGPKKHLKRVAAPKHGMLDKLTGVCAPRPSTGPHKLRECLPLIIFLRNRLKYALTGDEVKKICMQRFIKIDGKVRTDITYPAGFMDVISIDKTGENFRLIYDTKGRFAVHRITPEEAKYKLCKVRKIFVGTKGIPHLVTHDARTIRYPDPLIKVNDTIQIDLETGKITDFIKFDTGNLCMVTGGANLGRIGVITNRERHPGSFDVVHVKDANGNSFATRLSNIFVIGKGNKPWISLPRGKGIRLTIAEERDKRLAAKQSSG

SEQ ID NO: 1020361 - protein, 182 aa, Homo sapiens
GGAWLTVSPRPQSQPLHTLPVGQVPPFPLPPLEPRAFAKRGRVFWRHFVAGLCSQPQPEQLSTVPSPLCQVPGQGPGGHPGTPITIHPCYSTARSGVGSTFPLTIQEVSSTDYYQPCSVYSVPPWTSQESARTTQSDLELIPNSGIGVSWLAGSWLCRAGGSPSCQQGTEPSAGRSLTNLIS

SEQ ID NO: 1020362 - protein, 133 aa, Homo sapiens
HEGEVVGAIVRGGAVELHPPAGHLPADGAIGNARRSLEQQMLEQVRHAGLAIAFVPATDQVGDIDRGGRLRRIRGEQHAQSVGQPVFRDALGAGNRCGQARHRLAGRCGRSGRWRRSFHRRARGMDRTSAAQR

SEQ ID NO: 1020363 - protein, 167 aa, Homo sapiens
KLRTKITTLNYMYSHEDRDWKSIGLTLQASLAPLGINLKMKNLANATMGERLGKGDFDVSIGSWAPDFSDPYMYMNFWFDSSLQGLPGNRSFYSNPMVDKLIRDAAANNDTAKRTELYQEAQKIVLKDSVYAYLYQKNYTLPMRDSVKGYVFHPMLEQVFNVAEISK

SEQ ID NO: 1020364 - protein, 61 aa, Homo sapiens
SLRVIDRHGGRLCPDPQIVCPDLPCQTELSVAQCTQRAVDIVFLLDGSERLGALCYDRYQL

SEQ ID NO: 1020365 - protein, 153 aa, Homo sapiens
HEAHASMRETAKHSRHRPCAAAPDGRLPPASPAPRDPTAGCWSRTGRRLDSSQCCLPPLAIACAPSRNVRDVRRRVVHRVSVHPGFVMNTPVKSTPAPVAGGGFFEVADWRPEEAAFWQANRAFAIRTLIISMLALHLAFAVWFTWSALVVRL

SEQ ID NO: 1020366 - protein, 406 aa, Homo sapiens
VNEDRMRMWSVPVGEELWVVEGMPWVECGSDGKGPTGSKTRRRVGLKAPGIIPRISVREPMQTGIKAVDSLVPSGCVVSVQLIIGERQTGKTSIAIDTIIEPANLFNDGSDENTKKLLLYLCSVLVKMEIHCGPGGEETYRCRMPVNVHPIVVSATASDAAPVQYLAPYSGCSMGEYFRDNGKHALIIYDDLSKQAVAYRQMSLLLRRPPGREAYPGDVFYLHSRLLERAAKMNDAFGGGSLTALPVIETQAGDVSAYIPTNVISITDGQIFLETELFYKGIRPAINVGLSVSRVGSAAPTRAMKQVAGTMKLELAQYREVAAFAQFGSDLDAATQQLLSRGVRLTELLKQGQYSPLAIEEPVAVIYAGVRGYLDKLEPRQITKFENAFLSHVVSPAPSLVGHYQG

SEQ ID NO: 1020367 - protein, 157 aa, Homo sapiens
MCCVSEVMEQGVTRNRKRHHLLLNQKKNEDTEDAGLDDWEAMASDEETEKSRRKHHVHIEVRENPDEEEEEETKEGEDDEESERTRRKEEGRKRRHVKVMRNDAQVSDEKDSGMTLDKKPSKEMSSDSEYDSDDDRTKEERAYDKAKRRIEKRRLEQ

SEQ ID NO: 1020368 - protein, 149 aa, Homo sapiens
MPDRVLVGTEFQLLDIALRIGEFFQDLRVLHLDHLLQLFHVHLFHVVGPARPLARLQALRAAHHLSQTLEQHQETRDGNQGLEVGQGRPPGGCAGVLLQSPGSLREVYARVSQCQNAGDEEQEVQRQVQPCLEAGRKEAVEHVTTHVAV

SEQ ID NO: 1020369 - protein, 131 aa, Homo sapiens
TRRQHRLLRARFDLEHADGVGLAQHLVGVLVVLRNVLHAARQLRMRGIRVRDHRQRAADRGQHAECQHIDLQQAQRFEIVLVPLDHAALLHRRVLDRHQPRQLVPRDHEAADMLRQMARKAAQLRHQAGPL

SEQ ID NO: 1020370 - protein, 39 aa, Homo sapiens
MIFLFAYTILRFVPNKLGGVLALLLSILILTIIAVSLDG

SEQ ID NO: 1020371 - protein, 228 aa, Homo sapiens
IPVSSEEPVSEKALRFRVNWHHHVIAGVVDDVIAGRRKDVVINVPPGSSKTELVAINVMARGLALNPYARFLHISYSDDLALLNSETAREIVQSDEYRALWPLEIADDAKSKKRWNVVVDGKKAGGVYAVSLGGQVTGFRAGHMAPGWQGAIIIDDPLKVEDAYSKTGRSKANRKLVSTVKSRKASPDTPIIVIMQRLSQDDPTGFTSLGITGALECLRIRLLICYVP

SEQ ID NO: 1020372 - protein, 210 aa, Homo sapiens
ARICPESCAEQKPREELMEDTGPYGPTVGGDLSCYHDRAPPSNWLCLFPHTALACSLIGQADPQQQLEGAVKRKAASVVLVGHKHSGHLSLSGALTWEESYEMNIGMSISVGMAGFGLLVRNGWRFGRMPLRRRYAACLVPVLHWKEFKYAPGSLHYFALSFVLILTEICLVSSGMGFPQEGKHFSCSGKPRLFSFGAGTYMCLVNLLVT

SEQ ID NO: 1020373 - protein, 80 aa, Homo sapiens
AGVNRPRQLPSLCAVNKCGPAQRGVGAETCEATWERLGSRLRALRPGLGACASLEPPCPAVVLPPSRLSTLPWSTCQLVH

SEQ ID NO: 1020374 - protein, 114 aa, Homo sapiens
RRCEGSRRHVCAYAMGWACGTAPEFLSKRNKRTYRTEPNNLEGRNFFRFNGLSSTEECGRGARSPPHFYVRTTINKNGCATLRRIRHMIRKNKYRPDLRMGDIRKGRGILCRQA

SEQ ID NO: 1020375 - protein, 147 aa, Homo sapiens
KGFLPAPSLTLRYMCPPKYQPSQGEKPQLTEHLLGARNLLTNDIKILQQPCQTRSYFPYFTDAEPDAQQRGKDSRSLDPPRKRCQLDQQEAGGEQEAAMNQSLENSRISEERKNFSPAKSFMRWKGISYLLYCILIMVSINPLGRCP

SEQ ID NO: 1020376 - protein, 71 aa, Homo sapiens
GTRAGKENSISGPMVCPGELSTGLSTPCGIQRAKMQNLMPSKGERIAGALIHPGRGASWISKRLVENKKLL

SEQ ID NO: 1020377 - protein, 83 aa, Homo sapiens
MHQPHVANHHAIARQRGQAGEVQRQILLRHGVAQAAQQEHDRLLHQRHGDPLAGTAMMIGGLRTALRDEVEGRGRAGQEALRE

SEQ ID NO: 1020378 - protein, 174 aa, Homo sapiens
MRTKTTLTRRISICSSDKRIACEEEFSDSEEEGEGGRKNSSNFKKSQESQTQRMNKEKDPEEKKEVTKRRKQGGEARSQRGQGGGPVGLNGPLQLWLPAESLTFLPQLLSMNIFYISVYLYTNFITYNFPPGTETKAPSSGQLSWVKLFQEPPCQPFYPYLTLNRAEDVRYRAR

SEQ ID NO: 1020379 - protein, 72 aa, Homo sapiens
MELYLHLLLAVWFKFRCLVSSFSPILSVTSSGTYRCVATTQMGRASCYLTLSVTEPSQGRVAGVSDWGAPGA

SEQ ID NO: 1020380 - protein, 118 aa, Homo sapiens
RVGRSVMPNATPHVVIFLEAKPGAGVTNRSASPVSSLSSLCVVVVVYPLSQSIQAPPGFGFYVNSFMRRCPDNIHHRRISHTQPTYTFVLRVTHGRSGKSWKNHVFFFYSKRLSKTSK

SEQ ID NO: 1020381 - protein, 357 aa, Homo sapiens
PVGFFKVDFNKNGEIMHSVETVPPPPPLERYLPAISCLSPSPRFNPGILVVSPEAKGRGQRALPRPDASCSLEVLRQGADGKEGSLWGATRGLDLCREATSHPISCFWVPAPLCGGVVCVFKFSLWEQIDKKKLDERGIKLAINVATMVAPGFKKTNKKQKKNKTFWWARHMAPRENGSYRETIWVGAPEGPQDKDTGNTWAPNRGGPKRATPRGHRETRAAGEIITTQIKQKSARGGRHTPGRVSSRHNIPREGGSPERGPNKTRGDHTTPRGRGHQKRRSPRRNYNENIKGPARRGGGENPHKRETTDEVYANQRIRQKMTDDDVRANDTDGDDEPTQNTKSRHDTQLGIGQSIQ

SEQ ID NO: 1020382 - protein, 115 aa, Homo sapiens
MTAPVVKTYQLNRFNLGKARSFAPIISGRTKFPSTVGMTGIRKNHTITIPCAVNSLLYNSAVTSAPRGVIRFSRTTVAAAPPTKKKSVTVTIYRIAIRLWSVVNSHDRQPCGSVR

SEQ ID NO: 1020383 - protein, 120 aa, Homo sapiens
MPTRSPSVVISDDEPGDDLDLFCIPNHYAEDLEKVFIPHGLIMDRTERLARDVMKEMGGHHIVALCVLKGGYKFFADLLDYIKALNRNSDRSIPMTVDFIRLKSYCNDQSTGDNKSYWWR

SEQ ID NO: 1020384 - protein, 141 aa, Homo sapiens
TRGDLAGGCHGETGREGCRGAGASGHDERARAVRRCDHDRCRLRRLVRHLRDDDGLAGHAPRRRLDADARRHRDCRRHRHPRFVLRHPAHGERAGVRIVRRVHALPGDGCGLDRAVGGGQLRVRQHPCGACSRRHRDRFDL

SEQ ID NO: 1020385 - protein, 119 aa, Homo sapiens
IHLTRRETGTCARADLQPCRPRADRGRTPRGGARTPTAHWQPSHVWSQRTDLSSAPLRPPSCTQWAPPSQSTGTSWRLGSAGDTWCGPGGSQCLDSPPQMKVLDEAGHVDVAKAKALQV

SEQ ID NO: 1020386 - protein, 118 aa, Homo sapiens
VPPGDKIVNEAVMCLQEGILATPAEGDIGAVLGLGFPPGSGKAFPALMDLYGAQKIVERLKKYEAAYGKQFTPCQLLADTCVTALTSKFYQMSRPHASLSQCTNPSRRQCWFSNRDGV

SEQ ID NO: 1020387 - protein, 187 aa, Homo sapiens
MEDYLLLLECNTLIMYNVSYVRGFPCSVGFMLIQEWVVPRDMVLTREELVILRKCMHVCLCCANIDIMMSMMIHGYEFWALHCHCSSPGSLQCIAGGQVLASWFRMVVDGAMFNQRFIWYREVVNYNMPKEVMFMSSVFMRGRHLIYLRLWYDGHVGSVVPAMSFGYSALHCGILNVDAAANLVVVG

SEQ ID NO: 1020388 - protein, 146 aa, Homo sapiens
RRDLRAVPRHGPIPTADHLEQVADRSLPQRHRLAVQGEPAGRIGVEVRRLHVPAFRDRAAAGPDRVVADGAEDRVPLLPAVEVGPGQLERECVHELPRIARGTPRWRGRGLLARRGRGATGSRFQPGHQRVVAPQPLACDRALGRP

SEQ ID NO: 1020389 - protein, 92 aa, Homo sapiens
TRGIGREMHEPPEVLHWGRPRTGLALREGMVFTIEPMINQGGNAVLTEDDGCTVVTRDGQLSAQFEHTVAVTRNGVRVLTLRPDEKAPNFAS

SEQ ID NO: 1020390 - protein, 133 aa, Homo sapiens
LYFPVSITLYRLQCNASTAENPRTDYYQELQRDISEMFMSDLSTRGVVWASPIIKFRPGSVVVQLTLAFREGTINVHDVETQFNQYKTDAASRYNLTISDVSVSDVPFPFSAQSGAGVPGWGIGLLSLVIAGA

SEQ ID NO: 1020391 - protein, 34 aa, Homo sapiens
VSISSSGVSISSSGVSISSSGVSISSSRSQHFQQ

SEQ ID NO: 1020392 - protein, 141 aa, Homo sapiens
TRAARRRPPHSASKNGAETFAVAGATDIAFALIVPDGRALAVHHVGPRPRHDDLEDEARRLVAHMRVHQWRAAQRIAAVDVAAGIAQGPDDVEPADRCCGHHWRGAGLVAGIGVGAVGDQLLHGTLLTRRSGQMQRREAER

SEQ ID NO: 1020393 - protein, 157 aa, Homo sapiens
TRYEAFFTELKVAMFAAFFVAFPIIANQVWAFIAPGLYRQEKRAFLPFLIATPVLFTLGAALAYYIVMPIAFRFLLGYQVSSGDLQIDALPSIAEYLSTVMQFIFAFGVAFLLPILLMILERAGILSLQQLMAGRRYAIVAAFVIAAVFDPARCHFA

SEQ ID NO: 1020394 - protein, 255 aa, Homo sapiens
MHPEPAPPPSRSSPELPPSGGSTTSGSRRSRRRSGDGEPPGAPPPPPSAVTYPDWIGQSYSEVMSLNEHSMQALSWRKLYLSRAKLKSLQTGPRLCSPASPWLEIGGRCKLERLTHGTTPPGGLLIAIQVPCNNKVLGGWCTVFALNESGTLSLPKQSKAEEQTMHKYSAPVKGVPHMSALHRHIELGWGLTPPVIGTAGLSNLTWSCTCWGKVLPHQDPARHAKAHQGGPRQRRTKPRKDQRDHQRPAEAHENH

SEQ ID NO: 1020395 - protein, 104 aa, Homo sapiens
HEGQTGTVKTFIMESERSPNEEYTCEEDPLDGTIPRYLHQIFEKLTDNGTEFSVTVSLLEIYNEELFDLPNPSSDVSERLQMFDDPRYNRGVIIKGLEEITVHN

SEQ ID NO: 1020396 - protein, 81 aa, Homo sapiens
LRGSALGKASEPPGRFDGDTSVRATPMSRAVGKGKQPGLSLQRGLNIKILLFIPCWKTEFLLVLQMTKSAHCTTTILLNSG

SEQ ID NO: 1020397 - protein, 93 aa, Homo sapiens
TFHDDTFLTIVLYEDQRKHENAPKHARLEGIHPIETATQLRTVMTEKQPGLSLQRGLNIKILLFIPCWKTEFLLVLQMTKSAHCTTTILLNSG

SEQ ID NO: 1020398 - protein, 148 aa, Homo sapiens
MITPSYVIRLTVNDSTFTQYRSWDLAYNYGDPQTGIRSWTLLCTPDVTCCSEQVYWSLPDMMQDPVTFRSTSQISNFPVVGAELLPVHSKSFYNDQAVYSQLIRQFTSLTHVFNRFPENQILARPPAPTITIVSENVPALTDHGTLPL

SEQ ID NO: 1020399 - protein, 40 aa, Homo sapiens
MWVQSLALLSGLKELTLLQAVVQIWLASGAALAYSTCRYR

SEQ ID NO: 1020400 - protein, 218 aa, Homo sapiens
SLHQAEEKPHAPRPNQVLYQGIRFAPLTLTHEPRLRRQESLANGAGRSWITGTCPTGHLPPKPIKREPEGTTVDGETFDELNYIAFLSRLKKKKKKKKGRVFWNNMDPFRLELNENDNTPQFWGWGEYLLMEHYKPNQGQNYAIWGHPVDHNVGAGNSLHIFSALEVEHFYEGTGYRHLLTLNPPGFFWVTTGAREPRGTGQMEGQPRNKPNFSRSTR

SEQ ID NO: 1020401 - protein, 133 aa, Homo sapiens
HEACVRPPPPPDRHRWTSPDAIMQDAPLKPFRFTDAAALVRAGVPVTMVTIVEVKGSAPREPGIRMLVTGDDLIGTIGGGHLEWRGMAIAREMLDAAAHGEASSLAPDATRRIVRIPLGPALGQCCGGVVQLA

SEQ ID NO: 1020402 - protein, 170 aa, Homo sapiens
VWVVGPERQGASWAVLKGSKIKVPSFSETLSALNVVQVAGGSKSLFAVTVEGKVYACGDSHRMAGWWLGISSGTVPIPRQITALSSYVVKKVAVHSGGRDATALTVDGKVFSWGEGDDGKLGHFSRMNCDKPRLIEALKTKRIRDIACGSSHSAALTSSGELYTWGLGEY

SEQ ID NO: 1020403 - protein, 120 aa, Homo sapiens
TRALSLALGSSPAMADPSKDASMLKLAASSGCTVCHSVEPAKNADGRTPVGPPWRDVAARYYGVKDAQKQLVQTVMKGSNPYDSHWKGKAAGLAMPPNAVAINEADASKLVGWILSMDVR

SEQ ID NO: 1020404 - protein, 281 aa, Homo sapiens
VPSLELIQAAEAMKGNRMGRPRGAHSHCMRMSSWELQPAIEACETKRLEQLKTPGPEAKGGSLSPLEILEEQILRKLRKSQYAGSQQFTGKRLRRLPREDIVAQGKVGAIPGNCTCARWDSGSPGPSISAARNGGCGNQGICDEARPMQHVQGHASQEKLISSAKQVAGSTGPGSLVACKVKGDQDSEAMKRLQAAGNAVKRASDNLVKARYRRLQPCEEQENETDGGEREKMVEGIAQIIGTEEGNATRRNEQVEEAAEANWAQNPGRSQYKFLTSQLSR

SEQ ID NO: 1020405 - protein, 147 aa, Homo sapiens
QRDDRRAPRLQEQDHDQHHQRNRLEQRVRDRLDTVPYELRGVVDDAVVHAVREVLLELFHGLAHIVRDLDRVRARGLEDRNRHRGLVVEQRTQRVLRRAQLDAGDIAQIGHAAVRRGAQDDAAEVFLGVQAALRVDRELQVGARQRR

SEQ ID NO: 1020406 - protein, 262 aa, Homo sapiens
PPPGLAFLSCRRGCLHKEQMDSAPGFEYSWVPPSQAPPGRLAGAWPHSSRTLLCLQPQFHNGESEESHEQFLKALQNAVTTFVNRMKSNHMRGRSITNDSAVLSLFQSINGMHPQLLELLNQLDERRRRCPRHGASAQGQPGVVSAILGQGLPLRVLSSCESFIGAVASSRECQQEVVSVMTMPCPALPCPALPCPGPSACLPQSPAPSEPSAEGWAQGGHLRVRSTQELLGTVPEWSGLLCHLPTVYYEGLQDKLAQIRDA

SEQ ID NO: 1020407 - protein, 128 aa, Homo sapiens
TRSILNGLRKAAEFTSWREVPNNRFYEDERLFSPVLRVMPAPFAVLFALGLPGLILLLRRPGSGWLLWLPTLTGVATVVVFFAEDRFRLVVVPMFAFGAALWLAWLVHAWRAGNRALATGGLMVSVAL

SEQ ID NO: 1020408 - protein, 56 aa, Homo sapiens
HLLVVCAFPYSLLISYIRSQKTHHQATPWRLGGEGNLLLAPRPARRGASGHTLYMH

SEQ ID NO: 1020409 - protein, 138 aa, Homo sapiens
TRRAPIQAVAAQRIRRTPPRSHAPSRRPRLPIAEHLRLDAPGKRSGLPCPILQGRDGPQPDDAVYEKSFLRGEQLVQGQIPHFEGDARGAGKRHDPLPLHSFDPATAEIGGHQATMEHAEQVAHGAFHHPSPIVQEQP

SEQ ID NO: 1020410 - protein, 134 aa, Homo sapiens
EDYARIKLKQDIIALQEAINAGDAATATSLAKIVEEDYKRVWAYQAQNIALGIQNGTIQNIQNAAKLIPQDMNLINLGNLKSALDYINEMLAKLAKVPNSQDNASANATGKNPVVIPPVVVVPPPVSANPNWDP

SEQ ID NO: 1020411 - protein, 182 aa, Homo sapiens
MCGGNAAVRVMLGLLLLGLLYTREVCPGGVVEPEILEELSEMRYGIEILPLPVMWDVARAQSSGRCVIGTPSKYKQRYECQPARLELFSSSVTGRRKQPAYQGPGIPELLSPMRDAPCLLKTKDWWTYEFCNGRHIQQYHMEDSEIKGEVLYLGYYQPAFDWDDETAKGLQAGSSIRYNSQT

SEQ ID NO: 1020412 - protein, 174 aa, Homo sapiens
LNAVQLHYKDYIFHLIDTPGHVDFTYEVSRSLAATEGALLLVDATQGIEAQTLANVYLAIENNLEIITIINKIDLPAADVDRVKEKIENAIGIPTDDAILISAKNGTNIEAVLEAIINKIPAPKVVENEKELKALVLILILILQRSNYFSKNWFRSIKGGTKLSSWQMGRSLVG

SEQ ID NO: 1020413 - protein, 177 aa, Homo sapiens
MSDPKAVLRYGLDSDLSCKIAQLPLTGSMSIIFFLPLKVTQNLTLIEESLTSEFIHDIDRELKTVQAVLTVPKAEAEVTKGEVTKSLQEMKLQSLFDSPDFSKITGKPIKLTQVEHRAGFEWNEDGAGTTPSPGSAACPPLPSRWTITLNQPFIFVLRDTDTGALLFIGKILDPRGP

SEQ ID NO: 1020414 - protein, 150 aa, Homo sapiens
HEGFDTVMAPCNGCYHNLKKAEYELATSEEALKTVQDLARQADDPVYKGDVRTLHLLEWLMEELGPEGIKARLKKSLNGIRVANYYGCMYTRPRQIFPEKDRGPGSESTHKPHFMDDLLAAAGAVNVDFPLKTACCGGAHTLSGNPGPGG

SEQ ID NO: 1020415 - protein, 178 aa, Homo sapiens
MAGITTIEAVKRKIQVLQQQADDAEERAERLQREVEGERRAREQAEAEVASLNRRIQLVEEELDRAQERLATALQKLEEAEKAADESERGMKVIENRALKDDEKDGTPGNPTQKKLSHHCTKRQIGSMKRWLVQLVIIDRRLGNAQEERAELAESRLPREWDEQIRLIGPEPEVSECC

SEQ ID NO: 1020416 - protein, 129 aa, Homo sapiens
HEGQHVPVDPFGQPDLHVGALLERADLVARNGLQVVRETGHREKVGQVGAEPLVGLGVRVDKAAGARLVVLQRMGADEGREISVLAVQDRHQAELGEFRLAPVVDRHLRRAFHRDRSVVGREGMHRQVE

SEQ ID NO: 1020417 - protein, 97 aa, Homo sapiens
TIWYRDHAHYRYVAIGHWQGRLHLCLLKKPQLHQACSHKRRPKFVVIYEAVTVLEAVNAMAITLTVHHPHRLTPTDDQAASRLYSLVCRGAMALCIE

SEQ ID NO: 1020418 - protein, 66 aa, Homo sapiens
MPDGLFGFAVVDIHADDSFLVGVRVIPAPGAVTTPAAVAPAIAIAPTVTTIEAGITVHHVSLTDAV

SEQ ID NO: 1020419 - protein, 141 aa, Homo sapiens
RRVMASAAGTLKRLTLELGGNDAAIVLEDVDPKEVAPKIYAAAMANTGQACIAIKRLYVHDSIYDAVCDELGKLARETVVGDGLDSKTQMGPLQNPAQFEKVKGFLDDARQNGKVVAGGRVVEREGYFVSPTIVRDISDDA

SEQ ID NO: 1020420 - protein, 31 aa, Homo sapiens
MDLFTITIYTGRNTSSSMTLSELATAMPDTA

SEQ ID NO: 1020421 - protein, 162 aa, Homo sapiens
RGVGQRARRAVLFKVGTAGAVELFEAPERHRDQAVVADRAHAQHAVEALAHQIDPPVGAAHLDFQLRVTRQEFRQAWNDQIPRERERQIDAQPAPQIRLSAGGKQRIQFVEVGNQVATALVIGLAVLGELHLARGAMKQSRTERALQLLHRIRHRRFEQSQV

SEQ ID NO: 1020422 - protein, 146 aa, Homo sapiens
TRTRDELNFFPLIYWPIVPGAQKPSPEALARIDAYMKQGGTVLFDTRDAIMAPPGPGGEARSPGMLALREILSSLDIPELEPVSKDHVLTKTFFLLRDFPGRFNTGQLWVEALPTQDDLDGETENKRPARAGDGVSSILITSNDLA

SEQ ID NO: 1020423 - protein, 163 aa, Homo sapiens
TRPRADDFFTGTRAAICGGTTTVIPFAAQEKGGSLKAAVADYHRRAEGRAVADYGFHLIVADPTPEVLKHELPELIHQGYTSFKVYMTYDDLKLSDREMLDVLDVAKQNNALVMVHAENADCISWLTEKLVGEGRISPRFHGLSRPAAVEREATHRAITFAEL

SEQ ID NO: 1020424 - protein, 136 aa, Homo sapiens [sequence omitted]

SEQ ID NO: 1020425 - protein, 88 aa, Homo sapiens
MVSVAMYSYACPMCGAPLGYAIAVVTKGGREASAGAVMVRLLYTSVSRDRPAPPLPEPVGTLVDAHTHLDACGATDAASVAAIVDKAE

SEQ ID NO: 1020426 - protein, 149 aa, Homo sapiens
MRLLVSELSEAMSDGVRWLGVPMMGSKTLQLDLEDGNGAWNEVQHWTPRMGIQFLCRENELLQNTPCWRSALLPVQGLTGLNKTAIGDYLGEREELNLAVLHAFVDLHEFTDLNLVQALRQFLWSFRLPGGGPEIDRMMEGFRPGILLC

SEQ ID NO: 1020427 - protein, 131 aa, Homo sapiens
TPNCKVWPKQGSQARPPKSVSEDPPPWGQACVGVSRKLGSGQLWCIREGTTSPGHEPFAHSCPILTKYVSLSHPSREELNLAVLHAFVDLHEFTDLNLVQALRQFLWSFRLPGGGPEIDRMMEGFRPGILL

SEQ ID NO: 1020428 - protein, 135 aa, Homo sapiens
SSLTSQKRYSKLPGRSLSYPQKCILPPEELVITKTHHNLHKLSHVGLFEFQEGIIIIHADVIGIALDSTLGHMGAFQPGSTVNFIVLAAWLEVESVGPIYHASLILGALAKPTSYSFVVVLFTIEFFHSSYACGQ

SEQ ID NO: 1020429 - protein, 117 aa, Homo sapiens
SCRIRHATLKSALLMLQSHDQALVGDKSLAFWLMDAEMYTNMSVLAPFTPVIDRGIQLHKMIRLITHGLGGEGYLNFMGNEFGHPEWLDFPSKETNESYKFLNNFDRDMNRLGIGWL

SEQ ID NO: 1020430 - protein, 90 aa, Homo sapiens
RGASGEEKIRELAQSLRQGGVSLAFSSLKKQVREVFEAGGLIALLGKENIFGSFENRVGNGVPEAAVKGGRSPAERTLDAQDREIRWPMA

SEQ ID NO: 1020431 - protein, 130 aa, Homo sapiens
TRVPASVTDPVERSKQAWVAFAADAAGTGPFKMSRFVARERLEVVKNAQYWDAKRVPKIDKVVMMPMPEANARTAALLSGQVDWIEAPAPDAIAQIKSRGFQVYSNAQPHMWPWQLSFAPGSPWLDKRVR

SEQ ID NO: 1020432 - protein, 38 aa, Homo sapiens
QPALPRVSAALLFLTICRSFAAVAVRRQRDRAFVGLIL

SEQ ID NO: 1020433 - protein, 153 aa, Homo sapiens
RGRLEQDLAPSEIEHGRRADRERGKHDLGAGESLLAKRFLVDREVPIRPCAEAASKLVMADEGRLIGFESRVSEHVVRMHVRVDDVADRQRRDRADGLVKTGPDTGAAAGVDHRHGLPPDDEAGVRDVALVGRSVEPNLTSVSISPGRDFGDK

SEQ ID NO: 1020434 - protein, 121 aa, Homo sapiens
MVDVVDVPGVHVREEHRERGECPAGAVLQVEQVVDLLGRQRQRLAAGRHPLLDLRDREAVRSVLGDDVSQVTKQRVEPGTPDALFDEAAEDPLTECAAVLSLAGSGAIGLVQPPLVDVVRD

SEQ ID NO: 1020435 - protein, 36 aa, Homo sapiens
YRSFEDWMTSGLEGDMLFHSHSLAFRVPPLAHFQRL

SEQ ID NO: 1020436 - protein, 121 aa, Homo sapiens
MTIATIATSSPTVPPLSTCDPMRRPTGMCTTDSGSATGSSAPSMIPVMPPLTTAAAADARDPGRETVSARASARRAPDASRRMSGRTSSAFEVDRYSSLTLESMPAPTISSFANPTSREII

SEQ ID NO: 1020437 - protein, 73 aa, Homo sapiens
RIRNTWTSCLTWTARMVAELGRIAVRIPETRRKPKYIYEGPARKLNVSSDIVHPGVRRLSSNLLTDSSKLMIF

SEQ ID NO: 1020438 - protein, 111 aa, Homo sapiens
RGVVTVTPYEDPAEAIRIANDSDYGLAAMITGSDSLKAVEIARQLRTGNVWINAGGNIGNAPFGGFKLSGIGREGGVWGMHEFTEVQHIVLAQLRRRPLAATRPLAATITP

SEQ ID NO: 1020439 - protein, 120 aa, Homo sapiens
IIEDLSSSPVFFFFPLYFVSATYKQDTRTQDVENATSENVSAIHPSVLLMRCIRDCRKPRLLRRQDCRWATKHPSSCPRKNLTMSCNPWSSHHLRGRSLNPPPSLFQAHKLNLPGADIAK

SEQ ID NO: 1020440 - protein, 147 aa, Homo sapiens
MPRPSCGLAGEQALRPDRQDDYQQHEGDDVLVVGRHVEAAEALRHADDQAAEDRAGDAAHAAEDDDHEGLGDDQVPHRRIDQIDRRIQRCGNRRERARDREHQQRDARGVDADQRRAFAVLRHRHDGRAGDRAGQEQMQHHHQREGG

SEQ ID NO: 1020441 - protein, 70 aa, Homo sapiens
MEKRMRSDVRGKSSFSLMRPHEFGNRFVDADRIGDALQALAFAQHTQDLDLAVGELAQRVLGAHAAHYQL

SEQ ID NO: 1020442 - protein, 102 aa, Homo sapiens
MSISPSAAPANCCTHAGVGAALFTPKSFPQPMDQAALGISAQGNHHPSLKIPPKMRRRFTRLFGPLSHGELSDQVDNYPEGLGEVLYREQFDFIAEPPWEPT

SEQ ID NO: 1020443 - protein, 86 aa, Homo sapiens
CLLLSRFITANQYEMCKEKSFKNDGIRDLFEKGTAAIFERLPKNVRAQYIIHLPCSLYPLPHNVQLTLPPSLCSTFQPTSRVVSIL

SEQ ID NO: 1020444 - protein, 86 aa, Homo sapiens; identical to SEQ ID NO: 1020443

SEQ ID NO: 1020445 - protein, 69 aa, Homo sapiens
RVSTPPRAPVRPPATRPPPAAPIAPKAHTPATTHPPLFFSLNIPPKLPSSPTHKLPHSKTPSPTLFSPL

SEQ ID NO: 1020446 - protein, 130 aa, Homo sapiens
MLQANTVLGEYAPMMKRPGAMPGDANKSLEPKIIHLMAASVAGLAIARFSTNIRSVTTSITSRRRTYTYSINNQRIVALLKGIGTVGEKDLLNTVTRSLAQAAATVGKFIDRPCYVIEGNWSVRFRDVDT

SEQ ID NO: 1020447 - protein, 144 aa, Homo sapiens
NGGPGAVELHESLAVDSCAYSFYEDRRSDAKAAMENIVHRMYLSMYSDMITVQNKKHAKNVFGYIHSYLPHSVSRYIRETANYVAAMKYNATIEELVARLQEEAKRPFPILDDKDRELAAAYVNTIVKRWNQLRSREEVQPVVE

SEQ ID NO: 1020448 - protein, 122 aa, Homo sapiens
MGGNVMRSLDLSDMQWTDGFQAGPAVVGVGWRADLARSSSIQTGRGRGNGPRGCPSSAGDAGREAGAFLHQALELLAGVEGHHAASGDRDDFASLRIAAGTLRLVPQLEVAEAGQLDAVALL

SEQ ID NO: 1020449 - protein, 45 aa, Homo sapiens
AAFQDAGGYAYFLRGRLYWKFDPVRVKALECFPRLVGPDFFGCAR

SEQ ID NO: 1020450 - protein, 173 aa, Homo sapiens
TTKHLCMISGSTNSLDSAVMRLRKYRHASIPGSGRLPVIHAVTAYEQTVNQEINFQKSFNNHVRTLVAREEVAIGLMHLWDFVSALEQNPNSKPLMAQLFLIVQHSRDNEAFRDALLNIVKPEGRWLLDLINILQSIVVQERSLSLADKVAAINYSMLSLGKFYARKIYHTPY

SEQ ID NO: 1020451 - protein, 248 aa, Homo sapiens
MLGVILDEGGTNPYIPPTVLLPPLLLLLALLLCCQPSELRLVLRCPVLLGKVVQCVGCPVWLRGGGGWGCRQPSVLRCEAECACLSEWSVCSELRVVYTPELAAPVTCMCHPAQGLTEAAFCVALACSCLVPAAFLALPRLLFAEENPKESKPQAGTALQRMSTRQLTQQRNPGTSTTRSQPNSAGVKTLRWAHAVDIWTQCCSNSRLIVYRGAQTLYVPIVTIEASTGSGSAVLPGAAQRVPDGVWI

SEQ ID NO: 1020452 - protein, 82 aa, Homo sapiens
MATKAVCVLKGDGPVQGIINFEQKESNGPVKVWGSILALTNRSEMAASVKTCRHTSSSLEHPRGAQKYGHTTLSPWVRSRLK

SEQ ID NO: 1020453 - protein, 106 aa, Homo sapiens
LLSQSFLNAAENTLSVSLSNPSSYWHSCSSSLILLTPLQDVDAAYLNKVELEAKVDSLNDEINFLKVLYDAVRAPSSPPSRERESPICDAAGWDSQFFERTPAPLF

SEQ ID NO: 1020454 - protein, 154 aa, Homo sapiens
HEVDLLGAQECRSKCHGHGVCDSSRHCHCDEGWAPPDCMTQLRATSSLTTGLLLSLLLLLVLVLLGASYWYRARLHQRLCQLKGSSCQYRAAQSGPPERPGPPQRAQQMPGTKQANVSFPVPPSRPLPPNPVPKKLQAELADRSNPPTRPLPAD

SEQ ID NO: 1020455 - protein, 148 aa, Homo sapiens
RGFSAAAISSDGGRIGRRAISVRRAAGGGGSAGSLIGNEVFMRVSFPVRDGGGVTIDQTAGQAQRCERRGGFSDVGLTVPGALEQVDHGGEIARGGRQPGAADAGGAQCRGVGDQAMLRRRLRLYAIQGEEVLLFGGVEQQAVRVFDA

SEQ ID NO: 1020456 - protein, 76 aa, Homo sapiens
LEVGGAGLKASETEQIMSHKQIYYSDKYDEEEFEYRHVMLPKDIAKLVPKTHLMSESEWRNLGVQQSQGWVHYIDP

SEQ ID NO: 1020457 - protein, 132 aa, Homo sapiens
RGHVHVEGLVVGRALEYRRQRGHRRLDRSHAVAGHEATDHQTEDGDVLGGHPQRGQTAVQCVGADRSGKDDHVADDQKHGISLCMTDVRGINHCVPAGLTAPPPGNLTKSAAQVNSTRRTKKCRCGLPRSGE

SEQ ID NO: 1020458 - protein, 262 aa, Homo sapiens
MPKRKAAGQGDMRQEPKRRSARLSAMLVPVTPEVKPKRTSSSRKMKTKSDMMEENIDTSAQAVAETKQEAVVEEDYNENAKNGEAKITEAPASEKEIVEVKEENIEDATEKGGEKKEAVAAEVKNEEERLRKKTEEDQNEENGESWKTTDQRLNNGDRRWTHEDYPLDPDDHGDRCKREKKMDNNVVKTETGNGEDGKRRKEKMTHEDEDEKKPGDGKEIDDATRDRGLQKRGKDVKSKKMKREKRIGKKIKVAIEEEGGKE

SEQ ID NO: 1020459 - protein, 119 aa, Homo sapiens
HEEEQGVPRGIGHAGRGVPGRLQRQRHRLVVAPLAQHHGRIERIGDMVDVGQRDAGLLQAVVDRMVGQLPGRERHRPLAVLDMREPFVLGRGDDLAVAHQAGGGVVIGVDSKRVHGGSS

SEQ ID NO: 1020460 - protein, 154 aa, Homo sapiens
RFLVRRTGSKFNAVVLKRLFMSKINKAPLSLSRLVKYMEGKDGRIAVLVGTITDDIRVYEVPTMKVCALRFTETARARIEKAGGECITFDQLALRAPLGQNTVLLRGPKNAREAVKHFGKAPGVPHSHTKPYVRANGRKFERARGRRNSRGYRV

SEQ ID NO: 1020461 - protein, 160 aa, Homo sapiens
HEAGREPERSGAEIRVVAYVVPRQRSNGQAVLVSSCRTGDHRTIKIRVALDRDIEPAFTSPNGCLFGDIGVATVGLALGRRKTGCPAALADAEATALAFLPGVDHLGVLTALQVQVAANISRNLAAGDDAAQDIGIAAGNIATESVPVMWLFTCVALTLS

SEQ ID NO: 1020462 - protein, 141 aa, Homo sapiens
RGDLVVRVTGTAEGTRIDARSQSRVGRSDLGVNAKRVRTFLRELASRLEAERRSAWLIRRFTDPERRSFWGEKSLPTAPKIASSQDLSKSMREEETATHRARERYGHSIAFAEALKVWARVAALSFGGPAGQIAVMHRILV

SEQ ID NO: 1020463 - protein, 82 aa, Homo sapiens
SGDPRSREREGEEERASGKDGPLPPTPEREALILGSQRTAAAAAAGTITRPRATANCCECTGRGPGSGGGGGSRVAVKNVSH

SEQ ID NO: 1020464 - protein, 113 aa, Homo sapiens
MLYNDDDFEPYLSSQTNQSNSYPPMSDPYMPSYYAPSIGFPYSLGEAAWSTAGDQPMPYLTTYGQMSNGEHHYIPDGVFSQPGALGNTPPFLGQHGFNFFPGNADFSTLGTSG

SEQ ID NO: 1020465 - protein, 132 aa, Homo sapiens
MRGPIVVVEPVSSRVTILPGEGLTRVDEHDTHRQVTRIAFRRRQSRIDRRCRCAQDVDGFGRVDASEQRPEHMIDVGDIDVIVDDDTVRSMPPVLFRPAAANNACMAFPVPVCSIYITIINWRAYAHTPLMF

SEQ ID NO: 1020466 - protein, 138 aa, Homo sapiens
RGERDPALVELEVRRGLVTVDGARRYGVVIGDESATAALRTEMRAARPAELPVFDMGPPMETILANCEAETGLPAPKRPGVDLTGEPPRESGPRRVRVGATVSRGALVTGPHGASFSGRVGWGDRAGLLVVDLVRAYT

SEQ ID NO: 1020467 - protein, 124 aa, Homo sapiens
MERSSTLRARTQEAVGSWEVSGLLERHRIQTGAAPAAALLLARAAQSESDGRGPPSYHSMRSNCVHFALCLLVPGPSLDPRQIDGSSSRCQWTWTCPRIKHDLGPPGWTWRLQKDSLNYFPKLK

SEQ ID NO: 1020468 - protein, 113 aa, Homo sapiens
VARALGTGLVSPAACKPKNHPGQKKKKYTKRNEGGLGPKPPGGRPVGPLKGGRFEEFWPELVPEGVQLFKLVPNLGPGLLGVGNRQPGSLEQPPPVKGQVGAKQGVANLGGWN

SEQ ID NO: 1020469 - protein, 36 aa, Homo sapiens
FLQLMFVKATNHTHPLRCGRYRHLPLEHVHGIGQRW

SEQ ID NO: 1020470 - protein, 123 aa, Homo sapiens
HEVDRSADRAPRVVDEDIDRAVLLQHRLHEAVAIGHVGQVGGVGEHLAARGAQLVTHLEQLVLATRAQHGDRAGFGDLARGGKADARGAAGDHDHLALHPALERAIDEQIGIEMGLPVVPQPP

SEQ ID NO: 1020471 - protein, 103 aa, Homo sapiens
YIPQSVSRLKQAAQGPQLQNLGFKYPLGVSYWFHLYGYQSEAEVKAPSLQTLILLAQRNPLISSVASSRSHRDKIRIMPQEEERLLMSYLEALTGAPAELDFP

SEQ ID NO: 1020472 - protein, 108 aa, Homo sapiens
YIPQSVSRLKQAAQGPQLQNLGFKYPLGVSYWFHLYGYQSEAEVKAPSLQTLILLAQRNPLISSVASSSTSIERYDSREISMVMSEKIGCFAVNHGEARADDDYADDM

SEQ ID NO: 1020473 - protein, 57 aa, Homo sapiens
MAHAKHQQFVPAPVSGGPHDRLSSREADQGGADRGQDGNLACRNVGFTWINQRDRFA

SEQ ID NO: 1020474 - protein, 118 aa, Homo sapiens
LTAPWRLLQCCELEAGELGMAVPAAAMGPSALGQSGPGSMGPVVLSEHAARRCYCALWMQEAVPGATAMTAADVPCAAHAANGALCGEVATGRRYGGSFDKTPSVFCWGKEPGGQRKQ

SEQ ID NO: 1020475 - protein, 116 aa, Homo sapiens
LTAPWRLLQCCELEAGELGMAVPAAAMGPSALGQSGPGSMGPVVLSEHAARRCYCALWMQEAVPGATAMTLLMFPVLHMLPMVPSVCACDVCDCGCLPSLVGPSDKTCQLSSCWMK

SEQ ID NO: 1020476 - protein, 181 aa, Homo sapiens
MLVEFMLVQMVVDKDSLRLMSRDTLRLTECLARVHRTLHTPLYYAVNIHQGTTPLQGMQSSPHRHALTFPPRLATGELLPTMHVLHHLGSEQASSEKSFMTIPSCRWTILNSIQITAAVTLLDLFNNTEEQDHCAVQVSTSYELMGDVATLTSILSFLPSFPPTVPFPHMPSSEKTCSSVL

SEQ ID NO: 1020477 - protein, 185 aa, Homo sapiens
MLVEFMLVQMVVDKDSLRLMSRDTLRLTECLARVHRTLHTPLYYAVNIHQGTTPLQGMQSSPHRHALTFPPRLATGELLPTMHVLHHLGSEQASSEKSFMTIPSCRWTILNSIQITAAVTLLDLFNNTEEQDHCAVQVSTSYELMGDVATLTSILSFLPSFPPTVPFPHMPSSGLLAGRLHHFTP

SEQ ID NO: 1020478 - protein, 166 aa, Homo sapiens
DEELSDVLERFSPRFHGVVEVAPRQLNVFRARDVIGDVLAISGWDKWVVPMLDDKRWHAHGRKQRPYLQFGHHRHHDSNGPRARCQPFESRPRRPDLLIPRHIGIERSFELARSPHGHHRIEERLMSNPVVALSRRIRVDLESDQSRGARRISGREQRRGRESGIR

SEQ ID NO: 1020479 - protein, 88 aa, Homo sapiens
ISSPNYGCTGTVGVRLNSILFLRQYSTTAGGFPLALSSLAYREAHPMDTRQQVLGRLICQTPAPASGRSQTERYLMATGSAHLPERPN

SEQ ID NO: 1020480 - protein, 149 aa, Homo sapiens
TRQEFRPFRDIVIDWRQQDGGVRIMALSGRPWRDASGQIAGYRGSARDVSRQVKAEEDLRALNHELDERVRSRTSSLRAAFEELESFSYSVSHDLRGPLRAIHGFASVLESEMTRPDVSGLGKASFDALSRILRAALPMEHLVDDLLEL

SEQ ID NO: 1020481 - protein, 290 aa, Homo sapiens
GDVHLSLRYTSRTFSPFVNGKGSLFLALTYGSLFSKKKKKKKERKKATKHKTHKRPVPPVTLGLTEPPPSHAMGPRPAASHAPPHRSPPWLSFQPHVPYSVLLPASLSSVTKGVDHSETDVLSHLLRLLDAQMSLALFSPFKRCACAHWTPEEAGGGLPRFAHPGKCLNFNIMIILLEEKRTAWAHRLQEYSLGPSVNWPGSPSLCRGCEGSPGWSHGGYSGLCLRGQPLAAEGLPGALQRTARSPCLVRAHPTGSHVGLGRSHGGPPVTLASKALGWAPRLLVRFVIVP

SEQ ID NO: 1020482 - protein, 64 aa, Homo sapiens
MASRSGEVCEPTSASARAPKPYPPLAICCSRIAMTSAFCASVSPRGPALGPTIASVTVRSGYCI

SEQ ID NO: 1020483 - protein, 131 aa, Homo sapiens
HEGTMGVYLHLMKGSVSVREGQRVETGSLLARSGNTGNSTGPHLHFVVQRNVGLAVESIPFNFRQPVNSLPNFAVGGEYARQGLPAALLLRISRRNTVARSRISGVSVVAQWRRCAWRTLRGMRVPRTGLV

SEQ ID NO: 1020484 - protein, 125 aa, Homo sapiens
ISSVPWYGSGKRLMKLRDTALKMKAADVRDISIGLKGFFDGKKVEDYVNQQVNNLPLEKMNNSRCTVVATELKHGTKTVFNYGQYGTGGESISLNTSMFVPTKIGKSEYVDGRFSHVRYLPLPYH

SEQ ID NO: 1020485 - protein, 107 aa, Homo sapiens
LVPDVLEASVRPMLVVILLRCCPHKVQEGSETRAPASEVHPAVKGWGQRPPGDADRRSLMQVPDGPGTVSPGGMGQNTPLPQNCPSPAQRTPHLRASPHVRCALAVL

SEQ ID NO: 1020486 - protein, 77 aa, Homo sapiens
WTVTVGVHAVLDSCNCSSSIICWRIMNFCTLPGHGHRHLLDEADVARHDCRLGARGRCAHVLSPGCACGVDSGNPPE

SEQ ID NO: 1020487 - protein, 156 aa, Homo sapiens
RGASSRYTRAGRRLAKSSSALRIRSSPCSGRFSLGSPSYLGAPTAPSRMASAVRASSRVDAGNGFPSASTPAPPMGASAHSRWSPSRRSRSSTFTAWAVISGPIPSPGRMAIFIQPVNAQPNSHGASARRLASEALILSTCRRVSPMSSRPLSRQY

SEQ ID NO: 1020488 - protein, 102 aa, Homo sapiens
SGEKGEGGDPGLVLVIVSGTSYSPGENSCKKERILHRPKMLVSVLLQSTSGAVEPVARCSWQAPGIVLPCPHPQSRPPNYQGNIFALGPKRVFHQTSPLDDQ

SEQ ID NO: 1020489 - protein, 67 aa, Homo sapiens
SFPQDITLTVNSISLSPNRKLAPPGIRMLAVCRIMPTKNDFFQEELIPARPEKAHMGQNMRSAFASY

SEQ ID NO: 1020490 - protein, 177 aa, Homo sapiens
RGVRSELAEHLCRHAFTLADEAQQNVLGANVVVAQLQRLAQCQLKHLLGAGRERDVTGGGVRALADDLLHLLAHAVQRNVHGLEGLGGDSLALADKAEQDVLRPDVVVVEHARLFLGEHHHTSGSIGEPFEHVILLVSYPGWAGIRRSHLWRCVQANQGARVRMPMFATGVMAVTFS

SEQ ID NO: 1020491 - protein, 111 aa, Homo sapiens
HEARAGTSRGSGSRLRQDSHRRLCGPALGNGRPQQRHGRVTRPFLGGKDGLAGAGSAAPRRRMDRPSEYSLPSTELGARPSRAAMSRLVRPSATRARSRATSGLQGRLPWA

SEQ ID NO: 1020492 - protein, 161 aa, Homo sapiens
ELRTGMCCRPAHKLIVMLTYDDLNERCKRQPQRPAGRRVHRPPGGGSIAFFSRQKVRNQRIGVTMAHAVFSLEQGHKLHMLPGTGGLEQIQPVANGLPIVFFDGGEVRRWPFCFCIVGHDANSLFAEVINARITLPLWTHRVHRTARHYTPPLAYSTCRYR

SEQ ID NO: 1020493 - protein, 181 aa, Homo sapiens
MLTLYDLSHSATSQRQIGGIVALAHSPTTTWLRHKRGTSLAHGVEVRITLDEEAFVGSSMHLYVQLIDHFLGLYVQINSFIELVVLSLQSGEELIQMQAKKRIAESGVIQHLLAEPYRYQFVQAVRILLCWLRQQNVSHAQAFGQVLRFRSKLSLSFPASEIERLSLDEHEQLDLITGYMR

SEQ ID NO: 1020494 - protein, 93 aa, Homo sapiens
QIESPNGFPKWIPKWNPQMESPNGIPKWIPKWNPQMESPNGIPKWNPQMDSPNGIPKWNPQMESRNKYTVPRLSPVVFQDSDENETVPGITEN

SEQ ID NO: 1020495 - protein, 187 aa, Homo sapiens
TRGCVVAHRHVKELKRRKAVVAILRAHLYPPAGNIPHGPPNLLMTGNDLGASPYRNQTSQKKNVKELVFNALTQTTFRRLFDLWQVGLLLRVYIRKRFLFWMICNAANPLSEFCGGQKPIFGIDKQLALYRKMLLIRKVEEMLGNASLAAELPGPVHLYVGQEAIAVGVCHHLAETDWIAARIPGTG

SEQ ID NO: 1020496 - protein, 48 aa, Homo sapiens
MAPCQYPFPLSEKTFHACLAHDYLAQTTQFLGRQWRTAFITILMLVLV

SEQ ID NO: 1020497 - protein, 39 aa, Homo sapiens
MEKPVPLTSLALAPSRITRNVWMSDSGTEIKSNHCNTVS

SEQ ID NO: 1020498 - protein, 213 aa, Homo sapiens
LPVAEPAVYFKEQFLDGDGWTSRWIESKHKSDFGKFVLSSGKFYGDEEKDKGLQTSQDATAYYSRLYGSGSYRSLVSRSIGGQYRCVVLVRSVKHEQNIDCGGGYVKLFPNSLDQTDMHGDSEYNIMFGPDICGPGTQEGSCHLQLQGQERADQQGHPYARMMSLHTCSTLIVRQTNTYEVKIDTAGGIRLLGRRKGFWQQRNKGSDASKRKM

SEQ ID NO: 1020499 - protein, 204 aa, Homo sapiens
LPVAEPAVYFKEQFLDGDGWTSRWIESKHKSDFGKFVLSSGKFYGDEEKDKGLQTSQDARFYALSASFRAFQQQRPDAGGAVTVKHEQNIDCGGGYVKLFPNSLDQTDMHGDSEYNIMFGPDICGPGTQEGSCHLQLQGQERADQQGHPYARMMSLHTCSTLIVRQTNTYEVKIDTAGGVRLLGRRKGFWQQRNKGSDASKRKM

SEQ ID NO: 1020500 - protein, 115 aa, Homo sapiens
PCPTSGVTLFIAYMDVAQLHGGATEIELAAVEIRTLQTRLELRVTAHCNTGDAQPGTGAPQIGTALADPPGGIQGDIPTEQADPAEQAHVVIAEVTVVGGQVRYPCIGEAELGPH

SEQ ID NO: 1020501 - protein, 115 aa, Homo sapiens
MVSGGERGSEPIVPSRTRKYEANHFGAEDRKLRWTICPPAGQTKIIFWLIGAATASSACRSSPHLPSRLAVPAAFPCVCMAHARREDSAGITRRTSKKGDPMTTRPTRLSRSRRT

SEQ ID NO: 1020502 - protein, 139 aa, Homo sapiens
RGGTRKNSKFLKFLVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVDYWLC

SEQ ID NO: 1020503 - protein, 104 aa, Homo sapiens
GSFSSRPAALMPPVSPRRAAAAAGRLNAEGAEGARGGGSSYSEMAETVADTRRLITKPQNLNDAYGPPSNFLEIDVSNPQTVGVGRGRSPLTKSGSRQIFLFSS

SEQ ID NO: 1020504 - protein, 60 aa, Homo sapiens
QARARGWQCATIFADDAEQIRDSSHILETVMHERYLDAYSAAYSAAAQYKFFIVACDPPQ

SEQ ID NO: 1020505 - protein, 120 aa, Homo sapiens
LCVTSCLSLCVHQVFTGFEIQSSTATFFSNATCLLSGINNYTQHLSALNNTFLHDSFHNAAAVCDYAQNCLQKSSAQLTKHSSKHVNMTDCRLTSGKYPQCRYSAAAQYKFFIVACDPPQ

SEQ ID NO: 1020506 - protein, 43 aa, Homo sapiens
MPGCPIRKSSDQWSFAPTRSLSQLITSFIASENQDIRGAPLLE

SEQ ID NO: 1020507 - protein, 41 aa, Homo sapiens
YTRSACCRSAALSAVCHRCDQICWSTSCQLSSNTDNGSQHQ

SEQ ID NO: 1020508 - protein, 155 aa, Homo sapiens
TRARQIGCDFLITGPAHSKILGEKMLGSTAARIVRRASQPVLAVRRRPEGPYKTIVAGVDFSEASRTALMRGRAFFPSAQLTAIHTYSVSPNWAGPNADKSIDVVETEERARVVREAEQDMADLVAGLNDAPGRIQTVLMEGAPETTLADFVDKK

SEQ ID NO: 1020509 - protein, 52 aa, Homo sapiens
MIDPTFSESSYGFRPGRRAHDAVLQGAGVTVQEGFGRGREMSTLEKFFDPGQ

SEQ ID NO: 1020510 - protein, 99 aa, Homo sapiens
VFSVPLAEYCLITKAQMDRRYVPDPNKAQDLEKKREKALLKEFEQYQQHSGRKLKEFRLEVLRAGFKDAWSRKDYQTIIKVAQKIPDEALQEDEKLLLW

SEQ ID NO: 1020511 - protein, 99 aa, Homo sapiens
TRTADAERDQQHRGDEQPARQRRQTHHLSQFAPLAGDGEHEKADAAAGQRSEVAVQHPQQHADQPARGTARFDQQMQRPGAGDTRIYIERDETGRRGGP

SEQ ID NO: 1020512 - protein, 138 aa, Homo sapiens
RGATEVADRLAVDAVDEAAGVATNSRLEVIQPKDAGRQQRNRVRNQRSLTRRDQRGELAAANGGLGQRRRNLYIVVEDQISANSTRCTIGSNLFVASPSATILLLESKQHYSRVVQILRVERLDAEVVVVNEVIAGEL

SEQ ID NO: 1020513 - protein, 41 aa, Homo sapiens
NNLKMQVLYEFEVGIHGKLTVVQVEKLEVLDHSKRWCLERD

SEQ ID NO: 1020514 - protein, 115 aa, Homo sapiens
MPPAYLREGAPPESVLSAGSAMLVEVGGNSSHWGRSKGKNPKCLTSKGGPVPLESGVHCKALADDLGFVVPPPPAEHSVLFSKLTSIPTAMADIGLEVWKTKTEFGNLGPLLSLW

SEQ ID NO: 1020515 - protein, 150 aa, Homo sapiens
HEGENGAADGVHPLLVERFSPVSFDRDATLSDAEVDVLLDAARLTPSAGNSQPWMFIVGRRDDPVHSRIVNHLAPSSARWAPDAALLIVNLAHVLVEDTDWEFSEFARYDLGQAVAHMTIQGLVMGLGAHQFRAFDRDGVPREFGVPGAW

SEQ ID NO: 1020516 - protein, 116 aa, Homo sapiens
VQPWRNVQVEGGGGDYGADRVGYVQLGYGTYAVFVGGIRIVGDAVNALEVYHRSCAAHYKCVLSTCQIRGMARTHWCVGNVKGRQHHRRRSVEPDMNETPEVFRPGAYNVSPLATR

SEQ ID NO: 1020517 - protein, 99 aa, Homo sapiens
PILTGAIATTETKVLEIPVETLKQQYEGAPQMLKVIIKSLADRLRLAMNDVRSSKLEKDSSPCPEDQVAKVFGAVFHTANHKGDLSQPGRVEHPFNRPS

SEQ ID NO: 1020518 - protein, 203 aa, Homo sapiens
EKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCV

SEQ ID NO: 1020519 - protein, 45 aa, Homo sapiens
GRTRSGRTRLDLLSFSLTCVAGHVVAGHVQQKAYALFYRLDLYVS

SEQ ID NO: 1020520 - protein, 42 aa, Homo sapiens
MKTYSVHVSGHYVSGHVAGHVVAGHVQQKAYALFYRLDLYVS

SEQ ID NO: 1020521 - protein, 116 aa, Homo sapiens
MGKGDPNKPRGKMSSYAFFVQTCREEHKKKHPDSSVNFAEFSKKCSERWKTMSAKEKSKFEDTGRNSDKARYDRGMKNYVPPKGDEKGKKKDPIAPKRPPSAFFLFCSERSPKDQK

SEQ ID NO: 1020522 - protein, 51 aa, Homo sapiens
MRGDYLDGRPEMLRSPRYETRLDNLAAGGKVLRYQHGTVRVSHSELGQMSE

SEQ ID NO: 1020523 - protein, 94 aa, Homo sapiens
SRGTEHECSGTTLNMLRQIGDVSRRKLIQYQRFACGLSTLAIFSPLQRTIPDKRIWETQNTRTGMASTHLAYSFNHQNLIFPRCHYQTRYIRVL

SEQ ID NO: 1020524 - protein, 260 aa, Homo sapiens
SSFDLRKEASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALSPSPIRQHPADKLPSREADLGEACQSRETVLFSHEHMGSEQYDADAEETGLDGSWGIPGKPFTTYIWGYPHSGPTLTHEQEVVMC

SEQ ID NO: 1020525 - protein, 290 aa, Homo sapiens
SSFDLRKEASQSEVSGENEGNLPSPEEDGFTISLSHVAVPGSPDQRDTVTTPLREVSADGPIQVTSTVKNGHAVPGEDPRGQLGTHAEYASGLMSPLTMSLLENPDNEGSPPSEQLVQDGATHSLVAESTGGPVVSHTVPSGDQEAALPVSSATRHLWLSSSPPDNKPGGDLPALGQERKHPTRLGWQELVCPQTPSSCPATVENVTMAQNPGRSQGAYKAKFSLGYPSVFQDGGTLRSAQPWSKAPQGVIRAHQDSVMNGGPRFREESLIDTVVLMNGRLGQVVNRAEH

SEQ ID NO: 1020526 - protein, 108 aa, Homo sapiens
GTAVFSHQQSKFYVLLNFLMTHCFFYLHSSIKTCMHSLKQSFVKYIIPSHSTFYEVTTVTTIFPIPSTVPSTRYTFNIFFFKKNIFPPGAVARACNASTWGGLGGSIT

SEQ ID NO: 1020527 - protein, 145 aa, Homo sapiens
TRVDADGKALDREAMVEGTDAPVLQDAPRDAVLQELDEVCDIRLRLQPDEVVSGEGTCQLAILWNGEKRLRRRHGDVQIESNRIVHARPSQLCRKRNEVVVVNPNDVVGLDEGAERAGETLVHTDVSSVETGIELREIQPVMKYR

SEQ ID NO: 1020528 - protein, 56 aa, Homo sapiens
MTRDEAAYGELRAMVLDLRAFYAELYHIISSNLEKNCQPQSVTEKPSTVLEPVYIG

SEQ ID NO: 1020529 - protein, 73 aa, Homo sapiens
TKCERTDLPSRCCTARTSPLGSNALTEASPDSASAVAPPFFPHFHCTTPRRIASPLLDQSVRMLTCERTDHMT

SEQ ID NO: 1020530 - protein, 110 aa, Homo sapiens
MNIPSKQQHRFPMRKSKHRENKNTKVQSLLTFERHSTDSGPEDEAQETPNSVTMAIGHETLLGEGTIHIVRSNCCQEDRSAFTETERSLKAQSFVSRTESQAHTLLGCTS

SEQ ID NO: 1020531 - protein, 123 aa, Homo sapiens
LPAGGAGTRTAACALHVQVVTLSDVQDGFALTDFVRLLGAILQNKSYLQFFPGFGFFKWPWFKNEDVEKGRNLVVVVVRVSRDGEVRKRCAAMFDILAVCPARVTIFSIGGGLSIDTRSAYFV

SEQ ID NO: 1020532 - protein, 284 aa, Homo sapiens
MDPRQQLARARLCVPRAMERASLIQKAKLAEQAERYEDMAAFMTGAVEKGEELSCEERNLLSGKPIKKLWWAGTEALLWRCAVQYLMQKSTEEVLCEVNEGALRCCEYRETRVGGLELQGVCDTVLDLLDNHLIKEAGDAESRVFYLKMKGDYYRYLAEVATGDDKKRIIDSARSAYQEAMDNQPRRRCLPTNPISALVPGPMNFSVSYHYEIRQQPRGGHLSGQDQLLTRAGMICTTSDEDFRTKDEHRVIMQACCEITDTVELTRQTTGEEGRRGSPGVHQS

SEQ ID NO: 1020533 - protein, 141 aa, Homo sapiens
TRVDHEVRHVVADPASLVGIPPDVALAFAPRFAVRVGRRAVVEHPPVGGPRPAPLRLAGRCTAVGHPARGLVDGVGVHPGVDPAAGGGRAVGAQLGVGRQRVRGLADPVSVDLGQHRLPVRVAVLVGGVIPGQIQQSAVPP

SEQ ID NO: 1020534 - protein, 149 aa, Homo sapiens
LEAKIERGADQVTATGQLFLTDPRARQVLLHIIAEKGAIAGGDAAPGQFVGLRQNSQRLGLGRAQRVGLAGDVLDHRVEHQVAPGQGALGVGVGVERAGRLHHAGQQSRLLPVQVDCVDPEVGPGSVLDAERVVSERDQVQVAGEDLRF

SEQ ID NO: 1020535 - protein, 165 aa, Homo sapiens
RGIHQGGHERRRGAGRIEAEPLQDEGQHRAGQRAEGDDADQCSADGDRQQDPVLAVIMQAAQLPDHDAHDGQAAEDRAEHHAGRDLAQGHLPPIAQAQFAQCQAADQQRRGLRAGVATRAHDQRNEQGQHHRPRQFVLVVLHRAGGQHLAQEQHAQPTGALAQHL

SEQ ID NO: 1020536 - protein, 133 aa, Homo sapiens
TRPWLSPQAAKQAGAGLPDVRVTIQETMPTDIRSWWEHQKKMPLAGLFVGNHQRKTAAIEEVGIMSGLRFVPQPWRGRALVVLSHLNKDDPRLWPRFITGDLTIRHLECTHMSIVREPHIGAVAAMIDEVLGH

SEQ ID NO: 1020537 - protein, 65 aa, Homo sapiens
NHSYDQSDGYDRDIFQDTQIAFQIIFIFLGLRLYIALQGGQVLRLYLSIPLSNLTTLALISDEGE

SEQ ID NO: 1020538 - protein, 148 aa, Homo sapiens
RGQELALRRGDVGRHRDHAAAMARAQVCGGLVQRLGAARHDHHVDCLGGQRIGTGKAQALARAAHQRMLASQSDFHAPFSLIARFSNRSGALCGPFRSARSCRATADEMPPITSALPASCTSVIGSPSSQKPRNSVDTGPIMPACDAI

SEQ ID NO: 1020539 - protein, 104 aa, Homo sapiens
LLTLCSRFVPIKPTLIRMRGWEQFTAAVVSWLHQNSNGLVILLWGSYAQKKDSAIDRQRHYGLQTAHPSPVVSVSRVPLDVDNFSKTNELLQKSGKKPIDWKEP

SEQ ID NO: 1020540 - protein, 37 aa, Homo sapiens
MTGVLVRDKIENGKGHVKLQAEPRKAWNHQELEEGAC

SEQ ID NO: 1020541 - protein, 112 aa, Homo sapiens
TRGFQVQYSGDAGEVDALADQFADPLEALEIVVAVATGAAVGARRRQQSPSFVQPQRLRRGGGQLGGHRNAVDAARGSSGRIAGQLVSPCRNDPVFLARKEYLRRWHKIYVN

SEQ ID NO: 1020542 - protein, 133 aa, Homo sapiens
HEASASITVRGTIFDVFVEDGGTSWLLLHEGAVRVCNATGTCRDHSEPGKLIRISSGGELSKPTRWATLPGIEKISFDTAFPFVGTPPSVDPKPVLTREAVLQPTSDTAKETPKRRAEAPKEEAPAAGFRRGY

SEQ ID NO: 1020543 - protein, 80 aa, Homo sapiens
MLEVGLVAGVWVMGADSSWLTSVLEIVSEFLPDLAVLVLWHPHHPRVAPVLPVCCAYPHFIFHHNWKLPEALELYLNRGT

SEQ ID NO: 1020544 - protein, 62 aa, Homo sapiens
MLEVGLVAGVWVMGADSSWLTSVLEIVSEFLPDLAVLVLWHMLTARLPILFLQRQVVLLTEE

SEQ ID NO: 1020545 - protein, 35 aa, Homo sapiens
VAHSTSTNKQCNGSSRQEGRKERKKKKKDREHSRA

SEQ ID NO: 1020546 - protein, 132 aa, Homo sapiens
TRARRATARSAAPRSHRRPARKRCRRHSVPSPNVHPMVGLTLRSHPDWSSCKPSVRAGTRGDSSAGRRRVRTRRGLGLWHRTRRLRARLHRSCSADANEGERVAMTGPLQPGKDPVGRPGVRGPSALPTPPK

SEQ ID NO: 1020547 - protein, 144 aa, Homo sapiens
PRAIVGAAEIGRGHVNCEDWGNDALAYLQGSQVGSPPLGASRLGFRGSEGRPSGSTQAGDHGGGLWFCSPFKEALHESVGLLSLQHPHIHSFVHSYMHVYMQTHMPLLSSLIVYLCVFSSFSLPFSHNHHGDDHCGYRFLPIKW

SEQ ID NO: 1020548 - protein, 31 aa, Homo sapiens
MGDFEEINWTEEKEYEFDGFEEVALPDGSKM

SEQ ID NO: 1020549 - protein, 42 aa, Homo sapiens
SVPRHVSWTPQLKRKLRQAGTLRKNCLSAFVFRAVRVRYVSG

SEQ ID NO: 1020550 - protein, 128 aa, Homo sapiens
RGGTLLFDGEARVLHLALPEQADQQQIKDRVHAWLQHQAKRLLAERLDIYAEKLGVRHRAFALSSANTRWGSCTSDRKIRLSWRLMHFPLSVIDYVAAHHLGHLNEMNHSPRFWDTVASIFPEFRDAR

SEQ ID NO: 1020551 - protein, 84 aa, Homo sapiens
LPSENRYREVSSISICGDFQAQRMKLRYKEDGKTLYANTINGSGLAIDRIIAIILEQYQTESGYIEIPEVLIPYFGKIKQITNK

SEQ ID NO: 1020552 - protein, 156 aa, Homo sapiens
SVDCAVCRRWWCSVLTLVFAGEVLNTQQILGILLIPFGMVCLLWQGGGGDRLPWSMLPVVVLIGLCIGCYDLSVRAGAAALVASAGSPGVADADQRPGRFRCWRWCASVRTSSLFWRTPVAVGLKGGAVRVVELRFGTLGHAVGLIAETAALREVS

SEQ ID NO: 1020553 - protein, 50 aa, Homo sapiens
MEIMVTRSRAQRPKVSEHARRALSCFFAQVLSCYARGWLQHLLGRVERVE

SEQ ID NO: 1020554 - protein, 103 aa, Homo sapiens
DASTRHARHHLIIRLTKRCPRRRSWTPLHPAHLTIGPTYQGEDLPTPSPRVEQRPERPAGVAQGEVGRGSEVQVPAAGRCGDGPGIGNAAPGGGERGYDLGPV

SEQ ID NO: 1020555 - protein, 96 aa, Homo sapiens
TQAVKSGKFKLMTGESPVQNRMHYDQSQNSLLQCDRPCNVTHIAAVEPVARTCWRDPPKMLAYLLPTTPQYLLYHTGDSYFTITWTLYWASGCPVK

SEQ ID NO: 1020556 - protein, 65 aa, Homo sapiens
MAMTMASAPRTPAAHSSARWPGENVRRAGGAGRWLPLAGRGRGVPGAGRAGSMAARACVLDGIAA

SEQ ID NO: 1020557 - protein, 161 aa, Homo sapiens
HEASCRDVHDSELPCRREQDSAPAGSVSQRPRCAAFSGHARIGTERMSSSHFNASGSSGLDLHQNLCLNSTIDCANRRLNAPPVQLHQVGTSLRPMSFTLHFAVRPLLIYIKGIADRLRGKAIGLLPPAFGIEGYSMSCAHHGPKRFELLLLFLGEDSFEL

SEQ ID NO: 1020558 - protein, 283 aa, Homo sapiens
GLCAEVGGSGGGSEVSREESVAVAEPSSCVCLRLGRLSRGRFAEPVSAPGRDTPPPCPLPASPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYFFSEMMIMTDTDVLEAEVMKGGDQEVGLLITTIEDRIVLETVDRLEDHGVAEAIPTMIDQTAAGNTRVQFCLLQLQANDLTSGKKNHKKGASFNANKGGVWKCCSMNMFESFGSGLDKISNVF

SEQ ID NO: 1020559 - protein, 188 aa, Homo sapiens
GLCAEVGGSGGGSEVSREESVAVAEPSSCVCLRLGRLSRGRFAEPVSAPGRDTPPPCPLPASPNTSLFVRNVADDTRSEDLRREFGRYGPIVDVYVPLDFYTRRPRGFAYVQFEDVRDAEDALHNLDRKWICGRQIEIQFAQGDRKTPNQMKAKEGRNVYFFSEMMIMTDTDVLEAEVMKEEIKKSVF

SEQ ID NO: 1020560 - protein, 65 aa, Homo sapiens
DPALEQGPRNVLHVPAGQAEHRGLQQNMAVSIGNKQASAFSNLKNALELAPSSLVLPAVRLDMQS

SEQ ID NO: 1020561 - protein, 112 aa, Homo sapiens
HEALRDDVAQTVLTDQSADIDALLAQAQKDAQEKLERLRRRMPRGRSDRQSRGIHHRSLSLSEGRPTIPTSRQAQRPVIDHDHHAPAAARPAGHASAGGTRSPQGASFPAHL

SEQ ID NO: 1020562 - protein, 94 aa, Homo sapiens
WAYSDRRRAWSIEDYCRAQGIAMMGVGLTVLPMMYCEEELAQRPAGAIATAVVIARRLAAGGLTRTGAKCCRPIRAWIVLSGMKASKGCGDRLL

SEQ ID NO: 1020563 - protein, 172 aa, Homo sapiens
TREHRIKPCFWVGHHGHPRKIRCPEPVPPWLAALVAVCGLVLEGRPSLPQPLPGDEAHTVWRDVAPLHPHPRVPSAIRRLVRGAVSVPRRTVATPTTIPGYPRGPEDGVSRIITDHGIPVIRRQEPVNQMPTIRNGQDMQEIQEGKLAHLFLIPGIERHLAAVHRIPIGGVR

SEQ ID NO: 1020564 - protein, 51 aa, Homo sapiens
CGNPEDYRQKLYTPSGMRRVLAAHSRAGTAFLPKAERPCCDMAHTPAQAAR

SEQ ID NO: 1020565 - protein, 109 aa, Homo sapiens
TRNREGAATLELTIGRHDGGLVSNHLYDHARRGMVVGLAGVGGDFVLPDPRPRRVLFVSGGSGITPVMAMVRTLVSQRHRGEIAFIHYAPTPAEACYRDYLVALPSVRV

SEQ ID NO: 1020566 - protein, 75 aa, Homo sapiens
LIAGTLVLEAAVTGVPVKGQDTVQGRVPFNGQDPVEGPVSVKGPDKVQAQEPVKGPVSSEPGSCPIILIRCAMLN

SEQ ID NO: 1020567 - protein, 123 aa, Homo sapiens
MEAQNTTEVYVKWKFKGRDIYTFDGALNKSTVPTDFNSAKIEVSQLLKGDASLTMDKSDAVSHTGNYTCEVTELTQRQVTPIIELKYRVVHGFLQMTIFLSYFPNFCYTPVLRDSFGITTLTL

SEQ ID NO: 1020568 - protein, 72 aa, Homo sapiens
HEAAHNRQQQLCGKLDELVSSGTWEVTLGITMSSTLDWMSSIEYTVFPNREGHSPKPLSLQASLMRKRHSEK

SEQ ID NO: 1020569 - protein, 102 aa, Homo sapiens
LETMGGGDGSFTWQERIRNGYHQTKEPLWSPSRAKPSLSSLQWEQLSCHSSSPPVFACSKFVSTPSLVKSTSQLLSRPLSAVVLRPEILTDESLSSLALMSP

SEQ ID NO: 1020570 - protein, 142 aa, Homo sapiens
HEADDTHAQDAVIYALGLIGNQYRFGGRNPDSGVDCSGMVSWIFEQVAGIRLPHNAAQIARLARPVDRASLQPGDLVFFNTSGKPHSHMGIYAGEGRFIHASSTRGKYVRTDALDSGWFAARIIGLRTLRRDVLKEILMGLA

SEQ ID NO: 1020571 - protein, 66 aa, Homo sapiens
MNNRRAVFLDHPSLDLGDLDLSGLHGCFSQLQLFEQTTPENVLERLQGAQVAISNKIPLTAQNLAA

SEQ ID NO: 1020572 - protein, 240 aa, Homo sapiens
QQCANPEEGVRQVVGGKADAFIHDAPYNLISDESATEQYMLALEQPFTFEPLAFGLKKGDYDSLNWINHFLNQIAQDGTYGRLMTSGTGYGLDSRDRLIVITAYTSIPDREAALKRLRLCLAGSLSGFSDTRLITFTGETFVADNEWVQDRTPKWRSPLVRQPYKNRSGVLMMKKYLSMLMLGVTALVAATAAQDGAIDEAVKRGTVESMAWTPPYMPIEMTDTRVEIIGFEVDILKAMA

SEQ ID NO: 1020573 - protein, 131 aa, Homo sapiens
MMQGGVGIPTIRWCGAEGDYNVMVMELLGPSLEDLFNFCFQEIQPQKPSCWLLNQMISRIEYIHSKNFIHRDVKPDNFLMGLGKEGHWWFIIDYGLAKKSRMAAPPRLIPFVGNRTPGRRRDAPTKKELVL

SEQ ID NO: 1020574 - protein, 56 aa, Homo sapiens
MTLSLVDRQLQVLQPQDCLGSPEKCKSCTEFDSRNPRELTVVQVEKLEGSGPQEAV

SEQ ID NO: 1020575 - protein, 163 aa, Homo sapiens
HEVDKPYVMVGANVFAADEEAEARRLLSSIQQAFLNLRRGTPAPLPPPVEDFEAQLTPVERAGLDQALSNSAVGTPRQVREQLAKIVERTRADELMLTAQVYDHSARLRSFEIAAEAMKAMQHKHRAAREFRLNSLRTHKKAEDGPLAPYAPRRPSRPWDAGR

SEQ ID NO: 1020576 - protein, 64 aa, Homo sapiens
MEVGLGNSPMGRFNGAELNGQCTAVCQVGNISEACKRRAHLDGLNIYVYDLNVQAQDWYEFTDT

SEQ ID NO: 1020577 - protein, 116 aa, Homo sapiens
QYWMCCCVPPKRQPDNKSVPHWPTDVPTWILPISLTPKLVCSSAPCGARQDAGGWVLPTGNTEDLQVCVITVTLVALLILAHSLLLVNCKKMASSSWNRRTIFLQAGAGTLLLSAN

SEQ ID NO: 1020578 - protein, 145 aa, Homo sapiens
RITVAPNVRRRGMLCHADQVAVQAASDAGGLGSHHDHRADSRFDRPAFDSSVRPLTPSQASQLPQLTASLGQYAIPVGTIAQPAFLPLVSNCPNGTRRSMALDRIIEVLLKPNFATRLIRLSNSGIEPTAACMITQGSPVTRWHS

SEQ ID NO: 1020579 - protein, 37 aa, Homo sapiens
MDVFKLRESLVSDYSSFARSFTSILADDIRGGSSQHC

SEQ ID NO: 1020580 - protein, 40 aa, Homo sapiens
PVCGHVIGVPVDVAENVGMILSVLTGLLFGSDGYYVYVSG

SEQ ID NO: 1020581 - protein, 70 aa, Homo sapiens
VAELHHELLLLRLLLSPSVIIHGFLESGLRLSSEMHGIHVCVAPGAAVNEGESSGVEKMNAELKVPMQKH

SEQ ID NO: 1020582 - protein, 70 aa, Homo sapiens; identical to SEQ ID NO: 1020581

SEQ ID NO: 1020583 - protein, 162 aa, Homo sapiens
IAVGNLEGALWRLSMLMAIANPIDLVREYVEGNTTGWRVATRLGGAAICHVLLILALAVAVDAVIRHRHRILSSVAAVSHLACLAASGSRAGTISLALFVIGLVFFGRSYRTRSRKQRIVIAVLGIVASGVAIWLVTTVRSGSLVDPALCANLGIVDAPANL

SEQ ID NO: 1020584 - protein, 63 aa, Homo sapiens
MTTPSPTEHSQPSHKQQDQPSTNHHFQPSNNYSSTSINKSSYIFTILNDNPYYPMRAISAIGL

SEQ ID NO: 1020585 - protein, 73 aa, Homo sapiens
SDDVSTGLLLDRPHALRLTGMLSTHLTSMFEYLAPPRRKGSQITQQATNQRSQSRHHQPDGDRARLLRAGACQ

SEQ ID NO: 1020586 - protein, 68 aa, Homo sapiens
MKRFLSTAANDQTQQAHSTRQYDQNRSSNDSIPIDCSARAITPCHVLTPSTATQRKKGISHSVSHVCA

SEQ ID NO: 1020587 - protein, 197 aa, Homo sapiens
MSHVRRNRRGRTRKPTSGISRTGFDHRVRHVSRAGRRHRHRVRCGRSTPQWPRWGRRCWPWPGSLPSLMYSKLTSMIACQASFKSMKACSSTMRYHPQFGGGEFTPFDTWRDGRRPPKEVVHQLEHQLGVEDEQRGTGVNGLDLDQVEGWWARTASARTHRTSSPARRPRPRPPSGAAVEHADASVAAKGTLIISRY

SEQ ID NO: 1020588 - protein, 53 aa, Homo sapiens
ETPSYNFIFLLSLLTLTVFSPDLLVLTQMNDTLANPLNTPPRYMQDMQARYMQ

SEQ ID NO: 1020589 - protein, 268 aa, Homo sapiens
MRSRPKPVPQPSCAPGAPRLCPSCKDGTGRANSGDVFGQPVKNDQCYEDIRVSRVTWDSTFCAVNPKFLAVIVEASGGGAFLVLPLSKTGRIDKAYPTVCGHTGPVLDIDWCPHNDEVIASGSEDCTVMVWQIPENGLTSPLTEPVVVLDGAHQASGHHRLAPHGPKRAAQCRLRQRGTHLEWWAQLEELYRLDMPVTLTLYLQCRAWNHNVQLVLSQHAMDLSVRIIEPVRGDLVAEREKAHEGPGHAGIFLEMASVHHRLSAMIER

SEQ ID NO: 1020590 - protein, 38 aa, Homo sapiens
CAPSGSTLLWLWCRKAAVALIQTLAWEPPYAVSAALKS

SEQ ID NO: 1020591 - protein, 135 aa, Homo sapiens
VTSKAAGSAGGGGEACRFPCRGVVEGFHGTGQAGFGEFAQVAVDQAPIGLVEQRSRQGHGTHGLAEAAAGVEQHVVEVQALGGQVSADALHAFGLVDEQEGSPSGRMRWAFSSTGISRRHGGHQVAQRLITNGPP

SEQ ID NO: 1020592 - protein, 158 aa, Homo sapiens
HEDDAEGDRSRRGHRPHGLSTSGQPSRHRSGLTPGGPPLSGVGVSAVQHAERNVCRRASALEHSEHVVAAAGKRPDPLQVEDQQPAQQRLARCVFEQLGGGRVVQLAFNRQHRDIESKPPGGHFEGRRPAGGLRAAVPRGDCIILDCTSVMSGSICWC

SEQ ID NO: 1020593 - protein, 113 aa, Homo sapiens
TLLVMEARLGIEDFIVRKASAMMGVGFTVLPMMYCEEELASGRLVQLPPQWSLPGGWLAGWSTRTGAACCRPSGPGSTIWKKASKAVEIGCYEHDGRTSRTFLPEPARRTGRL

SEQ ID NO: 1020594 - protein, 83 aa, Homo sapiens
FTTPHWLDYRDCILRASFSKTSAKSLTQPGRGSSSIPAGMLFGSAAEATQIRCACDKAPQRLSWLNVLGVSTRVSSTSRPHVG

SEQ ID NO: 1020595 - protein, 125 aa, Homo sapiens
GPLIRLGNQRGEEQPYVRQSLWESPTENWPLRPNTLRDSPKKQTERMSFKVLLCLKFGIPGNHKREDIDWDGLNSVMKQCKLQLAYSYVVCTTLKCWQRYGETGTLHYWSEGRLVQSPCLSKRIS

SEQ ID NO: 1020596 - protein, 143 aa, Homo sapiens
RLNIHFVFMDGSLPPFAFQEYPSSSTSKGALGEGRPFWLRPQWPPWKHRLALGLFHLLPLSPDLPPPSFLWLLLASSTSQGALGEGRPFWLRPQWPPWKHRLALGLFHLLPLSPDLPPPSFLWLLLASYQLITNSFLFLCMPA

SEQ ID NO: 1020597 - protein, 67 aa, Homo sapiens
MWVAGTYSQTRQAFVNQLLLPKGFLKCARRFAPLVGGNSPERSDCALSIFSACCSIAWASRSQSSRF

SEQ ID NO: 1020598 - protein, 170 aa, Homo sapiens
RGVVALSVEHACRTAVIRKLTLDDIDLPNRRITLAGHNQRLGELTHIALNTWLDHRRDRWPHTPNRHVLLTTKTALRTTPVSQKSVKPSLSDNGFTIERIRADRILHEALTAGPDPLHLSLVFGISHNTARRYTTVAERLLSDELEQPVEPVVPPNAARLRAREPAAVMN

SEQ ID NO: 1020599 - protein, 64 aa, Homo sapiens
MPICECSSHPTSGSIYSRNPDKNPYPCSFDLLICRPCSKSNFRWVLTFVQQSWLPTASIATRSL

SEQ ID NO: 1020600 - protein, 183 aa, Homo sapiens
DSWPRQWHWLLLMAVGQESRTLDLGGPQRSDGLSLPSLDLGVSWSPQAGHVQVLLLGWTGLCHCGELGCCCFSHRTRACDLVLSSEDTDQASPSQAPPVRPPVSWAGLAPVGAGHCAASVHWAGAAEEIYVLSVSHLGSKQRAEQRWIAMETLRSILAEGIQKAPGGGGTKSGLEVWSFEVSS

SEQ ID NO: 1020601 - protein, 166 aa, Homo sapiens
MARCLFGMKPVMTGNPSSPSLDLGVSWSPQAGHVQVLLLGWTGLCHCGELGCCCFSHRTRACDLVLSSEDTDQASPSQAPPVRPPVSWAGLAPVGAGHCAASVHWAGAAEEIYVLSVSHLGSKQRAEQRWIAMETLRSILAEGIQKAPGGGGTKSGLEVWSFEVSS

SEQ ID NO: 1020602 - protein, 136 aa, Homo sapiens
KHRMCRISTNPQSITPTIPPNVLNATTAPTSWPTRSLPTQRRKARGNAAPNSSVGTNTMLNAATANLELMPSNSLAPNDSTQDSTRLCANTNHRPSSAISSKATNPVPAISKPNTPLGSRIRSIRRASSRLPKKQP

SEQ ID NO: 1020603 - protein, 59 aa, Homo sapiens
MNALGIRHAYCELTDAQQNPCARVGHYVPRVDGLLVNFVAVTVDDLLFREVGHHRLGHF

SEQ ID NO: 1020604 - protein, 68 aa, Homo sapiens
LKIFLDCAVSKHQNGTKLILEKGCTCCPSEPELHPCWISQNAGTGRALNGQLVQLPHLTDGETEVRRN

SEQ ID NO: 1020605 - protein, 136 aa, Homo sapiens
CQSFITNQVVILEHDNQGVWVRRDPRVSSYNSVKLFLCMITRLAPPRPPHSSDHSSSEHSSKENEASNDAHDGDGGLERRLPSQGEGLGETLMLHMAGVSLLLSRRHHHNRPLLEGSIPCRPGLHELRVLGLVRVP

SEQ ID NO: 1020606 - protein, 182 aa, Homo sapiens
LDHNIGFDQSKTHESLAFHVDTSVDLHSFCKEREISRSSLLHIAWALVLSRWMGIDRPCFGYLSSGRDMDVGGLDNMVAPLVNLLIGCVDVSTGLTDALAEIRNYSIDNLRFQHTSLAEIENRLGLRGQHLFNTVLSVHDRGPHSLASDGLQVRNTSEDDPHEVSIAYINQTSVSNRKLSSI

SEQ ID NO: 1020607 - protein, 35 aa, Homo sapiens
TTWFIYVVSGIRHRCRRCSEPVCLCHLFHELMGED

SEQ ID NO: 1020608 - protein, 188 aa, Homo sapiens
STNVDCLVSARAGAAAVRAVATAALYVGDQRHSQGILKDFALRDVNAPRTDADIRLAQVLVDQLRQAPVHDCFLPYARHPGLLGVLEGMQAEPGDNRPLAQWAEQVHVSERTLARQFVRELGMSFGEWRQRLRYLAAIEALDSEPAVCNTVALDLGYSTASGLIAMYQRHAGCTPEQYRRRTFVAGKL

SEQ ID NO: 1020609 - protein, 42 aa, Homo sapiens
NLVIEKLILKSLLIRLRTLLLWTVSLGQYLRSAITTGSVRVL

SEQ ID NO: 1020610 - protein, 58 aa, Homo sapiens
MLTRLLRTYMGAYRRELSAVVILQFVATAAMLYLPTLNADIIDNGVAQGDTGYILQVE

SEQ ID NO: 1020611 - protein, 96 aa, Homo sapiens
MRKSLLVLLLWAPFATALIAQPTERLDQAAQQAIQHFLLHNRIFDSPEDLDNAPYIIAAQGGRVLGANDERVHARGRLDPAQPSYGIIRRGKAYTD

SEQ ID NO: 1020612 - protein, 86 aa, Homo sapiens
TGTAIQETAIQEQLYQETAIPGNSYTRKQLYQETAYTRKQLYQETAIPGNSYTRKQLLPGNSYYQETAITRKQLSPGNSYYQETAV

SEQ ID NO: 1020613 - protein, 185 aa, Homo sapiens
GIEYAAEARAKIVYERLMNVTDDAGVKDALGFGMTREIAHQISFEKALHAIQPNFPQGKLPGKPEFTQVYFNMSQGAENLRGPWNQGDGWEFVENPQPAVDGGDGTASVQLDADDEAVLSAMKIRTLSDPNSDPHHRRCPGGGPQAQARPWIENSRTLKGRAVLSTFLDEDNDSGNPRGNLLECL

SEQ ID NO: 1020614 - protein, 136 aa, Homo sapiens
RPHTLFDVVDILRHRHLRVPELVRCLPRGQSLVVEDRRHRLPERVSGHPLQVQCCADLAPPPLHRLGVQDRAGPRLEHIRRVLTPPLEHVDGELGEREHTSVAGLGLGEILAHQTLSAMRTICPVTMRLASAKVCH

SEQ ID NO: 1020615 - protein, 169 aa, Homo sapiens
MIAMDINEMAPWDSQKREQSKRSEICRRHLLMDTISRRDEEKENQGSISRSHFEQMMSGGSVKYNGENERASRFGEVDKQIGQSIGGHHIRFVISGVRSTYIKKIIITVWPLGEGQRLEINVCMALVHSSYLNKAQGREDNLGRMFDKDPGSSCERSLILPVIRVGCQK

SEQ ID NO: 1020616 - protein, 44 aa, Homo sapiens
ALALRIRRTEDGCGIALRDHLTLIAPILGSLRMRCSASNEKPRS

SEQ ID NO: 1020617 - protein, 71 aa, Homo sapiens
MTFAAQQLQGLVKVSFPLDDLPDLISPSRLVLELQGTRRTHIWAWCYRNQGYLKQASQKLDIDPASRCEKR

SEQ ID NO: 1020618 - protein, 151 aa, Homo sapiens
MTSSDKTWMRLHRDDQKYRDGVEAFLNFAEFSIKRDKMPGPCMKCENLNFEDRTIMKTHLIVLWYTDPIMIFGTFMGRRDLESNDIDDDTDEADDDTDDDDIEKNDDVPQQDDEIENTNVPQQDYVPQHDDEVLVETCKDQYMDEITEGFI

SEQ ID NO: 1020619 - protein, 38 aa, Homo sapiens
MCPKWINIMTERSVPHLQKVFDRYKSYRPYDMLESIRK

SEQ ID NO: 1020620 - protein, 56 aa, Homo sapiens
MSEALADGYHIRRDEAKSSTSKDNFSASNICNKCMQSVVSVHSKHMGQQCSSSKSG

SEQ ID NO: 1020621 - protein, 219 aa, Homo sapiens
DSTDAYAYPITAICIIPNKLGIKPSYDQKTFGEQEKRGKLRVVVSPDGAEGSVAIQQDARMYAGLFDGEETAELSLGDGRLAYVHVVRGKVDVNGRRVSAGDALMMQAEPQVRIANGDKAEVLVFDLPGNRLGTQLIGGRKTQKAPWNGGFFVSAFIFAIRGHKKARQPEVVWGGEHTCFGGWRACSENYRLACCFATEKCPYSCNADDRIPAFSDWVC

SEQ ID NO: 1020622 - protein, 84 aa, Homo sapiens
MAVVSAPGAAGAKVSGYPGLTLDSRGNSLWCRTLRPFELIEVAIDPIGSTLDVELNEIQANKSPHALAPWIAILSNNTNQGREV

SEQ ID NO: 1020623 - protein, 119 aa, Homo sapiens
QIIRDPSAYNSPRGRNTEEELENVCSNSREKIYNRSLGSTVSSMPSEDYGYPKQTAETQTAGAFEASSVAPAFETVMVKRSGMLCWIRTGIARIVEESATAVSAGSEMDRCAIGVLCVF

SEQ ID NO: 1020624 - protein, 88 aa, Homo sapiens
GHDYWLDRLHIRERYNGMNKFTSAMAQVCTSPILVMVQLMQMPNPFIYVMFCMYPKSPKTSFQLPNSHKIMMSFLKFIHLIFLSRISV

SEQ ID NO: 1020625 - protein, 156 aa, Homo sapiens
YSASSCIMRRMLILPTLCLDDFLFRRLRGVARQVGQRRLGHFQRRGGRAGDGVGFGLLQFLGDDRRLGRRIGKRCGAGHQHCRDEVGFEHSWRRLPSEFPDHVDKRAVQCRSRPGCHRHRLGLNTTGTANAPRLKARRSNWLSAAGSKPFLKYLVD

SEQ ID NO: 1020626 - protein, 53 aa, Homo sapiens
MALQSKNLMQTFQDNENYVQFKQQLKELKKQCGLQADREADGTEGVDEDIIVT

SEQ ID NO: 1020627 - protein, 36 aa, Homo sapiens
MGGGCLIVGGRIVPPLPGLPWVDTQAAHGIPDARQF

SEQ ID NO: 1020628 - protein, 69 aa, Homo sapiens
EDPLSTNVRRALLEFFGGGAQHVRLAQHQGLGGAVHRQVCRFDRHLVAFFFHTLRQQRGGRKGGDKRQR

SEQ ID NO: 1020629 - protein, 72 aa, Homo sapiens
YRIEISTVKRGQRSSGLKGHNGLQGLLVSLVTMVIKVLLCSVGPAGPSGPCVVLLGPACENDGRTWTSVGWI

SEQ ID NO: 1020630 - protein, 58 aa, Homo sapiens
MTTRGRGRVFELIAGHLDGLRIDSLIVEKPKTGPALREDRRFYPEMLGYLLKFVLPKE

SEQ ID NO: 1020631 - protein, 54 aa, Homo sapiens
RIPCKRLVSGYGWMGGVRRWIGGKGCCGDVVRRDVGVVGAPSLPLPPSTIHKPL

SEQ ID NO: 1020632 - protein, 153 aa, Homo sapiens
DYCSTEWSKRRHNRILRGAIYKCNSCRKAVTFLREEALIDKNINVIPKLFVSTADSPLSDAHIRQIAGMIIEHQVMALVADPLMKVDAKLGTLGKTLRVSESAVTRHTNPSTLPGGVTHAIIFGDCQVERQQRVAKAFEQRGVIVRKVRIAKA

SEQ ID NO: 1020633 - protein, 58 aa, Homo sapiens
RVSPVSSSATCIVLSSPRVDIRRQEGLLDGHIGSLGALAAILQLESIGHALAEPVSIN

SEQ ID NO: 1020634 - protein, 44 aa, Homo sapiens
WSDLDFRDETAHSDKKHRDSKSLEGRPMVEKKSKKPKKKEKKHK

SEQ ID NO: 1020635 - protein, 48 aa, Homo sapiens
MFCGWFNEFLIPWIPSYSTVSSDSTAEGERRTEDEVVAILESLGVALC

SEQ ID NO: 1020636 - protein, 127 aa, Homo sapiens
GCYRALNVPRDMTRGITIKPSAPTLAAWAAWDTASRLFTAPVPTMVGTPVATRRATPSWRWASVSSGQSPMEPQYTTALMPMSISSRPLATSASKFGWRSAVQGVIRAGMQPVKMLSLMVLTPVSVE

SEQ ID NO: 1020637 - protein, 76 aa, Homo sapiens
MAMLGLAQNSEGTEDCVEETPAERCPCTSNGQGPGSRHHGERCTRTEPRAASHSKGQGLGSHHDFPSTRRTRLCLD

SEQ ID NO: 1020638 - protein, 105 aa, Homo sapiens
REKRKAENQRKFELGGAVLAAFKDLGMDISESTPEQIRNRIKNVTKFHNDVLKSKVYQEVKNYKNEYFERNKLFHQVLHGLSTWSNKGEHLYLIEIKKALAKNQE

SEQ ID NO: 1020639 - protein, 107 aa, Homo sapiens
TAAASHATQHQIVVLRTVALATRQAHSLDQIVFETDQVSQVHLRQEQVVVPIRLEVRITQPAILTQHVVVGIDDSASCLDMAIHYRRQRVAVEHVVVIEERHPPSAR

SEQ ID NO: 1020640 - protein, 38 aa, Homo sapiens
FDGKVTYGQKRAAGGGSYKGHVDIWAPTVQELAALEKE

SEQ ID NO: 1020641 - protein, 71 aa, Homo sapiens
VDDTYRKNKATQGEQISRISTHEGYKQARPPAFKVEDEPRDKTELSSEKHRDVPLRAVLSQVKKGILRGGQ

SEQ ID NO: 1020642 - protein, 84 aa, Homo sapiens
SSYPHHLSLTRRLNRLFINRPHHLSRKLWLNHPLPSRQWRLNILYLPLPYTSGEAYITDHDSTQKPEDIGHYPPCLATIATGRS

SEQ ID NO: 1020643 - protein, 84 aa, Homo sapiens
SSTNVYNSYLPGKGDTVIKKAVTQAQAQPLHSDCADPCEFPKCGNLDCIIYGSGGLRSRSPLILMLKKYTNRFNLTCVSTQEFN

SEQ ID NO: 1020644 - protein, 73 aa, Homo sapiens
SSTNVYNSYLPGKGDTVIKKAVTQAQAQPLHSDCADPCEFPKCGNLDCIIYGSGGLRSRSPLMSCLMINCCLA

SEQ ID NO: 1020645 - protein, 124 aa, Homo sapiens
MPILDDSGVPHPVLGIQSQADFQKAVLEPLYQAMGITSAASLDTRITEVERRLRSMTVKDNLEMRGYRFIETVQSHAPLRDMLAMANQRALTSNGSTVFITLADPDCLTGRHSVYRHKCVPAWK

SEQ ID NO: 1020646 - protein, 35 aa, Homo sapiens
MGAHPHPSSVHKLILSSCAAVNFIFVLILEVLHKA

SEQ ID NO: 1020647 - protein, 167 aa, Homo sapiens
LPLCRPMTCFPSCSLFSVTSLLCSCRFLHKPVGISTVVPFILGHCQTAQSHQGPLHCCHVFAFKEVNSLEHVSLDDPIVPSRLQDLNHLLHLLKYHRGWVLGHLHRLGANQGTGCSPACSESRHSSARPGSPSAQCLERTTSGPQCTIIHSTSRSSSSSSYFFSILD

SEQ ID NO: 1020648 - protein, 82 aa, Homo sapiens
MSSPNRLAVTRVSRRNRTLNDLILTNSNNEQTCEQPIQYTTNVNSDALYRNLDESAHQYPIHFNERHVQNHETDDSDYRPVL

SEQ ID NO: 1020649 - protein, 363 aa, Homo sapiens
ANRSHSAGRTPGRTPGKSSSRGFRPLLARPGLVHRVYPPSQCMPSMEGGQAFLPDARRTSSERPPVSPHQARKHQNAWALNLNRFLTARRKPETTFGPQVGKRTIDAAHERFIRTQVLIRYCYYATKATPGSSRKTCRYIPSLPCTVILECCLKVHNDYYLNLVALAVLGNVLACGTGQQCVPVECKLWGHPAALQMEQPGEYISSVAWIKEGNYLAVGTSSAEVQLWDVQQQKRLRNMTSHSARVGSLSWNSYILSSGSRSGHIHHHDVGLAATLWAPEWPSRKCCGLRLGPDGDIGRVVIYLVTWCALCPEKGGGVTGEFPAQGVQAACSLGLLSQGPCSHPHMFPAIGSHHCLFYDEPVA

SEQ ID NO: 1020650 - protein, 219 aa, Homo sapiens
LETAIENDEESLRAALARLRGYSVQATILLAQRAKSVAIASQQRHGDKLVSVIAGHPDSPESPIVAIDQALGARLATKHLIEQGYRNLLHVPGDLEWQDASERLSSYIAVCKEVGIDPAWMPANSWGAEAGAAVAEELIAGHLPDAVLAGNDDIAIGMCHTFLTHGVRIPDDIGFVGFDDIPLLRWMTPSLTTVRSRTSKHPDTKLSSSTLVSPYSADI

SEQ ID NO: 1020651 - protein, 47 aa, Homo sapiens
PIDPMNPKWNQWNPNGIPNGIPNGIPNGIPKWNPKWNPLHWFLSFHK

SEQ ID NO: 1020652 - protein, 55 aa, Homo sapiens
NQIKHMEKFVENIRQLGIIVSDFQPSSQAGRNQKLNFIVTGLQDIDKCRQQLHVG

SEQ ID NO: 1020653 - protein, 235 aa, Homo sapiens
VNKRSCGGAGPVCDSGFCCGCVGDFGGCQVLAALRNGGPKLPFLFSVYKKLDVVQVARNLEKWNERYQCETERSPNDLLQCRLYSGCQLPKKMPFPVSKSTGFFKFLHHSQLHSDQSYTKSDEQKRPNLRVERAKALSQLRSSTPSSLMSQMFRTMERGLLSLLNDFHFLENFKHLEMNVPLNMMEHCSGGMQEKLARLKFASSMGELEGTSWRIREKQPVTQIWDRRLSELART

SEQ ID NO: 1020654 - protein, 247 aa, Homo sapiens
SEDPLEYDGFSTSWLSIVCKIREGCKILIFQEFKRLCCKAAKGKKEVESKDGILELIMTAHQGPVMGLEGKSPEIPMENGVQWVKPEQEKVQQETASCGREKCLIRGTAAKSITKKCEKSSSSWKETECVVVDTPGIFDTEVPNAETVQGRLCACISFGLPRGLMICFVGVPSGRLHWMKSTKQEKILKMLREGYNVHDPHINGKDDLGDTKLGCYLREVQKNSDVMGISVTGNVVKQQGKGVGEEA

SEQ ID NO: 1020655 - protein, 201 aa, Homo sapiens
MAAQYGSMSFNPSTPGASYGPGRARAQKFPMENGVQWVKPEQEKVQQETASCGREKCFIRGTAAKSITKKCEKSSSSWKETEFVVVDTPGIFDTEVPNAETSKGSLCACISFGLPRGLMICFVGVPSGRLHWMKSTKQEKILKMLREGKNVHDPHINGKDDLGDTKIGLLLKGSPEEFRLMGISVTGNVVKQQGKGVGEEA

SEQ ID NO: 1020656 - protein, 168 aa, Homo sapiens
NTVSYSQSSLIHLVGPSDCTLHGFVHGGVTMKLMDEVAGIVAARHCKTNIVTASVDAINFHDKIRKGCVITISGRMIFMSNKSMEIEVFGVTPSLLWDSSQKRYRVPASAFFTYVSLSQEGRSLPVPQLVPETRGARRKRFEEGKRWRGTLQMYGPKQTGDHAVVLKA

SEQ ID NO: 1020657 - protein, 125 aa, Homo sapiens
IKHMATRGTSGKTRELWLRLRVALSLRRDLQVPTFAFFTYVSLSQEGRSLPVPQLVPETEDEKKRFEEGKGGWYLQMTAKRGEGARWRSSCRMSSRPLCQWCLRVAMAKTVPSVNMSLTKFPPWA

SEQ ID NO: 1020658 - protein, 201 aa, Homo sapiens
NTVSYSQSSLIHLVGPSDCTLHGFVHGGVTMKLMDEVAGIVAARHCKTNIVTASVDAINFHDKIRKGCVITISGRMIFMSNKSMEIEVFGVTPSLLWDSSQKRYRVPASAFFTYVSLSQEGRSLPVPQLVPETRGARRKRFEEGKRWRGTLQMTAKRGEGARWRSSCRMSSRPLCQWCLRVAMAKTVPSVNMSLTKFPPWA

SEQ ID NO: 1020659 - protein, 115 aa, Homo sapiens
GGILLASRVWWRSLSASCTRSPSSEEKSFRRTSVLSVALVEDFLKKHNLNPARKYFPQWEAPTLVDEQPLENYLDMEYFGSIGIGTPAQDFSCPLFYTRSSNLWVPSVYCPRVEK

SEQ ID NO: 1020660 - protein, 39 aa, Homo sapiens
TRSASVRSESDVYRAVWNTVKGSMGNLVEYFDVYTYTTF

SEQ ID NO: 1020661 - protein, 245 aa, Homo sapiens
VPQKSYSVMNKGWDGYDVQWECKTDLDIAYKFGKTVVSCEGYESSEDQYVLRGSCGLEYNLDYTELGLQKLKESGKQHGFALFSDYSFISGPRQDFLVTLSGLIYHPCYSLVIGLWKVILSWYLKVKGQYSPPTRYFLEYSSIFPTVYQEDSPTQARNLTPPGLSSPEFYRYHEKYWAVVQQAGSGSAFTGQQGSDHIQDQGSGQRFGNWWNTRIFCLGSNRSGNTLLRLVVLPVLSSLLPWHVE

SEQ ID NO: 1020662 - protein, 252 aa, Homo sapiens
MMMPTEAEHQRAYLEDTLAWSGSHKYLEKGKETLLHLEPPKTHVTHHPISDHEAYPEVLGPGSSTLREITLNLGDDRMVEGHYPQATGDSWTPGLQGMCTFQKWARLWWCLLERSIDTRAKCSHEGLPDARSNLKMESRSVTQAHGITHRGHHCVDLVLLGICGLWKLWFAAVIWTEERTHRGPRRHATLTARLERQCPRGSRHLTSVGKSLETGCLVCRLGDAQAALCCQFECGISLTLPYVFRGPGALFA

SEQ ID NO: 1020663 - protein, 82 aa, Homo sapiens
MVVRQIRALLSSLLWAWRRARLQGRSAFQLVRACLREGAKGPRHFARRMAAYASGGSASPPPVSLDAYESWHSALPQLEVPA

SEQ ID NO: 1020664 - protein, 52 aa, Homo sapiens
RSLQHDVLQVLLQDGVFHSMEHEADVLVSMRCEVMKSAAAVTLSCRSTDKPL

SEQ ID NO: 1020665 - protein, 43 aa, Homo sapiens
RSLQHDVLQVLLQDGVFHSMEHFLIRLVRIVFHLLGLGYQGTE

SEQ ID NO: 1020666 - protein, 430 aa, Homo sapiens
MLRLVVAACQACACSTETVLLGCGIAERIRSCADDEEDVTAPLLERQLEPEELYQTFQRIVENVNVIISTYGEGESGPLGNIMIDPVLGTVGFGPGLHGVAFTLKQFAEMYCGPQFARARGRDQIGGRARAGQESRGHDDRSCGADRYFDPANGKFSKSATSPEGKKLTRTFCQLILDPIIQGVGGDHESQEERRQQELIDEKLDVTIRKGSKEKRTQGKREKGKDRMRERELKHAARHEHAMRDNAMAARNDTPESHTEPYTHDARPAGKVPRLTTDLPWKQKRGTHRRTTRRDWTTWESINNKLETPPKRGHIKRRKRNNTPKTKESHTHSRNKPTGDTKRPMGHGSRTARGRDNTKSARKRTKENKGRPQRKNTLGEKTGRQQQQQKTQHAQKKQTEQKGRENRTTRTEEKARRTKVSNKKERQEKR

SEQ ID NO: 1020667 - protein, 261 aa, Homo sapiens
MSRSAVKGCGAVMGKNTMMRKAIRGHLENNPALEKLLPHIRGNVGFVFTKEDLTEIRDMLLANKVPAAARAGAIAPCEVTVPDPETLVYGPEKTSFIPGYIGITTGDKVGAIEATLLNMGNICRFFGGLVIQQGFGGVGIYNPEVLDITEETLPYLAFLEDVRNDASVCLQDGYPNCVHQYHHIYQSDGYRRVLDLSVETEYTVHLVEESTALLADPSCFGGGAPWLLATQVVRRVVAAHLGWRAVRMWVVRQDMDGRALL

SEQ ID NO: 1020668 - protein, 289 aa, Homo sapiens
MSRSAVKGCGAVMGKNTMMRKAIRGHLENNPALEKLLPHIRGNVGFVFTKEDLTEIRDMLLANKVPAAARAGAIAPCEVTVPDPETLVYGPEKTSFIPGYIGITHSKYSRGHTYEHPRVMCSMIKTGEQSWEPDEDTRMHEHSSNTHPPFSIRAMDQSRQGVRTMASIYNPEVLDITEETLPYLAFLEDVRNDASVCLQTWLPKLCASVPPYLSIKRVQRVLDLSVETEYTVHLVEESTALLADPSCFGGGAPWLLATQVVRRVVAAHLGWRAVRMWVVRQDMDGRALL

SEQ ID NO: 1020669 - protein, 143 aa, Homo sapiens
MRPASIDWPAGWARAHVHAQVGVVLTHGRLSGNRVQGTVDGLEAVTADQLAVAMHQETTAARQPLLAPGTVHPGQQVSSATLADRGAPGARLLLRHSQCPGTRIASLSTVRCPGRGWGAVLIVGTDRGQAQGWHVDQQQVVPH

SEQ ID NO: 1020670 - protein, 47 aa, Homo sapiens
PEHNERKSVRFMHAHIILRLAAAVLIILFPPLLIPTSKYLINNRLVI

SEQ ID NO: 1020671 - protein, 119 aa, Homo sapiens
EKFGRGVIAGLVDIGETLQCPEDLTPDEVVELENQAALTNLKQKYLTVIPNPRWLLEPIPRKGGKDVFQVDIPEHLIPLGSGALGHEESQVWAPEKNVPEKPAKIMAPSICHGDADLDK

SEQ ID NO: 1020672 - protein, 119 aa, Homo sapiens; identical to SEQ ID NO: 1020671

SEQ ID NO: 1020673 - protein, 121 aa, Homo sapiens
MGRDGGGVRAVSASSIEITFQYQGVRCRERVQLKPSAANIKKAELHKAAIEHAILAGTFDYALTFPNSKKALAFKIPEDSQSLGVYLVEWLDKNNGSAQVKHRRTLPGNDRWSADTNVRPL

SEQ ID NO: 1020674 - protein, 128 aa, Homo sapiens
MVGQCAQSDASCIADDVNGVTDRVRTILERVKAAMKTPRATVVVTGYWDVGLDGKAGRENGPDYFKVTDMITEAFNANVKKIAHEVGAVYVDFRTPFRGADGTRDDTALLTDDGDHPSEQGHKVLAEA

SEQ ID NO: 1020675 - protein, 67 aa, Homo sapiens
SCSIGHACLGNNPIVQIADWLDAVNQTWSGSRIGLMNKPFIAISVRPRLSSINPHDHENAVFYFFLE

SEQ ID NO: 1020676 - protein, 104 aa, Homo sapiens
MSWYPHRYIWFSQSYALAVGTGQAPRIKSPRLRHQKGPQLPSLGSREETGHTRQSSSPPKTGSGGPSRGDTHSCGHTAHALIKHTRLPAPSPPPREVGPNLPPI

SEQ ID NO: 1020677 - protein, 210 aa, Homo sapiens
MRESLILFTRPLYTRYEPSDYHASDAFFVGLFPEDDAVKIAATWSASKKRFGANSLICANMMEHRPHPRRINPPRLRPRQPVDGSAGAGLLSVVVRSSNQCELISGVIRISDDGVKTTTHDRLTDRHNKGFLYWQYSGARPATLFKGLAKAPQRTVLGTTRLSCDSLLCSVLLVKLRNLLGIEQRDRFCRREPLGHPLMELCTNSSSSVS

SEQ ID NO: 1020678 - protein, 43 aa, Homo sapiens
APGGLLPCRSIRAEVKGVCTEAGMYALRERRVHVTQEDPPERG

SEQ ID NO: 1020679 - protein, 66 aa, Homo sapiens
SFWGNFPEIPIKFDLTGVVGGYFCYRRCRATGKETRYFRFNRVLARENLKEYLDQICPHEVAHYIA

SEQ ID NO: 1020680 - protein, 110 aa, Homo sapiens
MGRGTGYSKNEGITTQGRRKARETGVKVDVGRSRRGGGALLIKQEEGGGLPEVSAADPQAERGARTEQLSIKGTRIREDHNNVLEGRPGTADQSSRTKPIKRTTRTPTIT

SEQ ID NO: 1020681 - protein, 36 aa, Homo sapiens
SGEAYITDHFSTQKLKHRPRPMCRKRQIKNIEAPLA

SEQ ID NO: 1020682 - protein, 110 aa, Homo sapiens
SARTTLALAQAQIPSFTQNWEIAVMYGPHGAPDFFTKQDIDTFFANEFEIHYNSSRTGIRLIGPKPEWAREDGGEAGLHPSNIHDNAYAIGAIDFTGDMPIILGPDGPSG

SEQ ID NO: 1020683 - protein, 195 aa, Homo sapiens
GLDTEKVTGKALSALREAVKADDLARDKALMASPQLAIEHLADGVSLRIDGADLDVPIGTTNQRRVHGELVMEMGEAWRVRISPTSEVMTLGNDAEKAHQTVVSQLEDLGVASLEQAESRLAERRVMETHISSWREHLEEEQGEVTIQELEAMAERTTETVSITAAEAQKLEEEAVAAANEARYAQGRLTPVKTV

SEQ ID NO: 1020684 - protein, 129 aa, Homo sapiens
GADLAWMQQSAELDFNTLELITDPRGFATLWLSRETKNNAFNAEMIRELIIALDQVQGDPALRFLVLRGRGKHFSAGADLAWMQQSAELDYHTNLDDARELAELMYNLAKLKIPTLAVVQGAAYGGALG

SEQ ID NO: 1020685 - protein, 178 aa, Homo sapiens
LDQYETQGHPYYSSARLWDDGVIDPLQTRDVLALALSASLNAPIEPSRFGVFRMYMELHPMTDFNTLELITDPRGFATLWLSRETKNNAFNAEMIRELIIALDQVQGDPALRFLVLRGRGKHFSAGADLAWMQQSAELDYHTNLDDARELAELMYNLAKLKIPTLAVVQGAAYGGALG

SEQ ID NO: 1020686 - protein, 39 aa, Homo sapiens
MIHSALYLNIRVSETEEGSFEEASNQLINHIEQFLDTNV

SEQ ID NO: 1020687 - protein, 75 aa, Homo sapiens
TCDESCSTLSGNEIAGCIEKGYENILSTEATWLLSFNTPKKMTDYAKKRGWVLGPNNYYSLASQQQKPEDTTIPY

SEQ ID NO: 1020688 - protein, 59 aa, Homo sapiens
VKRKQENRLEEEKRAFEEARRQMVNEDEENQDTAKIFKGYRPGKLKLSLEEMERQRREY

SEQ ID NO: 1020689 - protein, 241 aa, Homo sapiens [sequence omitted]

SEQ ID NO: 1020690 - protein, 628 aa, Homo sapiens
DAAGGADGSGPRVAAAMGEGGLPPAFQLLLRACDQADTETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAARFGHVSVAHLLLDHGADVNAQNRLGASVLTVASRGGHLGVVKLLLEAGAFVDHHHPSGEQLGLGGSRDEPLDITALMAAIQHGHEAVVRLLMEWGADPNHAARTVGWSPLMLAALTGRLGVAQQLVEKGANPDHLSVLEKTAFEVALDCKHRDLVDYLDPLTTVRPKTDEEKRRPDIFHALKMGNFQLVKEIADEDPSHVNLVNGDGATPLMLAAVTGQLALVQLLVERHADVDKQDSVHGWTALMQATYHGNKEIVKYLLNQGADVTLRAKNGYTAFDLVMLLNDPDTELVRLLASVCMQVNKDKGRPSHQPPLPHSKVRQPWSIPVLPDDKGGLKSWWNRMSNRFRKLKLMQTLPRGLSSNQPLPFSDEPEPALDSTMRAAPQDKTSRSALPDAAPVTKDNGPGSTRGEKEDTLLTTMLRNGAPLTRLPSDKLKAVIPPFLPPSSFELWSSDRSRTRHNGKADPMKTALPREPAGAPRGRRGHRHYTRQAC

SEQ ID NO: 1020691 - protein, 362 aa, Homo sapiens
DAAGGADGSGPRVAAAMGEGGLPPAFQLLLRACDQATLETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAAREAAVARGARDQSGARRWPETRSPAAGAPGGEELRTPESWNDEEKRRPDIFHALKMGNFQLVKEIADEDPSHVNLVNGDGATPLMLAAVTGQLALVQLLVERHADVDKQDSVHGWTALMQATYHGSVPAPRPQRQGQTDALAMRWRFPMGSSGPEMLHTNPRDYDDQLEGIGRDYKQSVGEQVLNLYSAQLSGAQEFACSPEITGFSANGPLKYPLLKESIYLREVD

SEQ ID NO: 1020692 - protein, 370 aa, Homo sapiens
DAAGGADGSGPRVAAAMGEGGLPPAFQLLLRACDQATLETARRLLEPGAAEPAERGAEPEAGAEPAGAEVAGPGAAAAGAVGAPVPVDCSDEAGNTALQFAAAGGHEPLVRFLLRRGASVNSRNHYGWSALMQAARFGHVSVAHLLLDHGADVNAQNRLGASVLTVASRGGHLGVVKLLLEAGAFVDHHHPSGEQLGLGGSRDEPLDITALMAAIQHGHEAVVRLLMEWGADPNHAARTVGWSPLMLAALTGRLGVAQQLVEKGANPDHLSVLEKTAFEVALDCKHRDLVDYLDPLTTVRPKTGQAACPPWLHRGPQIVFMWLKLRIALLEGHAELQSPALQTTETEEVVCLSIGGIACDMQVLGPLSAE

SEQ ID NO: 1020693 - protein, 62 aa, Homo sapiens
GYSPVRQPATKLLELIGRCTDLAVDCALAGKTGVIGQDEENGDKLTNIAFDRIKGGKPFDTT

SEQ ID NO: 1020694 - protein, 81 aa, Homo sapiens
GLARRQRHVTYVVAKKGVGLQSARASWKSEVISMVVDSQDEDMTKEHNNLRNIDNTLTEVSISARFPRHHGFLEERFVICI

SEQ ID NO: 1020695 - protein, 158 aa, Homo sapiens
CDTPDGSGPDDRPTVEDMASSLDEVARVIRDEQPDILLLQEVDEGAKPSSYQDQLALLQERLADLYPCSAQAFDWKADFVPDLHIFGSVGRKLVTMSRYQIEHAERLQLPVARANLISRQFQAKPALLLTYLPLSDGGQLAVLNTRLDGTAPGHNAVL

SEQ ID NO: 1020696 - protein, 108 aa, Homo sapiens
VVGSADRLGQCTPAQGGIVLSRYVAPVQPEGVKSSQLQSYRFLGVLPLNRPAHRAYEQSPSAYHCSKRQKLHLLDYATATEKQYLSCLCDLHHSLQECTNSSRGLPKL

SEQ ID NO: 1020697 - protein, 48 aa, Homo sapiens
NWFFDDDLSLSDSVCVCVSIVIWRGHFRMDKCVDLRIIPNTCVIEEPI

SEQ ID NO: 1020698 - protein, 182 aa, Homo sapiens
MSTGDWAAWAEGAEAKESPFFRSLDWHWQQVLLPSLLSPLAPTPTHPGSGTTARHLPGWAIPGLAWPEVSLMLAWVRPHAAPGTGPAQVGGQHTTRRLAGALYSVPPHPGPIQCTPAQAGQPHSPRPVSAAASPTACPLVPVALPVWCRAFSPPGLGWRTLPSRLLIPRGVSLPIFECDFKE

SEQ ID NO: 1020699 - protein, 254 aa, Homo sapiens
PPSTQGQGTVTAIPTSNVSHCTPSVTTDLGMDPCTCPCLALVFEREEGAPLSPLALQLPLHSRLGLPVPIIQEKPSGDHLAASSSHFPDTCGAWLREWHWQQVLLPSLLSPLAPTPTHPGSGTTARHLPGWAIPGLAWPEVSLMLAWVRPHAAPGTGPAQVGGQHRQGGWLGPYTDVPPILAPSSVPPPTAGQPHSPRPVSAAASPTACPLVPVALPVWCRAFSPPGLGWRTLPSRLLIPRGVSLPIFESDFKE

SEQ ID NO: 1020700 - protein, 156 aa, Homo sapiens
MTRVMLPCTLSYILPYFSAVNLECAITVTTGSLQLATAPGEKTMSWQQIQTVGKNRQRLNERSLIGAPKAASRKGTSKQVGKGKSIQGGEPGLPGICGEHWPKETKARKVQPQGRLKPGLITQQGPEKLAGDAVYTKSFVHPNEPLRQQISCAENP

SEQ ID NO: 1020701 - protein, 76 aa, Homo sapiens
NLPVGQRAKVFSLRYTLTNVGYATGPMLGVVIAGQMPLAPFLIASAIAFGSLFLMIGIPPTQRDDSNKPLSFLSTT

SEQ ID NO: 1020702 - protein, 75 aa, Homo sapiens
VSRELSLEDPDASCASGWTGLGVAEYLSGGLVDLHAGGDDLAILDLFHNGTHLTGGHRFFLVLSQVGILSLQQRR

SEQ ID NO: 1020703 - protein, 126 aa, Homo sapiens
RLFWERFTWAGNPRPYYCGADGGLPPWPPGLPAGLLRSSRVGLVDLHAGGDDLAILDLFHNGTHLTGGHRFFLVLSQVASSPSSSGGRWQSPAPPRLHIQQDFVFLVLLLHLAEKVGQAEPPVLPI

SEQ ID NO: 1020704 - protein, 86 aa, Homo sapiens
AHTSFAHTSFAHTSFAHTSFAHTSFAHTSFAHTSCSQDRDFEEEQLADLRGEESSEFKWTNVKSRLEGLTFHRVCKPRGVLLRFNI

SEQ ID NO: 1020705 - protein, 70 aa, Homo sapiens
LLDQGVRHQAFLMAYSDAVLSGLCGVGGLCGGGVDVAAYLGSMLWLAQVSAMFRVCFYGLGGLSTYPLFG

SEQ ID NO: 1020706 - protein, 150 aa, Homo sapiens
TVKHMYLRDHLHTSTAFVCHTLLVKAGWLHCLPQPNIAFVWENASDRQLSHGSGHLHGGYAHLRGTLKLQLVPQTHCWVRRTPGGGGRPGHLEGEGDLGAFLRGLGHVAIARTLSRTNYGIIVNDFLIYLSQFMYLNVKAEKYIDHVKVM

SEQ ID NO: 1020707 - protein, 76 aa, Homo sapiens
NWFFDDESFLSLMQLLFLQVSDETSPLRNLPGPPAGAGGEAPLLWAPTTPWPPFTIETIRHSDDIVLPLELIEEPI

SEQ ID NO: 1020708 - protein, 81 aa, Homo sapiens
DLESFWILGDVFNPPVLYLSSEGANNLGQAWPPWLKPKSLQPPPRKIWPLSVPTLDVSNSPDCSSQGSVEVLALFPVLPIT

SEQ ID NO: 1020709 - protein, 81 aa, Homo sapiens; identical to SEQ ID NO: 1020708

SEQ ID NO: 1020710 - protein, 85 aa, Homo sapiens
PVPLAFFVKGFFSRGIPLGWGGHWPPGDKYQAPPSLFGSGGSFFLFRKVPLGQGRLPPGELFSLPLVAGGFPHPFPPGGLFLFPG

SEQ ID NO: 1020711 - protein, 103 aa, Homo sapiens
DFPVKVKLIPNCVHQSGPFRESVACAKSHSPSQLLILLGLCEIAHPEFLFPSSVTSPSSMAPSCCILSLPSTWVVERNYQVGLSLSPEAQSLRPSPLQLRFTS

SEQ ID NO: 1020712 - protein, 38 aa, Homo sapiens
SRNPHHPSSKACIQVDHYSHLGKGLMTGFNEGLMTGFD

SEQ ID NO: 1020713 - protein, 71 aa, Homo sapiens
HRTSKIWSITPLYWLPIAVWVHFHAADKDIPETGQLQKKALLGLTVPCSWGGLTIMAEGERHVSHGSRKRE

SEQ ID NO: 1020714 - protein, 253 aa, Homo sapiens
SSVLVSGLRGLGVEIAKNIILGGVKAVTLHDHGTAQWADLSSQFYLREEDIGKNRAEVSQPRLAELNSYVPVTAYSWTPREDFLSGFQVVVLTRIPLEDQLRDEVTFMSHTDGIQLCGGQNTRGLVWAKLFLVTFAKKEKIDPFQRFPIGEKQPPQVLVVSMVTKDNPGVVTCLDEARHGFESGDFVSFSEVQGMVELNGNQPMEIKVLGPYTFSICDTSNFSDYIRGGIVSQVKVPKKISFKSLVASVAEPD

SEQ ID NO: 1020715 - protein, 106 aa, Homo sapiens
VLSIGRLTDSFVRELSRLDVNPVWAGHRILPGRRGKRRVTDGRQLWRLQHLDAGGDLRHPRQVDGKTGHQAVLLVGQLHEPLNQVEHPHVDRQGGDAGTTLHRQDI

SEQ ID NO: 1020716 - protein, 73 aa, Homo sapiens
WTSLGLVSVVTVVATVLIVSVVSGGALMLDRAHARAKADSDGAAGLVALGWTAIGVAGLIVLYGLYLLIPYFH

SEQ ID NO: 1020717 - protein, 86 aa, Homo sapiens
GVALEDPRRQRSHINFPSNIQIAVETFILDIQIGTDESKLLFKRNKLLGILKVEAGSQIISELIKQKAHSVQIDVAALLRGPLDHP

SEQ ID NO: 1020718 - protein, 73 aa, Homo sapiens
FDKDDSARLVIDELLAASRRGVKVRVLIDQLSAISDLQILGALSGAHENFQLRVYNPTFGKARLNYFDYAGSV

SEQ ID NO: 1020719 - protein, 103 aa, Homo sapiens
MPPVKDLKARASESTVVTAVDSCCEPSAAGNTYTKEAYKKYIKDYMKSFKGKFEEQRPERVKPFMTEAAEHKSCTSLLISKTTSSLIGENLNPDCMESSIGLP

SEQ ID NO: 1020720 - protein, 747 aa, Homo sapiens
GLRRTGRTQRHARPPCLAAAAARATEPCRARSAPAGSLRVGRGQPRSRVPIAVHWPEAGAAMGRGARAALGRWSRAPLEERLPGRGSGRLAGRPGPRAAPGAVGSRPRQLQVRGFCRARRSSAPARPVPGRSRSRCLGRGRGLAARAGGASRGKGRLRPAAAGLPEARKLLGLAYPERRRLAAAVGFLTMSSVISMSAPFFLGKIIDVIYTNPTVDYSDNLTRLCLGLSAVFLCGAAANAIRVYLMQTSGQRIVNRLRTSLFSSILRQEVAFFDKTRTGELINRLSSDTALLGRSVTENLSDGLRAGAQASVGISMMFFVSPNLATFVLSVVPPVSIIAVIYGRYLRKLTKVTQDSLAQATQLAEERIGNVRTVRAFGKEMTEIEKYASKVDHVMQLARKEAFARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQLNPVWLRSKIGTVSQEPILFSCSIAENIAYGADDPSSVTAEEIQRGLKGQAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 1020721 - protein, 737 aa, Homo sapiens [sequence omitted]

SEQ ID NO: 1020722 - protein, 52 aa, Homo sapiens
SRYLSETQLKIFGTGHLKMTTNMPGLKELIHLMKYCLSEMGLLDLLFEGKRP

SEQ ID NO: 1020723 - protein, 147 aa, Homo sapiens
GELVIQQKLLVPKESYVKLLIGPKGHVISQIAQEAGHDLMDIFLCDVDIRLSDEAPQADHPLLTLPGQFQLKLLAGTDQFFPWLGTLQALVRDMNTDWPLAGLALLSLHSPCPAVSSRWNERNPALAQFPRARFFSPRHTQHTKVYV

SEQ ID NO: 1020724 - protein, 79 aa, Homo sapiens
MNPDYHVELSAQIILVMHALAHRGAQNHVNRSAPSSMMLLLLPSGTAGYLGQVPTINKGCAPSVMSCHPKPLPETPSNT

SEQ ID NO: 1020725 - protein, 57 aa, Homo sapiens
VARGISSERQVSTVSRFKCRVHVWLMHGWGMHAGSLFFCAILRINGPIWAQKPVQRG

SEQ ID NO: 1020726 - protein, 164 aa, Homo sapiens
FEHTAKRTYIRFIDASHTAHFRIFHEHYWFMEEISWLPSGLVQTKLRRGFGRLLRQVVKKRRPEGIVPAWGSAYWALTRECCEFVLEYMRELPDVVRWVRTSFAPDEQFFHTVVANSRFLHRSDGFVPYQAPSVHLLSNLHLIAPGLRKDPHRARLRRSGRVAE

SEQ ID NO: 1020727 - protein, 141 aa, Homo sapiens
DVLRMSRRKKKEGVRERETLRNSLSSAPGHKTPGRGWGCLCKWSRHTRPSCTPVHQATSTAVAPAQSSSFAEHLLSGFIAEGAKITPLCRQQNKSLQNMKGFLQPPYEMGTEYPHYREGNGYIVYLRPCEMKDWTGTRMQT

SEQ ID NO: 1020728 - protein, 187 aa, Homo sapiens
LGSVEHHVDALRRNVIPGGEHQYMRAVGHLGLIPADRLDLFANVRISHHRQFKWLEAARGRRQSYRFQNSLQLFSRHGLGTGHNFSSHNANSVTRLFCSFFIFHVGQRSLSSPIRIPSGLRSGLYCWITVNLKIKQKMKIGEISRRTGLAASAIRYYEEQGLLDAPTRDVNNLSLLPAKPPLNAWKS

SEQ ID NO: 1020729 - protein, 58 aa, Homo sapiens
TLSGSGTGESTSPSDKVVKKGKKDKKIKKTFFEELAVEDKQAGEEEKVLKEKEQQQQQ

SEQ ID NO: 1020730 - protein, 96 aa, Homo sapiens
MRIGQARIHMPCHHNKYIVTERATYIGNFNWSWNYFTETAGTSLLVTQNGRGGWEHWSHFPEGLDSPYSMTLTPHVQRGNRSACSEPDQWQQALAR

SEQ ID NO: 1020731 - protein, 71 aa, Homo sapiens
MTDPMLLWLWRRPVATAPTGPLAWEPPYAAGVALEKAKRQTYTHTQNLTKTVFQCKIPSPTSSKTHLGVRA

SEQ ID NO: 1020732 - protein, 96 aa, Homo sapiens
DPLCHHASLLAVIRGNWYFGNFLCKAVHVIYTVNLYSSVLILAFIMSVTCYLAIWHATNSQRPRRLLAERWPMLALGSLPPADYPDSIFANVSEAS

SEQ ID NO: 1020733 - protein, 125 aa, Homo sapiens
MVQLLGFGSAFTMDNQRDLKIPGPWVLDMAWELVELLGYLFWQSTTHAANIHFVKTSLVRTTSYSLPPTLSSVETSGVTQPPSWHVLRDSIIRSCSKLQTPKNPRTCITDYACVPVTTIQRSKRW

SEQ ID NO: 1020734 - protein, 106 aa, Homo sapiens
MGIALSGTLLAGCAPSYSVWTGGMNAFVGTRFDVHLYDDCSRGCGDSYWSPVNKNKVYDQVVKEGDSQRYFLTWIRDCRYSVLVSGEGIIQSWRYETEDRSSCHVF

SEQ ID NO: 1020735 - protein, 73 aa, Homo sapiens
WAVGHVPIITDGHWVVVCVALYDEEGVLEVGAQWGQNYSEAPDDEGHDQHWLLVPGILGEGADSRSHLCLPGI

SEQ ID NO: 1020736 - protein, 240 aa, Homo sapiens
MLAARLVCLRTLPSRVFHPAFTKASPVVKNSITKNQWLLTPSREYATKTRIGIRRGRTGQELKEAALEPSMDTKYLTIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKASCLGCYIPGVMGAAGGSLTNIPGVLFVIELHGTQVDLWEALMWPVFARK

SEQ ID NO: 1020737 - protein, 89 aa, Homo sapiens
MLPSTGRQESLYNKRLPEGKLLTAKGLRLNQQKNLVELSFLPGDTGKPDVLSASLEGQLTKQEERKTEAEERDQQGEKKNQTRNEKKNQ

SEQ ID NO: 1020738 - protein, 78 aa, Homo sapiens
MRELDRERQKLETPGGRKSLQDIKKMAKQGQMDCCPHHGKRLGAHPGAYCAPRWLMDGGPTFPGWCPLRIQNIQVHKL

SEQ ID NO: 1020739 - protein, 61 aa, Homo sapiens
RVFELKLRNATLTFSVHAYAWKITGFHSTVQGLEEQGDYPLDRGLLQGAEQEQSTGPSLQT

SEQ ID NO: 1020740 - protein, 109 aa, Homo sapiens
GRSRGSPLSLGKTRKKRIHRTNEEILSTSTKSRLIITEDFTKNCCVSPIPSAAHSPRASSNFVYMSNVQLSSILAQSQQKNKQTREKNGHPPKQKHPQAPVPRKSVLKQ

SEQ ID NO: 1020741 - protein, 33 aa, Homo sapiens
MCADASVVGHFYPNGPPWRKPTKAINVPTAMMN

SEQ ID NO: 1020742 - protein, 98 aa, Homo sapiens
GPGQGRLPRCQAAQWDSAAPEASTGQGRQTRRGKESQPHLYTRVLRASRRSSGLLVKPDWVHRCGHEESSGERGPTAEIGVLCVDPQGGGGPRSPEDS

SEQ ID NO: 1020743 - protein, 63 aa, Homo sapiens
PVYQPRTNQPGLSFTPRVGYRSLSLEAPMSWRDRLLPASFRGVGFWVDQAKVPVGKKGQLHEY

SEQ ID NO: 1020744 - protein, 114 aa, Homo sapiens
DKEQHRELCDENLVEDISRIQIEQVIRAQHFVWVKSPGLETEASETACDAQDPTPPAPFQSTLSRESQGRSLSVGVTGPVCSHSISSPFMEAWPLLHIHFLHNGNNNIYLVGSL

SEQ ID NO: 1020745 - protein, 97 aa, Homo sapiens
SVASTVGKAWILVDAGLADGQSGQMSRPCTVVRMNKAQLDNYYAIHIAKHCPTATIFILCVNGLSHNEAEDARHRCAAACHAGSVTERGMALCPTRQ

SEQ ID NO: 1020746 - protein, 40 aa, Homo sapiens
YAVVLRSAFMQLLVDHLDHKTAARGSRFAFNDCHDAPLPY

SEQ ID NO: 1020747 - protein, 61 aa, Homo sapiens
GLQVLELEVLETSMGWPDSLSVGHRDCDLLMVMARGRNFYHITVVFGSLGAAAHGSCHRAT

SEQ ID NO: 1020748 - protein, 75 aa, Homo sapiens
MVVEARQIDNPDYKGTWIHPEIDNPEYSPEPSIYAYDNFGVLGLDLWQVKSGTIFDNFLITNDEAYAEGYQLDCI

SEQ ID NO: 1020749 - protein, 126 aa, Homo sapiens
ANSENFVHEALGNMFRNVWFSGKKVNCKNGQGHCYQEALPAMHINRLAPDKRLQVTQLCIPEQPEGETHHCGHVKGAQYVPDHFDATVEDSQLGQSTTRYPTSLNLILSTAASSLLLPCCERSNYS

SEQ ID NO: 1020750 - protein, 97 aa, Homo sapiens
DCEEDTGEDGEEDIGEGCEEDTGMDGEEDTGKDSKENTGEDSEEDTGEDSEEDSEEDIGEDSEEDIGEDSEEDTGQDGEGDTGEDSKEDSEEDMGGQ

SEQ ID NO: 1020751 - protein, 79 aa, Homo sapiens
GPVIVQSLKADYRATRFRCAGAGSLSRTVVSGWQGGIDRMSRGTGISLYGHGLRATPSTRLHSSLAPSVRQSMVSATGH

SEQ ID NO: 1020752 - protein, 41 aa, Homo sapiens
MTCWNNYLVLIPCGGRLGLQGMGGWSSGQCSWMPAVMRRRR

SEQ ID NO: 1020753 - protein, 40 aa, Homo sapiens
ARYPNETGNRRLRREVFVAIYSMQRIDQRAANRPVARATV

SEQ ID NO: 1020754 - protein, 123 aa, Homo sapiens
RKEGDDRRVEVDGWRQASTMTGGLKEMGGGRREMTGGLREMGGGNRAEEGGRWEMTGGLKEMGGGRREMTGGLREMGGGRREMGGELRGKWEMGGGRREMTGGSRGMGGRRGRAVSSSSSTRP

SEQ ID NO: 1020755 - protein, 114 aa, Homo sapiens
DSEWVAPGKPPHTDGTGSMLFLILLSLSCYSRWVLKGSQCPVILDSSSFCHCTFLSVQPCGMAQLQGFCMMGQQTALCFSGYDIGHPYVHADVCICAWNLHHILYLDFLNLGCQ

SEQ ID NO: 1020756 - protein, 152 aa, Homo sapiens
TVSRQKHSCELVLSPLLKSNKPALWLERKPELVYLQVTLSGLSWDMVESGDMEYLIVKRLPLPGLKGKLMDHSPLLSLLASWPLGPAEQEAQLSFSLSFFLFLFYEMESLTLSPRLECSATILAHCNLNLPGSGDSPVSASRVAGTTSACQY

SEQ ID NO: 1020757 - protein, 44 aa, Homo sapiens
FDYVNYLCLVMASSSLCFCRSFPFSSVPITSSAPYLPSVIEATI

SEQ ID NO: 1020758 - protein, 67 aa, Homo sapiens
DWTRVSHTDTRVLIRIGWKSVGAATMLKHIPECYDKRERKKHSLHENPSKMPFPYKVLKDLDPRNLS

SEQ ID NO: 1020759 - protein, 267 aa, Homo sapiens
GHAPGPNADQSQRTPTSPRAQFLARQPLTAPATHEQLDSINKAKYLTKSTPGSQRWSLVKMLDESPPAAERLSDPVERDDQASSSPSEVTRLPQQPASTPCKFPLANCILHAQAGHQPPTRPPLNGVRFLGTSGQNVSDIFRVQQTWRITWRSWRWTLRVRHISPTAADTLGCYPFVAKLTRFILAQSARMSTFVANTHSFGSKIISGPEDQTVLLVTVPDFSATQTACLVNLRSLACQPHQLLGPSGQRTDDLGGQGHGHLTQKSG

SEQ ID NO: 1020760 - protein, 79 aa, Homo sapiens
RGPISYMVQAVVCLLHCKTSPFPVDGPGSHVSRGTVMSVGAQYVSPAQSSSVHGTVMSVQASHVSPGRILSAVAPSQAM

SEQ ID NO: 1020761 - protein, 165 aa, Homo sapiens
TCRRSGINRGPGAHASGLYETFDGLPLTGPGGTPYELKDPLWLSRVEVLRGANGFDLGALALGGAVNYVTHTGYDAPKLQVRYEAGSHGYAQREISSGQVLGDADYYISLTDSHYDGFQNHSAGSGKGMAANFGYRFNPDLETRFYFRYRETDNDSPGKLTRDQI

SEQ ID NO: 1020762 - protein, 59 aa, Homo sapiens
MADMDPELAISCNQARADTSEAKQNNEDQNKDVEKEIQKKEITWEEGRRGREFSSSRRR

SEQ ID NO: 1020763 - protein, 88 aa, Homo sapiens
MVQRGKNSRSHRNRGHHNNRTKSTTVGAHGARQTPQQPAQGPGPHPTAPRPRGPANRGHTHGANQNNGRDRRPEPAGRRKDPHTRKPT

SEQ ID NO: 1020764 - protein, 223 aa, Homo sapiens
FYETGEIPQKNLDVMKEWFSQRNRLLRLLGSWRNRRRYRFKKERNGWLHLPSRLPENRRSTPEECEEMSEKRTKKKKPKPQEVPQENGMEDPSISFSKPKKKKSFSKEELMSSDLEETAGSTQYSPEEEVYTPGGNQLMTLRRPGPPEVAPRKRGNSPKRSPVSRGPEEAAGQSSSQKKKKFHKASPEDENANGHSLGGGAYHRPQVTFPPLCRVPPIKTNSP

SEQ ID NO: 1020765 - protein, 188 aa, Homo sapiens
RKLYRRDAIPGTLLLGCINLYSRIVRLSFPLRDECKTPKKKKPKPQEVPQENGMEDPSISFSKPKKKKSFSKEELMSSDLEETAGSTQYSPEEEVYTPGGNQLMTLRRPGPPEVAPRKRGNSPKRSPVSRGPEEAAGQSSSQKKKKFHKASPEDENANGHSLGGGAYHRPQVTFPPLCRVPPIKTNSP

SEQ ID NO: 1020766 - protein, 221 aa, Homo sapiens
MVNFTGDQIRRIMDKEDLYLKPIQRTILMMGRYVEPIEDVPCGNIVGLVGVDHVPGEDGQHHHLRARAQHAGDEVQRQPCVSEWPWRPRTRSDLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEVGRG

SEQ ID NO: 1020767 - protein, 425 aa, Homo sapiens
SRRLPDVCGQVRRQGGGLVVGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTGPEVPLRAPVRGAPGRRGCQWAIKSCDPERPSYDVYFQNGAKLRLRSVLTPLGNGVFSGLDLHMELKVRIMGPKYTPGKKEDLYLKPIQRTILMMGRYVEPIEDVPCGNIVGLVGVDHVPGEDGQHHHLRARAQHAGDEVQRQPCVSEWPWRPRTRSDLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEVGRG

SEQ ID NO: 1020768 - protein, 190 aa, Homo sapiens
PDVCPMYVAKFAAKVEDQRLACERAKKVEDMMKKLWGDRYFDPANGKSQQVSHQPRREEAADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEVGRG

SEQ ID NO: 1020769 - protein, 440 aa, Homo sapiens
SRRLPDVCGQVRRQGGGLVVGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVIFFFFFFFFFFIFIFFCAAWLPAGDALLQMITIHLPSPVTAQKYRCELLYEGPPDDEAAMGIKSCDPERPSYDVYFQNGAKLRLRSVLTPLGNGVFSGLDLHMELKVRIMGPKYTPGKKEDLYLKPIQRTILMMGRYVEPIEDVPCGNIVGLVGVDHVPGEDGQHHHLRARAQHAGDEVQRQPCVSEWPWRPRTRSDLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEVGRG

SEQ ID NO: 1020770 - protein, 428 aa, Homo sapiens
AHACRDDSQKYLSDNVHLVCEETANYLVMWCIDLEVEEKCALMEQVAHLTIVMQFILELAKSLRVDPRACFRQSFTKIKTADRQYMEGFNEELEAFKERVRGRARLRIEKAMTRSYDGRRSASRACLEPRSGLDPRTRFYDVPHLSELHASASSVRGRCKNCCQSTSEIKAKNWTPNLTPIGTDYVRRMLVELLVSILCGPPRLYTAQSSANGRDEDGTVLGDHMYWNACSPRIVAIEERDVRCDDRDPSVAPDTLASRAPYGAPLFRKTREMPVSDRLRELPSNLTLSSEHSTEGTPTRPPMASPHVIHSSEQPIPSLMLMSQRGLHVTESAKRKVGRCQRKLKELEVDEGGQAELIASGRGQQAGKEGAELPAKLQDMAEGGRGYQERDTPGQRTDEHGSQARKRSSENRREKSKRSTRKTHSRRE

SEQ ID NO: 1020771 - protein, 106 aa, Homo sapiens
VGLDRRCRKGDVRPGTPRPAKSSAYLSFQERSLGPLKSEYCWELSRYTLSHWERDIDLKYVVQGGKAKDLAVRLQWATNRGSNGYSAVDRDVDEYRMIVDYPINVF

SEQ ID NO: 1020772 - protein, 128 aa, Homo sapiens
SSSVPLNRLMLFQETGVSLPTWEARDRLACPGIGWRTLVTQKWTSPLYATSPAGRRGTCHLAALWMSVGLVLTPGRILKVILAWPRCALSSSKGAYKCRVPLAWVDSCSPASLARPSNSGTGSSIWRT

SEQ ID NO: 1020773 - protein, 72 aa, Homo sapiens
MTPPDPTLGGGGLSALGIPHICCHPPSQCFSQHPLVVFSQQPLSGSPATDSSALTPWDGRITAPPPSSKNQL

SEQ ID NO: 1020774 - protein, 91 aa, Homo sapiens
YNSSSLLPNWFFDDEVVDAVVEVIELQVLELALGGAEEFFHAVHVLVHRAAHVHQQQHLDLVVAFGLHADVQQAGVGGRAVDGAVQVQLKV

SEQ ID NO: 1020775 - protein, 222 aa, Homo sapiens
QRPPRVKNIGSPSGGLFVLRRLTNVLRFDSHQEGQMGKTMYGARRSDSPPYGFGDVTSENFKGIPFKFEADQALQAARQDHPKETYRLVYSEEELYMVNEQDMKRVRRLLALLRAEGIDCIIAGGFARDVFFEADPKDIDIICGGVDHYTISTLFEETGTLTRSYPKYNGPESDRLAGVWKILDTNIDVILYEVPTALEAVSKFDYNLNQFVSNEETETSHD

SEQ ID NO: 1020776 - protein, 38 aa, Homo sapiens
MSELKTDVIHRGDCFEVLRALPDASVDMVFADPPYNLQ

SEQ ID NO: 1020777 - protein, 75 aa, Homo sapiens
MPTSTYSEGSTPLTNMSFSTTPVVSSEASTLSTTPVDTSTPVTTSTEASLSPTTAEGTSIPTSSPGEGTTPLASM

SEQ ID NO: 1020778 - protein, 83 aa, Homo sapiens
RGPPVIGVIVIDDTAASIWPDCTAAKSPANGMFVNLTSEPRRLPTSVMRSTSKPTILPLASWNSHGTLPTLAPTLSSAPYADA

SEQ ID NO: 1020779 - protein, 70 aa, Homo sapiens
HTVLSLVNEYDDMERVSSYFVLHISLTSLRTRLWLMQSLGDSKTIPGDTAWLLYDTYGFPDGSDWTDLLK

SEQ ID NO: 1020780 - protein, 170 aa, Homo sapiens
MTVLSLVNEYDDMERVSSYFVLHISLTSLRTRLWLFRAYNDHVVNNYIQFIQRHNILGICPHMTEDNKDLIQGKDLLIAYYDVDYEKNAKGSNYWRNRVMMVAKKFLDAGHKLNFAVASRKTFSHELSDFGLESTAGEIPVVAIRTAKGEKFVMQEEFSRDGKALERFLQ

SEQ ID NO: 1020781 - protein, 45 aa, Homo sapiens
MQTAKTRGLLRFRSPLLSESRLMSFPRASEMFQSPGSTSLSCDTI

SEQ ID NO: 1020782 - protein, 263 aa, Homo sapiens
MSDAAVDTSSEITTKDLKEKKEVVEEAENGRDAPANGNANEENGEQEADNEVDEEEEARWGRHSRQAAKKEQVMAEAKEALAGCKMQEQLSQLTGKAGQPARLMQDDDVDTKEAEDRRRMTRQHNKGKVTAIKTKRPPGPIHPPYSRPQNLTVVTFDVDRPARPPMSSATPADDTRSQPPNPKPLSNFRNQGEDTQRSSKIFPKAPDFFLYTVPLPPANLLGLRIPLPLLLVTYLVRATPFNDLVMTILLRGFPALLDLPCVY

SEQ ID NO: 1020783 - protein, 66 aa, Homo sapiens
MIKSAYHIISGPGRYFGVDVVHQQLLQNSVPQLLRHDHGEHEVKSVGFEHNGGILSAKLWEETRNE

SEQ ID NO: 1020784 - protein, 150 aa, Homo sapiens
MSSSLPLIGSSMTPSDTCACRQGVLVDTAVLQTRARVARVPWWTPLDIGYGHESPGTAGRPLRPTDMDPSPLGQLLKTKGSRTKMQVAREGWLTPQALGAGPESPGTSVGIPVPREWSRVARETWSTQSALKTVPESPKTSGRPSSKNQL

SEQ ID NO: 1020785 - protein, 49 aa, Homo sapiens
ELGTPIAGTLTLSPCDTPAPSSPSTIIATITLVNLYFYLRLIYFTLYTQ

SEQ ID NO: 1020786 - protein, 93 aa, Homo sapiens
TQRLSGHGAFPGHTWGYPGHPTPWAYPSFGQASGPRGPTLPTGPMAPLLGTLIVALYTPPLPGGMVPRMLITILGTRESPMPTRNCFRFPKRE

SEQ ID NO: 1020787 - protein, 137 aa, Homo sapiens
SSSSANTTPPLRQILLLLSARYYSISPPDLLLLSARSYSSPPDPTPPLRQILLLLSARSYSSSPPDAPPRLRQILLVSARCSSSLRDAPPLHRMLLLSSRCSSSPRDAPRLHRLLLVSAGCSSSPPDAPPLCQTLLL

SEQ ID NO: 1020788 - protein, 45 aa, Homo sapiens
IADDRPDLTLTTDSAPEIEALCLITPPIAADVSKKSRMPFASASS

SEQ ID NO: 1020789 - protein, 106 aa, Homo sapiens
SAGQIASLRLGYFEFVCIPICYSAHANKRTLCLATHFFPPFNNGIESIKSRGRFGSCVWETVTDGTVQFPHLMPLCQHKIIQRDFSMRLKLRMNFLAGYVILEFSV

SEQ ID NO: 1020790 - protein, 58 aa, Homo sapiens
SWLTVRENISFGLEMQGRPEKERRALVDEKLELVGLAQWRNKKPDELYGGMQQRVGVP

SEQ ID NO: 1020791 - protein, 277 aa, Homo sapiens
SSPAHPLNRGHLSSPLRQAADEDDKGMRSETPPVPRPTTLSGPGYPGLPENGAPGSPQSLAVPLEEPGPPYASSVAPQASDESVQDEQTPPTKKEPPKEETCDMLTGARSRPESLPAESGVEARAPQHHAERVAQRPAGALVQGAVVVESLQRSQGPPPRQGWAYKESSTTYKSRRAGLPKPLEQGEEPPKPRSQTQLKITKGKLGGPKETQPMDTLLPLSQGFGGTIPYERVPTSCRVRGRGEYLARGRGYTEDYGGREREPKPGIRRKRHVRRHM

SEQ ID NO: 1020792 - protein, 103 aa, Homo sapiens
NWFFDDASLGFSPGSSSKPEHVPRALPSRRQVTSSSPRPSSPCTCDGWHTSRLLDTHPYLPAHGHTMGISNPVLSLSSTFSSSEQCHCGLHPNSGSIRHRRTN

SEQ ID NO: 1020793 - protein, 49 aa, Homo sapiens
DSQLILRINQIFSVLLQQGKASCKLHGVDRSIGEKRYEPIQATPPPPPW

SEQ ID NO: 1020794 - protein, 74 aa, Homo sapiens
KVVSEVQAHCPNTPIILAGNYNLILADDKDTIETLKEKKLTPITYPQGLAMAKEIGAVKYLECSELTQRGLKTV

SEQ ID NO: 1020795 - protein, 130 aa, Homo sapiens
RRREFGHRYYSSRPDSDSSPPDTTPPLHEMLLVSARMLLRSERCSIVSARCSSGPRDAPPIHRMLLISAGCSSSPPDAPRLRRMLLLSAGCSSSPPDTTPPLHQILLLSARYYSSPPDTTPPLRQMLLAR

SEQ ID NO: 1020796 - protein, 77 aa, Homo sapiens
MTAGMAQESKIELQGERPKASIHEKVSSIGTDKDDRKWQKPTLEKTVTNAVVTVPAYFNDSQRQATKDAGSYARSSM

SEQ ID NO: 1020797 - protein, 137 aa, Homo sapiens
PGTEIFNLPAVTTSGSVSSRGHSFADPASNLGLEDIIRKALMGSFDDKVEDHGVVMSQPMGVVPGTANTQFVTSGETRKRGSGTHHLIQEEFCKPKLISKSNSRKSKSPYTWGKATRTRSQSPLYIQKIAEQPPQQR

SEQ ID NO: 1020798 - protein, 43 aa, Homo sapiens
QSDLIFRASLKKYGLGEMYFCVYCHRVVEKGIGMPLCKLHSLL

SEQ ID NO: 1020799 - protein, 149 aa, Homo sapiens
LLLLNSRPRRRKKERKKDKETKEGKNKERERPKEGRKEKERERKREREKGRKEEREKERKEERKKERKKERKKERKEGRKEEREREREREKERKKERKKERKKERKKERKKERTVQGYPTEIVGGGASIAAVHLAGDVDAAANLVVVVD

SEQ ID NO: 1020800 - protein, 41 aa, Homo sapiens
MVLLSLRCSSSSSSCRPWRISGSRAEKGSSISRISASIAKA

SEQ ID NO: 1020801 - protein, 45 aa, Homo sapiens
MIRMINASSSTAITAPTIPYTRLVGMLNSQVSPQYQCVFVFGHRQ

SEQ ID NO: 1020802 - protein, 48 aa, Homo sapiens
HTLSLGKEKATHTERTKLPIRKEPSYHTERTKLPYGKNQATIRKEPSY

SEQ ID NO: 1020803 - protein, 57 aa, Homo sapiens
DTLAVGATSSSRSSTVPMYVRKTMKATVSDVDWKRSPSQRASDKGCTMSNLPQPTRP

SEQ ID NO: 1020804 - protein, 160 aa, Homo sapiens
IPAERYIARSYRAVRKRSWIMDVIQIKNYQEPSVTLSQINRASGYFTQRTWVDGKCQSQTVRVQIVGRTVEYIDHQFHPTGFDAVANHIAQQAVAAHQRVQFAAAAELDGFRANGGAPVDRALQQFAGLVGVQQVVVADKPGGQAVQRCQAQASAAVPGY

SEQ ID NO: 1020805 - protein, 139 aa, Homo sapiens
SSFYSSSRTWLTWTTTLFVRFDSDATSPRKEPRRMDEQEGPEYWDRETQISKTNTQTYRESLRNLRGYYNQSEAGSHTWQRMYGCDLGPDGRLLRGYNQLAYDSKDYIALDEDLSSWTRDTHAQITQRSIEKRSSSHRS

SEQ ID NO: 1020806 - protein, 68 aa, Homo sapiens
IFGKIQNYQRTLVLSPAQLNSAVGQFNNFQKGRWHKSLFSTKGRHYISHQRGLAQDLNSFLYGLMNGA

SEQ ID NO: 1020807 - protein, 144 aa, Homo sapiens
CNVMRVALFMSFGRYFMCIAAEMHIYTEHHLMLYTPSFNTPRSSSPTAFLQPGDSLEHFPKLRCPLFIPTIPIEMINQHLRRRRSSMGDEEVTNHHQEIFAFRLFADHVHGRLECLNSWKTRSHLASTAGLRRRGREFSSSRRP

SEQ ID NO: 1020808 - protein, 48 aa, Homo sapiens
CVHLYTDEVRLTHNYWGVLLSADLCRAFLFAFLLMLSYISGIDPMLAR

SEQ ID NO: 1020809 - protein, 118 aa, Homo sapiens
SRYTAWKPSGFAIYRGRLTGWMDRFSLMLIAGGREAMAVSRRSSMVLSASFESQIFSSSRIIHQSEYGSSCWAPRDIRLTTVQKPDNPMMPTLRSFFGRPIQIQCSVMRVKGELHIAA

SEQ ID NO: 1020810 - protein, 88 aa, Homo sapiens
LDVLQKPEQGSCITWINQPVVPRVCAAVEGGGLAVEFLCGDLFEHVEHIGIGHQAVFQLLGKRIDMAMLQLGCYGRSNKSIVRRKGIW

SEQ ID NO: 1020811 - protein, 46 aa, Homo sapiens
AVNQLGTRLHFHAVHFMRTLPTGSVDPNFGRRVRNRRQLNSLQNTW

SEQ ID NO: 1020812 - protein, 112 aa, Homo sapiens
FLGGKDDMQNPLQGATENRIGKDGTSGADQQWHDSKQMSDESASWGDTENYNFKLHEARNVPIENTEEIIPTMKKEINLQVYQKGRKADVGKTSIYGGTNRNASDKRGAAIT

SEQ ID NO: 1020813 - protein, 77 aa, Homo sapiens
MSFLLLLRPCIIMELVRRLHNWDTDALGQRWAEYRPLHCEGRYLALLLLHSNVILQANVMDLHIIGAPFPKELEVWG

SEQ ID NO: 1020814 - protein, 77 aa, Homo sapiens
SRTFADVIVQRLGHVELAVHGADGLGVKRVAHQPNRLTGNAQADGELRAERHEVEIIGEGLAAQLRLFVPAVEAHVL

SEQ ID NO: 1020815 - protein, 31 aa, Homo sapiens
MRVGSPRDEKRRGGQRVVCETTPEAASGPSR

SEQ ID NO: 1020816 - protein, 75 aa, Homo sapiens
ITRPYVTDSTYQVIGFSCCYIFTTTQWGSLTHHINNIKPSFTREKTQNDPPKNDPPKNDPPKNDPPKNDPPKNDP

SEQ ID NO: 1020817 - protein, 94 aa, Homo sapiens
ICGRSEDPRWAHSGALPRFTVLDDKDRQALHTFFTKFALLSARVAVPGANIIIASNPLLSHIVADAMISAGLELRGYVARQVTDYAKVNGILLA

SEQ ID NO: 1020818 - protein, 77 aa, Homo sapiens
MLITFHSNGRGRSPDAYLTMLVPCSQAVGNVLRRQDSRTRRVHRRPARSWPSSGIERAIEEAQGTHEEDEEDEDKPP

SEQ ID NO: 1020819 - protein, 95 aa, Homo sapiens
CVNSQVGLVDMFVAVDVDAEVVGLPVWVLALASRSVLGVPPRSSRSTAVRANSAASTLAVCNGEGRTLLGLAVTRDSSWCAGAYPGRRQVRPWLL

SEQ ID NO: 1020820 - protein, 69 aa, Homo sapiens
LIGSSMTPRVPRQCPAAGGSLTEQRPEEPPPLPSKVIRAQGVHREEHEHRCLASGLLGELCSAEQRHRR

SEQ ID NO: 1020821 - protein, 132 aa, Homo sapiens
MVEDFQVPADGVSFSVSYRNTFFVVLIVFLVLFVIDASLEIRKYDDVTEKVNLQNNPGAMEHFHMKLFRAQRNLYIAGFSLLLSFLLRHLVTLISQQATLPASNEAFKKQAESASEAAKKYMEENDQLKKGA

SEQ ID NO: 1020822 - protein, 99 aa, Homo sapiens
MADVDSRGYLRSFEVAYQRVYAHTFAREGAVLGAHGRYWKVDHLCTVVRSAFRGLSLDRDPSLARVLRVHEQAWWAVREPLRCLLGVYEMPGEVLWNHQ

SEQ ID NO: 1020823 - protein, 77 aa, Homo sapiens
HMAVKHASESKPDGHTIKKGEGGDRAGRHEALNTHRRQVMAGFKTLGQTRSKGTVHQHRIFSLPQTQMLRRQPTLHK

SEQ ID NO: 1020824 - protein, 181 aa, Homo sapiens
SIYQDPGRSDMHSASSARMAPFQPFSAPRRCQRAHGWAPELVIQPFVDFRDGAHMLEQGTRVWELNVFDATRLKRDPALGVVLWRRIGVFRQLHLVQAGRQRLNRIEALQDRAMLVTRHACGDENAEVSDMRVGEIHDSLAGGDQSFRTFVHDGNPAERLVRWRDVVAVRGKDDDRFANAP

SEQ ID NO: 1020825 - protein, 100 aa, Homo sapiens
SAALKREKYKNQVLDWSLFIKKKGYLWLDTIMTRHMCTTTTVHHDTVHHDTVHHDTVHHDTVHHDTVHHDTVHHDTVHHDTVQTRHSAPRPQCATTQCTT

SEQ ID NO: 1020826 - protein, 84 aa, Homo sapiens
DCVGTNTRFIHSIYPYLYPLTSPYFPPAPSLHHPSQHHDTVHHDTVHHDTVHHDTVHHDTVHHDTVQTRHSAPRPQCATTQCTT

SEQ ID NO: 1020827 - protein, 127 aa, Homo sapiens
VLITPCPCYRNLTQVRRDSFIGGNSRTCTDATISSQEWHPVKSTLNTLRDANRVTELTVDPTAAGDVRPLMHHPPNQIDDHDTVHHDTVHHDTVHHDTVHHDTVHHDTVQTRHSAPRPQCATTQCTT

SEQ ID NO: 1020828 - protein, 78 aa, Homo sapiens
TEINRSFRKPSGSVISDKRPATSRNSEKVSTTTTQCTTTQCTTTQCTTTQCTTTQCTTTQSDQTQCTTTTVRHDTVHH

SEQ ID NO: 1020829 - protein, 122 aa, Homo sapiens
MPGRMAAAGIRLVTVRSNNRPRASRLTPLVHAVKRTELSSPTDVHMHEGSTVHATCCQKCIIHSIGSLLTAEIICIPQQMTADADPTKAPSTIEYGAHRRWANGRISNCLIHANLSKSASST

SEQ ID NO: 1020830 - protein, 136 aa, Homo sapiens
MALWMRLLPLLALLALWRCWPSGDLTQPRAFVNQHLCGSHLVEALYLVCGERGFFYTPKTRREAEDLQVGQVELGGGPGAGSLQPLALEGSLQKRGIVEQCCTSIMLPLPGWRTTATRRSPQAAPHPPPPAPREME

SEQ ID NO: 1020831 - protein, 68 aa, Homo sapiens
NIVSFVSEHSCPHSCPEHSCPASFVKSHHVEGSLVKGCKSADFGLARVIEDTNVQGHRSSQFVTSMVH

SEQ ID NO: 1020832 - protein, 77 aa, Homo sapiens
GTVNCDLFKTLLFDKKLFSRINDPGFIAKINDLRKGGECANQDLMVGYKSENVSDKKQRVTKSRRRGREFSSSSRRP

SEQ ID NO: 1020833 - protein, 47 aa, Homo sapiens
PSSYPSLQALAEAKHWLDTIAYTGSLVVSWWLQWWGNPCDHQETTKE

SEQ ID NO: 1020834 - protein, 149 aa, Homo sapiens
MTTVRDREMPEALEFNLSANPESSTIFQRNSQTDALEFNPSANPEASTIFQRNSQTDVVEIRRSNCTNHVSTVRFSQQYSLCSTYSLDDSTAIQHYLTMTIISVTLEILITITLRDADRSLSIPDEQLHSSGQVSPCRPGWSELETSDP

SEQ ID NO: 1020835 - protein, 62 aa, Homo sapiens
VISKNVKRGYITAFLAKATKILYPHQASLQISEHAEYSLKCFEVAQCTAKTQDVRYLKEVKG

SEQ ID NO: 1020836 - protein, 58 aa, Homo sapiens
KYVRPTRTEKVTYPLWSIYYPSTYRLLSVNQSVDDPSIISMAMLCLYHLSISPSPVAW

SEQ ID NO: 1020837 - protein, 41 aa, Homo sapiens
MLGNACPPFSFSAGSLQDPCGLTEGNPGRATSPRAPFSGGV

SEQ ID NO: 1020838 - protein, 53 aa, Homo sapiens
LVAAKIFTCDGNGALRNRDLFPCVIHSEDPSQMTGISNGERVYISWDPVFPVE

SEQ ID NO: 1020839 - protein, 169 aa, Homo sapiens
RTFVNLRDRFANVVGRTVPFVQAEDFCDCLFSIHHALPHSSVILRSAIAGPTLMPTPVCINAAFTPGAAAQERKRPWATGTIDALPALHDLDLAAQGVFGQFDHPGVHLFGIEGDGSLPLVMTEKDAVKCRAFARPDWWYLAVDAAPSPAFIAWFDTQLMRLLPARLLP

SEQ ID NO: 1020840 - protein, 147 aa, Homo sapiens
ERLHSAHDADKNGAGQSVGCFAYLPAVAPSLVNLHTGKRQPVDHFPVGQQVHAVAGIGNPERFFDTLETATLTPIPHAFADHAPYSAEVLNFTPALPLVMTEKDAVKCRAFARPDWWYLAVDAAPSPAFIAWFDTQLMRLLPARLLP

SEQ ID NO: 1020841 - protein, 208 aa, Homo sapiens
VSVHIPQELSFSGPRNLTRCRHGGLCSHLISSDQLCPKWSGVASGLCRSFCPWSRIAYSCDWKELCSMAAVPMVLSAMGFTAAGIASSSIAAKMMSAAAIANGAGVARAAFWLHPAVTCGATGLSGLTKFILGSIGSAIRGCHCEVLLAPCTLATAEKRTMPGEKDPAIVTQRGANYPKYTWGEIYQILDLQRKLRNKDELLQLESPK

SEQ ID NO: 1020842 - protein, 311 aa, Homo sapiens
MIWWYRYAFFDAALGREHFGACQLTLLALIDMTLHGAVLFGVALGLLVACKLGTEDGLVELSNQTSIVFSTCGMGLGHVETALRITDRVALLTQSDHGVGGRFFCLTCETHRIAELLRLSCFVLRSWYLISCIASSSGSNSVPAPCDVYGSRYTDVGCGRRDTGVAEPEPYSASSSASDGCGVSVLPLPYGSRGRPAALFADTYGFSSLLLLGSAGGCSTGGILGFRRNKGFMRAEKQDAPPPSGGISASMGPQGSKPARTLGARVPTGPLKAPSTAAPAASRFHKDECTYNLLTHERFSAMRVIPNSCGI

SEQ ID NO: 1020843 - protein, 108 aa, Homo sapiens
PDHDLCYVNEIRKGLQLYTSAPTEPYLSYQNYGELFIQHRFIWLVDDTNVYNVHYFTSTFEGNLTPKPNQREPSSSTNPRTGTDVPQDNPHVQCVSGQDPYGAEDKGA

SEQ ID NO: 1020844 - protein, 75 aa, Homo sapiens
SPLPALAIAPETKLGEACLIMEGAEFTENIINGVERPVKAAELFAFTLRVRAGNTDVLTDAEENVRQKLRAEGVM

SEQ ID NO: 1020845 - protein, 55 aa, Homo sapiens
MRVPRGSRDVIPNTREKERHSYFPLGTNYDDANIPFVQALGSVNQVVKFVLGDNI

SEQ ID NO: 1020846 - protein, 42 aa, Homo sapiens
MSSVQSVYHSYTFTTHHSITITITIFITITINFNITTIITTN

SEQ ID NO: 1020847 - protein, 73 aa, Homo sapiens
MARDYHIKQRDSKTHPEKAEDRGGQVSVGGRDIPFQRAEIRRHEITVHTYQGAWRRSPPHKTQHAPHSRSPAS

SEQ ID NO: 1020848 - protein, 131 aa, Homo sapiens
MVEDFHVPADGVVIVLCATPSLWFSLSSLSCSSSMPVLEIRKYDDVTEKVNLQNNPGAMEHFHMKLFRAQRNLYIAGFSLLLSFLLRRLVTLISQQATLLASNEAFKKQAESASEAAKKYMEENDQLKKGA

SEQ ID NO: 1020849 - protein, 145 aa, Homo sapiens
GAFAELLHSAMPAPSFTLAHRWLYARPSTSHEFGVLADADLGLYVLWRLVPVGPCGRCLAQRPGSGAAVDRASAMNRINPAKLLLSEWTAARPQHKEKHFLVTQLLRDEEGDVQEIELEAVMSHRVQRLPWQTLQNAEDWKIGWK

SEQ ID NO: 1020850 - protein, 104 aa, Homo sapiens
MHLPCVAKYFQSNAEPRCPHCNDYWPHEIPKVLDPEKERESGVLKSNKKSLLVQAALAIVPCRGAGCLEWPDRHSPSWKKGVRVSGSTRVTSFVLMFTVHSFGI

SEQ ID NO: 1020851 - protein, 37 aa, Homo sapiens
MKIFTIGFTKTSARSFFTKLSASGAKRLVDVRLNNVS

SEQ ID NO: 1020852 - protein, 82 aa, Homo sapiens
MPVLCGVMSTHCIVNRLVHSIRSFGRKNQNDSVTPRTRMPALAAARKKPNYNHPLSHWATTVHLKRTTEVDELIKLNAIHPT

SEQ ID NO: 1020853 - protein, 196 aa, Homo sapiens
MCYRIRSLLIRVTDTCYRYVLPIRVTDTCYRYVFPIRVTDTCYRYVLPIRVTDTCYRYVLPIMAYTCYRSWHTRVTDHGIHVLPIMAYTCYRSWHTRVTDHGIHVLPIMAYTCYRSWHTRVTDHGIHVLPSMSIHCVTDHGIHVLPIMAYTVLPIMAYTCYRSWHTRVTDHDIHVLPIMAYTSYRSWHTRVTDHGI

SEQ ID NO: 1020854 - protein, 126 aa, Homo sapiens
MAYTCYRSWHTRVTDHGIHVLPIMAYTCYRSWHTRVTDHGIHVLPIMAYTCYRSWHTRVTEHGIHCVTDHGIHVLPIMAYTVLPIMAYTCYRSWHTRVTDHDIHVLPIMAYTSYRSWHTRVTDHGI

SEQ ID NO: 1020855 - protein, 134 aa, Homo sapiens
MLLHVLPIMAYTCYRSWHTRVTDHGIHVLPIMAYTCYRSWHTRVTDHGIHVLPIMAYTCYRSWHTRVTEHGIHCVTDHGIHVLPIMAYTVLPIMAYTCYRSWHTRVTDHDIHVLPIMAYTSYRSWHTRVTDHGI

SEQ ID NO: 1020856 - protein, 67 aa, Homo sapiens
EWYRSCGCGLFRRGELNFAECSSGMVFGTMGEMGPSVLKPPSVALVGIAGAAPGRHFPAKSSFSTKE

SEQ ID NO: 1020857 - protein, 96 aa, Homo sapiens
MVPHSDTVQTEDVLVISSVNFITKEVKGGSASTISISLINESSLSEVVVTALNIKRKADNLSYASQGIKADKLTTTRIQDVNNALAGKISGIQVRS

SEQ ID NO: 1020858 - protein, 90 aa, Homo sapiens
PPVPAQGLKTGPPPPFRPGDFGGPPPFRPGVDSGGPPPLTPTGDSETAPRAAHGLNPGPPPVPPTGDFEAAPVPPTDDSKEAQMPAVIRF

SEQ ID NO: 1020859 - protein, 228 aa, Homo sapiens
LFIDNFRFTQAGYEVSALLRPSAVGYQPTLATMGTMQERITTKKGSITSVQAIYVPADDFDVTLPLLRLLCPPCIATTRTAAVPIAELAIYSSLVDPLDSTSPTMDPNIVRQPTITMLPRGVHKILHGLQIPPGYHCHPGLWMKLSEEDKLTVSRARKIQRFLSQPFQVAEVFTGHMGKLVPLKETIKGFQQILAGEYDHLPEQAFYMVGPIEEAVAKADKLAEEHSS

SEQ ID NO: 1020860 - protein, 110 aa, Homo sapiens
NSSSYPTSYASSLTSHHCFYSILFYSVLFYSVLFYSVLFCSVLFYSILFYSILFYYILFYCILFSSVLFFSVLFCSILFYSNLFYSVLFYYIVFYSILFYSVLFSSDLFY

SEQ ID NO: 1020861 - protein, 47 aa, Homo sapiens
MMNSELPIQCKADGARVSPIHAVIKADTIEYFLSNRLLILIDAGKWS

SEQ ID NO: 1020862 - protein, 265 aa, Homo sapiens
MEAIKKKMQMLKLDKENALDRAEQAEAEQKQAEERSKQLEDELAAMQKKLKGTEDELDKYSEALKDAQEKLELGEKKAADAEAEVGSLNRRIQLVEERAGSCSGAPWPTALQNAGRRLKKAADESERGMKVIENRALKDEETDGTPGNPIKEAKHIAEEADRKYEEVVVSWVIIEGDWEGTEERAELAESKCLRLEEELKNVTNNLKSLEGQAEKYSHKEDKYEEEIKIFNDKLQEAETRAEVGERLVAKWKEIVTGNEFHARNE

SEQ ID NO: 1020863 - protein, 127 aa, Homo sapiens
MKKQMELQEIQLKEAKHIAEEADRKYEEVVVSWVIIEGDWEGTEERAELAESKCLRLEEELKNVTNNLKSLEGQAEKYSHKEDKYEEEIKIFNDKLQEAETRAEVGERLVAKWKEIVTGNEFHARNE

SEQ ID NO: 1020864 - protein, 71 aa, Homo sapiens
RHINGEGCILSLGGRRGGRHEGRSEPACPLLKGRLGDAAQSPRGAQPPCITARSSSGRGALLDIIPSPVAW

SEQ ID NO: 1020865 - protein, 166 aa, Homo sapiens
MRRRERIRGEERGDLGIVAPEADIDTRDALRLGSHINSGAEFLERAQIVDPQPDGVAALLCELPGQAPAHADVAVVVDDAAEEIPGCDGAHGVKRRRPEKADIVSAACSTLTPSEPANAMPPDPTPPDLPETPESVEPSAAANVPDFDAKATIARLPNLPGVYRYF

SEQ ID NO: 1020866 - protein, 327 aa, Homo sapiens
MLTTCSCTRLNQPYSQCFNNSPPARHQPQTITSSHTTQPQQHSQRPHIPGTREQNNATKHNCAHTRTPPHARHTGTHRQNTPKHTRWIKTQDRNNTNNKEATPDTKPPPQSRPREDTTGQIRKKPHADDKQATQTQNNKQHSPRTPQTTTHKSTSNNKRKGQQYMSHHIGPHKRHQHREPPNTQAKTERTKPTTNAKHNNKTTEHTEISKTQTHELRTLTKYTQQYRRIKWKMSGEAEERSGSREGGEHRAGGGGRWQGGHGQVRACARDNTNREQEERRARRAGRQKREDRGGRGEREQIVERGDRERTEAGERRREAREGKGRVW

SEQ ID NO: 1020867 - protein, 101 aa, Homo sapiens
EQHRAFYELLPYLVVGAVDDQGLPWATLLEGAPGFVYSPDPYSLRIDSLPAVDDPSRGGAEEGCAVGLLGIDLNTRRRNRMNGVVVRLALMVLRWTWGYRA

SEQ ID NO: 1020868 - protein, 117 aa, Homo sapiens
SQDLRNCVVLWQAPREELARRFEEQARVQQIQNEMLQAQQKSIEELKSMVAALLGHSTKSKSMDASPSKTTKGKGKEKMAEHSASDDAVDSEPEIVVSSAEEPEAGDRKRNVHNTTQ

SEQ ID NO: 1020869 - protein, 35 aa, Homo sapiens
RGKSTVWQLLRARQGRKAGVLGAPADIHAPATLLL

SEQ ID NO: 1020870 - protein, 117 aa, Homo sapiens
YFFGYDSETIRLFKGNSPDGVGKSFKDNRDPNGVYVNRDLVKVGKDGTHYLQYSSTQPGQTELVPKLGYTEYLPKWDMVIGTSVNLDGIDAQVAEVQAKVEKRMEGVVLSIIGIAVV

SEQ ID NO: 1020871 - protein, 313 aa, Homo sapiens
GTMATVSHHRRDQRPGSCGSCWSLQWAVEAISDRICIHTNAHVSVEVSAEDLLTCCWQHAVVDGCNGGLSCCSLELLDKKRPGILVAIYEIAMYGVHDSYRPSRSLMRHHCQIVISRARMHRGDGTIPPQRVVNRSVEPVLTSAVPDETGTKAATRIQIPYRRTPSSVEADIIGLRSYRKRAPVAGTLSHVSFRTFHAHTESGSVRNTSPGEMMGGQCHPHPGLGSGRMAHPTGWLPTPGNTDWGDNGFFKILRGQDHCGIESEVVAGIPRTDQYWGKDLICRGPVVPVLGARLGVANVHYSPPIFINYSVDN

SEQ ID NO: 1020872 - protein, 144 aa, Homo sapiens
QREYLERIAKTKKKMAENGIEVLLITNPANMNYLSGYDGWSFYVDQMLVLIIDEEQPLWIGRKMDAAGARATTWIYHENIISYPDIFVHSRERHPMDFVAEILKQIGQSQRHIGVEMESYYFTALVWERLKAGLPIPPKTGDRA

SEQ ID NO: 1020873 - protein, 58 aa, Homo sapiens
CLDVLCLDVLPFEAGAAAVGLALANVVPVIVQGDAAAPAGDGGDQQLAAGVFTHVFGF

SEQ ID NO: 1020874 - protein, 55 aa, Homo sapiens
MHKPSPVAWCARRRRREKGLPKYESPIKRQTDRQLSLIEAITGPKTQELQKHRQE

SEQ ID NO: 1020875 - protein, 69 aa, Homo sapiens
QVPSGRRLLAESVPGGVPIVAQWLTNPTRNHEVVGLIPGLAQWVKDPALPELWCKSQMWLGSCVPYIAV

SEQ ID NO: 1020876 - protein, 41 aa, Homo sapiens
RSTYSSQSSRRAGHEDPPIIPTCKGTCKPGTWVHATRYMQR

SEQ ID NO: 1020877 - protein, 100 aa, Homo sapiens
SPSYNKYIRSINHLTSRNTSISLHNTSVILPYYVLEGLILSLYMYSYSHNPTTPLPLSQYCAYCHTSLCRLRDTVGLALLVSISNTYGLDYVHNLNLLQC

SEQ ID NO: 1020878 - protein, 100 aa, Homo sapiens; identical to SEQ ID NO: 1020877

SEQ ID NO: 1020879 - protein, 125 aa, Homo sapiens
AAWMNQSAAWVNQSVHLLLCVAKFNEPAAMRVQRVVSSSLVHRNRKRSLRFINFFRSFEIDRHRRKFPVCNMYPFAPACIFAWKNYLTAPGKTIVADETASHKHCRVLSFDFSGRTKEKLKSSYC

SEQ ID NO: 1020880 - protein, 94 aa, Homo sapiens
AIALQQIIIISHPSGVESQLNYLDAGGDSDDYGSGGEICSCVYVYSYGTYMVVRTQMKPRKPIDISSSDHTYGIQMVRVFRSSSYNIGDYSEAW

SEQ ID NO: 1020881 - protein, 49 aa, Homo sapiens
LDRAGVLDQLEQRLHVDTGRCHQQVGQRLAVELDGFDVSTGHFDDLADQ

SEQ ID NO: 1020882 - protein, 105 aa, Homo sapiens
MSQRGSTREEDVQTARAEVRATQARIAMFQAQIRQAQASLRSDEAELGYTRIYAPMSGTVVAVDAREGQSLNAQQQTPLILRIAKLSPMTVWAEVSEADIGHVKP

SEQ ID NO: 1020883 - protein, 159 aa, Homo sapiens
PDKDADGAFTAGQILRDDNLYYLAGDFFLADGFSLRALAYHHDDRGEGLNWNSGAWSNKGTAQEIPIIFRNTIYTIDRDGGTLSFDWELGAHRIEGGVWYERNTSSAERYQTAVDGPRDLSGMNTLPSDVGVFAQRTRYKTHQFFLKDTWRLLDDRLTL

SEQ ID NO: 1020884 - protein, 58 aa, Homo sapiens
AGVCDLYVLVCGWIRAGVCLDDVLVCGLHDVLLCAIPEVLVCGWIICCCVDRAATVVM

SEQ ID NO: 1020885 - protein, 107 aa, Homo sapiens
HDLSSFGSIPSNGTAGSNGISWFWILEESPHCLPAVVELIYTPTNSVKASYFSTSSPTSVVSIVFLIASPFSIWCAHWYLTCSICICHFSCNAPVHAALLIIMSYLA

SEQ ID NO: 1020886 - protein, 35 aa, Homo sapiens
MLKDEKEENVAEGVFDCVVRLERNGVISAHCNTVS

SEQ ID NO: 1020887 - protein, 100 aa, Homo sapiens
KLLEGDPSKAKAIAKRYADIAAVMSKSGAMTAEDITQFGKYAYSGASAAGISDTTVAAIGMALKRANMTGQESGTMVRQLASRVLSPTREGRQSAIANGI

SEQ ID NO: 1020888 - protein, 223 aa, Homo sapiens
AWQARGNRPRTGTILIATDVASRGLDVEDVKLVINYDYPNSSEDYVHRIGRTARSNNKGAGVYLLHPREPKTGQESLSKCWKRPIRAINPKLMQLWTTEEAAEAGEGVVVSRYRTTSSANNPNLMYQDECDRRLRGVKDGGRRDSGRSIGIVGETYRAVVMLMAVAYGSRKILPSEHKQAQIHRMVKAPMGQLLMGPDSYTGSKNMVLANLWSVVAAQLQAGQ

SEQ ID NO: 1020889 - protein, 392 aa, Homo sapiens
CEHRGIMACTGQRLCGHSAVYANTLVDVCAYAGSGTVLKVQQLLHICSEHFDSKEKERKTKTQKDTRTDTDKKASPCMTWEHIRAVAVLGIALPLLCGGGALVQSWHYNHLRHLLRYGGAYNSERDIVTILATWTLISVIQHPRLNILRYHKAKLLSCMLIQKFHYNSNDIEHGALVRAVVTKYLPRTGLHNVCSQIYASQLLKTTGEPTNTTIIHWIAPMRHQGTLDNTIVRRQTEHNPIKRPLIAPPIPPQQQRHQERRPYKADPNGMAAQVRSGNTSGPPTHEHATGTTNNDTTRTKLHTPAKHESHKSPLKRSKTTCHKRLQRTTEQAPYAGPRDEAPTDQHDPRPTQEKKNSEHTHSATDNTTAQSSNDRHHSKAQQSETVDNRRPP

SEQ ID NO: 1020890 - protein, 58 aa, Homo sapiens
SGHTPPEKVTSVSTTRRDLVHVGVVIDQQDLPRGHRQRGVHGRVLADTIGMWPFSGGV

SEQ ID NO: 1020891 - protein, 259 aa, Homo sapiens
MLTRKTYISRSSSISRASSICSSSNISTSSSISVSSSIFMSSNNYQSSINWLNIHVFQRLQCADLLTFRSSSVCNIQGFRWHLCQGPSNNSGSSSDFKSSNNLKVFQIILSFQKIHIFQTIHVCPDKPCLPRQLQVFQSIKSSSKSSLPAITGLPPNPDLPGKSTSSRKSMSSNNFKVFHQIQIFQLIHVFQKNLCVPPNPSLPVKLVLPEKSRCSSQSVSSREKSRSSSISVSSSIFMSSNNYPVFHHTGSISMSSNP

SEQ ID NO: 1020892 - protein, 225 aa, Homo sapiens
MLTRKTYISRSSSISRASSICSSSNISTSSSISVSSSIFMSSNNYQSSINWLNIHVFQRLQCADLLTFRSSSVCNIQGFRWHLCQGPSNNSGSSSDFKSSNNLKVFQIILSFQKIHIFQTIHVCPDKPCLPRQLQVFQSIKSSSKSSLPAITGLPPNPDLPGKSTSSRKSMSSNNFKVFHQIQIFQLIHVFQDFKSSNNLKVFQIILSFQKIHIFQKILVFPQIH

SEQ ID NO: 1020893 - protein, 72 aa, Homo sapiens
LEVIWWTETSNLHLGRASRESHVHVNDIAELWTRQHQHDHTTSSTVSFVGGHIHGSCEPRWTTPSVTCAPQP

SEQ ID NO: 1020894 - protein, 202 aa, Homo sapiens
MHTNHISCERVLKQLPLFKYREIATGLVFFKCILKNMGIFFCSCQFTDQKKKKNSENYLDLWWNPKLLQYSKKSGEANLRGTWGHTELAFFSYTEGPGAAISTFPKTKGPGPVRTVDGPGFYTYLENVFSPRVVEALAAHVVVVVWCQEPVKVLHFESDQNVGTLTQLALRRGTRVHLSHVGHWEGALVGPSGVKYPGEYTA

SEQ ID NO: 1020895 - protein, 93 aa, Homo sapiens
PLSDAWENRNKARIMSKLSWAEGMETMTNISVNVLTSAGHRGGENTPGLTELVAAHEVHLAPAEDVQDEALVGVRELHRSMYLFAVGAGLLRL

SEQ ID NO: 1020896 - protein, 38 aa, Homo sapiens
YQTYAKIHFTSHIRRLNLLSSHNRFLGSIWNAPKFLRL

SEQ ID NO: 1020897 - protein, 90 aa, Homo sapiens
RARYPSDGDVTDDHDRHRRLVDLALARQEPRALALHHPAIEGFQRLQQRKRRMAFVPGLEQTISHGHQGWLAASTVVMRKCPLGYPLDTS

SEQ ID NO: 1020898 - protein, 88 aa, Homo sapiens
DECTKSASAACAFIIYPPAEFTDKTFKEHLGEEFLFVHEGQVEVDFMNERVLLARGDALHFNAQKPHRIRSVGEVQAQLLVVVHSAEE

SEQ ID NO: 1020899 - protein, 57 aa, Homo sapiens
MLSPNTVVVEMMGVTVVLFVLVGVGVGVIVVVVVMSTVVGDCVPVGVGIEVTEKEEV

SEQ ID NO: 1020900 - protein, 74 aa, Homo sapiens
SAVPPQDSCEERRICSHLSVSIFPAKGYYSLFPSQIFFEAIPPCSTAHPSALVFTACMSTLLDYGMQLHTSFSS

SEQ ID NO: 1020901 - protein, 130 aa, Homo sapiens
GTPAGWRVSLACWAPESSCKAEVIAMCELYVKADPILYESRSRSLRICGVVTTVRLENQFWDILSEIAEADGMTTNQLIAKLYEEVMDYRGEVVNFASFLRVSCTRYLSKQRVHAPELSLVNTRNGAQKI

SEQ ID NO: 1020902 - protein, 48 aa, Homo sapiens
LVHRTFSDFLSACFKENPCVQNACSQLAPYQMVSFTQISEQQIELILL

SEQ ID NO: 1020903 - protein, 239 aa, Homo sapiens
MIRYAEHYGHREKTYSECEDGTYSPEISWRHRKGTKGSEDSPAKHAGNNESHSSRRRSRDSKSKVTSGVERNEKPWLVKDVPECLELRGKWNSFGTPREEVEATGQAGRGEGTWGSLFEIEVLFPTDLGRVRPDPSAGGPLATLGALSLLLTELLMCRHRWQRGVLTGTTVAIHSQLPRAAPRLLDQWMQRKHLPSDRGMNPMVNGLVSPAFISFSKIYLSIDLTFTFRPLFCLLFRLL

SEQ ID NO: 1020904 - protein, 51 aa, Homo sapiens
MLSPTPTGTQSTTLTPITTTTTVTPTPTPTVHTDPNNDPISTTTTVLGDNI

SEQ ID NO: 1020905 - protein, 88 aa, Homo sapiens
GRATELKYLCRSHNYWFNVLRLQTTPYLTLQPKNKQYQAIHRSWIAAKPNPKEDGFGEGIYSGNSDGAEPQKIELYKLTNKKVLEWLA

SEQ ID NO: 1020906 - protein, 138 aa, Homo sapiens
AGTFNISFRQRNAIKTTMRYHLTPVRMAIIKKSGNNRCWRGCGEIGTLLHCGWDCKLVQPLWKSVWQFLRDLELEIPFDPAIPLLGIYPKVYKSCCYKDTCTRMFIEALFTIAKTWNQPKCPTMIDWIKKMWHIYTME

SEQ ID NO: 1020907 - protein, 141 aa, Homo sapiens
AALRHFFMHFQSLGLDRLLADSAVTLERQFPGEQAQALRFGFEGFVQAFGAVLRQGFALGLGGEGVEGVELRDDLRVFVQETVQRALVVIAGLGQCVTPNRKGFKRRCDVAPGVFAQAALDGVAYRLKQKQQQVSHQHRDQ

SEQ ID NO: 1020908 - protein, 95 aa, Homo sapiens
YEVDNLVGGSTDGDAALPRGPVSQCTIGVRVGTLPAPSPGSMVQVEVSGQLILTKLSVTSSGTYRCVATTQMGRASGELTRLGYRIPPGGEWPAL

SEQ ID NO: 1020909 - protein, 107 aa, Homo sapiens
NWFFDDRTFGIPPCLPATPHVTVLRLALASKAQLELMLALLSDTCHRPIDGVLSENQHLWCLSLSKALNPNTVLSHDDDPLQLLRAWVEPTVWQRLRLRFARHRRTN

SEQ ID NO: 1020910 - protein, 109 aa, Homo sapiens
KIPYTTCCTLYVIPTLSVLSYVSLCAVSCCSLSLSCLPFCISVYFHVYLSVIISDVSYVHHLYSVSLSLSVFLSLFFSLPLSVSPLCVSLYLFLSLCLSLSVSISVLLY

SEQ ID NO: 1020911 - protein, 133 aa, Homo sapiens
APVGISFRPLATHRPRRLLWLADAVSPQGQIVITDGAVEAATQRHSSLLAVGVTRVHGDFQAGDPVTILASDGRVVGRGIAQFSHDEVRVMRGRSGAWLAAEMGPAASREIIHRDAMVLSRRRKAEPSSKNQL

SEQ ID NO: 1020912 - protein, 64 aa, Homo sapiens
CSRSEDPPLTWIVTANSPSAITPERIPRAKSRFQCFGKIREFAANRAIDNQVAGANDDTTNQGG

SEQ ID NO: 1020913 - protein, 138 aa, Homo sapiens
MSLAPGVIRDAIISFLHALGSDASSTEIVAGISCTLGQVSPSSVRSYLALNTPKIFERTERGRYRLQGLPLIHLSGVGDFTNTKIGQASLYRADCFDWLASQEASSVHAIVTDPPYGLVEYTAKETTKLRSGKGVPSS

SEQ ID NO: 1020914 - protein, 163 aa, Homo sapiens
MHCILDDITYLIGYNFFEPGSDAIPCCVIQRLYRRHVFLIGQVLHIQRHLPVLARRFIPHVRPEDCVGGRIEAVRIIHRRTRSRLHVHPGIEARRVLILHFALIDMLRNSRQLVVAEGRVVPVVEVVVGVHLAQGDFFTRGVFPQARIQAGLDPLMDRRVALN

SEQ ID NO: 1020915 - protein, 219 aa, Homo sapiens
VQPTSEERIPKTIEIKSITHDIEEKGVRMKLTVIDTPGFGDHINNENCWQPIMKFINDQYEKYLQEEGQNQTEKRAYGTRVYTCVSHIISATADYSPRGLLDIEFMNTLSKVVNIVPVIAKAETLTLEERVHFKQRITADLLSNGIDVYPQKEFDEDSEDRLVNEKFREMIPFAVVGSDHEYQVNGQEDLGRKTKWVEDTNTVSFLTAGPSHQAPIVRF

SEQ ID NO: 1020916 - protein, 33 aa, Homo sapiens
MAIEELSLTHGGQALRSCVSAFSAGSAMEVGLV

SEQ ID NO: 1020917 - protein, 141 aa, Homo sapiens
VTNTFSLYRRWLRLPCPSSCWYHRRDTLRLDVGKGYNMWVACSLQSTVAWSLLCPFFKYFLRKWTSAPFFSALLHSLTVLPAAPMRRRCEGSLRTSTSRKRKQENYFLPPSLDQISLPSAPESAAKIFLRDAVKTRGRGQP

SEQ ID NO: 1020918 - protein, 112 aa, Homo sapiens
RFDLEDPHAAPRYKTQNHRCGVLGKIKVESAFHTPTGDVRRHGGPDTKLRHSTVQFGEYTRPGLASWSGGTSSEQKSDKKETCVHQTCHDNGKNDQHETRKEYVCRHGILRT

SEQ ID NO: 1020919 - protein, 46 aa, Homo sapiens
LGPSHGVNKVTRSDGFIRGFRFGIFLIFSCYHHVRSAIASRYEMLE

SEQ ID NO: 1020920 - protein, 361 aa, Homo sapiens
SDTVPTYQSNMSGYLKQQVQLTQIAMEQQVKSYKKALTASLPVLDAEVDIDYKNQAKIAKTLSTQNLGIIRRLEFINDRFNELKTLGDEGAAIIRKTIRELPQLTLIELKSLEIGLGRYLCIDETQSQVPATVRERMGQIVDSAEINVESFSEIIERGNGASLDNRIEVLNSLVEQFSSADQRLLDLHADYPQHLLKPRLERFRLQISEFSQRAIHDLAYLLRGKKAQQPKPGSSRAEPAPRREVIKTRHHGLVMGEPREADSSLVDVKAHMTGKVLATFHEKAPGVWVKRQKAPSQPSAPVAVDLDTSINTGQALLDGEQAETRKYQAFSRKPWHAPQDIQDMFDDHAKALEKAQRYEEA

SEQ ID NO: 1020921 - protein, 225 aa, Homo sapiens
MGQIVDSAEINVESFSEIIERGNGASLDNRIEVLNSLVEQFSSADQRLLDLHADYPQHLLKPRLERFRLQISEFSQRAIHDLAYLLRGKKAQQPKPGSSRAEPAPRREVIKTRHHGLVMGEPREADSSLVDVKAHMTGKVLATFHEKAPGVWVKRQKAPSQPSAPVAVDLDTSINTGQALLDGEQAETRKYQAFSRKPWHAPQDIQDMFDDHAKALEKAQRYEEA

SEQ ID NO: 1020922 - protein, 66 aa, Homo sapiens
MSRQYGEFVGSTTSAQHSAPLGRASHPKLRLVLDVVVAAAGVALLVWGIMVMASPTVSCRGSQTFL

SEQ ID NO: 1020923 - protein, 102 aa, Homo sapiens
MGIERKKFFREMISQPLSLYNERLRGPGALTMSYAAWTVGKGESSASLDGQEGEAPPPLQSPTPHERLKAADNSRGTLLPDIGKVSTTTIVIKRCGLTLITG

SEQ ID NO: 1020924 - protein, 37 aa, Homo sapiens
TKQTDDMILLDDNFASIVTGVEEGRLIFDNLKKSFAE

SEQ ID NO: 1020925 - protein, 130 aa, Homo sapiens
YRVNVQHDETYNLLKDYLDWALYRQLRLKHGLSYGPWVEREVLGGVGFLSLNADLERENLPEAEQVLQDLKAQLLKDGLDPTVFTRLQQAAIARQAWAVQGNSALADYYWSAAGDYSNERFSDPVKRIKA

SEQ ID NO: 1020926 - protein, 204 aa, Homo sapiens
LVFLALSSIIGICDLLRKHWVANNLFGLAFSLDGVEVLHLNNVSSVSILLGGLFIYDVFWVFGTNVMVTVAKSFEAPIKLVFPQDLLEKGLEANNVAMLGLGDVVIPGIFMCRCCCGCDIICLKKKYHNNLTFLTPSFGKAYNASGLGPLPSSIMHIFKHAQPALLYLVPCLHRSFRVLVVALAKGEVTEMFSYEESNPKDPAA

SEQ ID NO: 1020927 - protein, 102 aa, Homo sapiens
VHKLGSLSGAAARALAQPPVPFDFDVEFRNVADLDRTIDRSRCGLDPFAVAAIPTMNYSSEAFHSKDDAQCSICLGEYNDKEILRIMPTCRHNFHLECIDVW

SEQ ID NO: 1020928 - protein, 80 aa, Homo sapiens
APSRQIPASRIGTCAAQHLPEREVPRHHRQNRPQRAIFDARTLRFNLGGFAAEHQRAIFGACLNQIAVACPGFAEVGPRA

SEQ ID NO: 1020929 - protein, 79 aa, Homo sapiens
MPTLPPSYNTSEFLRIKWSKIEVDKNGKDLKETTVLVAQNGNIKIGQDYKGRVSVPTHPEAVGDASLTVVQASWQVIPG

SEQ ID NO: 1020930 - protein, 53 aa, Homo sapiens
GTYQVCSVLKEASGGDRDKRTSGRSRLDTLDSKENREHTPDHYTRHSTYQSIA

SEQ ID NO: 1020931 - protein, 61 aa, Homo sapiens
RYTHQAHRPNPDTHLHHHYGDPNPNTHRHTDPNHDTHHHHHHGDPNPNTHCTQLPTPHHYH

SEQ ID NO: 1020932 - protein, 185 aa, Homo sapiens
SPRAPVQSGSSRMLQLMNRTYTREWYMAKVDRIKELLPDCGISSDIIAGFGTETEEDHQETLSIMQYSGYDMSYMFFYSERPGTLAARRYEDDIPDEVKKRRLQEIVDLQGELSRQSNLKDLGKTFKVWVEGNSRKSDADWMGRNSQNKVIVFPKKDMNEQLKGSYVMVKVTDCTKTTLRGEREL

SEQ ID NO: 1020933 - protein, 43 aa, Homo sapiens
MDGPERRAAGPLWVRWYEERGGVTRPPSRLSSADRFAVMGHAA

SEQ ID NO: 1020934 - protein, 79 aa, Homo sapiens
HATGEGLAASTHPVHLIGASIGAWRMATGAMHDAARQFRRLAHDYIHERYEPEPGRRTPSAAQVSRRFSAALDAFSVLA

SEQ ID NO: 1020935 - protein, 181 aa, Homo sapiens
MIPTLQLGVPTGSVRLGICEFCASPFCYMHMQQKNIVLGTTFFPPFNNGIESFKSWGRFGSCVWETVTDGTVQFPHLMLLCQHKIIRGTFSCGFTQDELPGWILILRISRISSNIKQFHASGTKFASALEFLHCGWLEACLEAGSWRYRSAILVVQLVCGLVPLLLKRGWYLEMECKLTSA

SEQ ID NO: 1020936 - protein, 171 aa, Homo sapiens
MDFKCQLYDLRAELGALHSAWVTMPWFQHYRNVTVGPPENIEVTPGEGSLIIRFSSPFDIADNSTCFFCYYVHYWQTTRNPTGQRAFQKRLHSWVIKTSECLFQSRQLFGTVPLSGVMQHFCQTKRDAPGVIRIDIGEDTMDPRETVSGDNRGNMVPRVPLKFNTPKVEDT

SEQ ID NO: 1020937 - protein, 68 aa, Homo sapiens
TPPHLHWNTDPNINTHHHHQYGDPNPYTHWHTDPNIDTHTPPPATCDPKHHTPTGHTEPLTLSTHRPP

SEQ ID NO: 1020938 - protein, 244 aa, Homo sapiens
DPHMESLSQAKPVARHKAAKPPATATVTPQTPPFTVVGIEYRGGERFLSVAPPGSTQLNQIYLIRPGDAVAGTAWRLNALDGRSARFDVAGTSQTVTVRNRTSFMHSPTTSSKTMKPRNILGFIAGLATFAFAYGCHAASGQLTSISNTQNSEVHNSSQGASQTELAREWGLTPQEWSRFQTVMEGPRGIYSPGLDPLTALGIEAKSEEERRRYAELQVRAERQRIDKELAYQRAYDQAFARLY

SEQ ID NO: 1020939 - protein, 105 aa, Homo sapiens
LEYPPILACSGREVQQKTDRLLKVELRLKDCLAEKAQEERAAQSGACCNSHETIASLRVQSPPVRYVIKTVEVESSKTKQALSESQARSPAPAGPGWLSKSPGCL

SEQ ID NO: 1020940 - protein, 177 aa, Homo sapiens
SRLVGPEIDVILKFRDKIEKMEKDVYAVLQLEAEEKEMQQSEAQISTAKRLLEKGKEAVVQEPERSWFQTKEERKKEKIAKALQEFDLALRGKTEKEEVYEGCQKTRGTMTAAGTGLSLETPQGARMLSLTRLRERSESPAAKRARANARGSEASEQVLAKQAKTQGNANLVFALTE

SEQ ID NO: 1020941 - protein, 136 aa, Homo sapiens
LLHVPPQSNQLRAASSFNFSSTCFLLPFTMRHHMAICPGKSRHATQHSISQKFNWCHASVIIRHLLRITGHSFDPSRDTEVQEYQLCHETATQPPHRTQSLMAMAHDASTELQKLAAHDRILHSCTWTHVLTLVPL

SEQ ID NO: 1020942 - protein, 242 aa, Homo sapiens
FLKGDIVRKLVTKGCIVLKNRQRFPSSGGVARRILLATQNVRQLRYKSGMVLAVSALLFHYSSLVSLLFIWASWSRWLKTSNVLVVPFVVCALVFLLSLNGDYFLAKLLSYQDSESPNPLSGLSKVGVLLLFVAALFFSKLPNAEKTKLIVLGAGFTISFWLVSAVSYAGSRFLDLISFAFPVAILLTYSRLALKFDTTIKLAFIMAGVLSAASGYRNFVAEEGIGPSPFMPYHFIGFPYGD

SEQ ID NO: 1020943 - protein, 212 aa, Homo sapiens
MSPSFCPHKRSLILRIVLGMVLAVSALLFHYSSLVSLLFIWASWSRWLKTSNVLVVPFVVCALVFLLSLNGDYFLAKLLSYQDSESPNPLSGLSKVGVLLLFVAALFFSKLPNAEKTKLIVLGAGFTISFWLVSAVSYAGSRFLDLISFAFPVAILLTYSRLALKFDTTIKLAFIMAGVLSAASGYRNFVAEEGIGPSPFMPYHFIGFPYGD

SEQ ID NO: 1020944 - protein, 58 aa, Homo sapiens
CCFSDLRIPAASGINDGAIRPEAESPGSAGRQRGPSEQGPMRPGELVDTAGVHLMPLA

SEQ ID NO: 1020945 - protein, 56 aa, Homo sapiens
SSVLPFGVFALLGSLLFWGLCSFGVFAQSAQEVAAGSGKFLFTLSKDPKRAKTQKE

SEQ ID NO: 1020946 - protein, 107 aa, Homo sapiens
IHRVCQENRLLPLPPTASGRLPSGLLAFSQRVVAGEQVAVVRNVIGEQRPQALDVVAPVAVQLTGQAKPGHQLRAVGRHAGPGGLLGQFVESAGGVGDHKHFKAFGQ

SEQ ID NO: 1020947 - protein, 196 aa, Homo sapiens
QTTSFYSRSDKDAVELQVYQRSELRQERKTQKRPRAVMMKNHHQKRHAHNQTVKPKQKKGIAVKKMAAKTAVKMEPVEIDEEEEDDPRPAKKSKVAPKKASPKPTPPAQETEPSDVEDEEPSKRKTGPKRAKTAAQSTKTAEITPDAGSRRRESKRLMILSQKAESEEEEEKPEVAAKARAKVHSTLKATGTAKHI

SEQ ID NO: 1020948 - protein, 74 aa, Homo sapiens
ALAALMNDYLTHQSGRSKAFFIPQSRRVKGNNSEIIPSKVPGGKSHHMLSPAVLWTVLNGALFLYTGRSLDAAS

SEQ ID NO: 1020949 - protein, 80 aa, Homo sapiens
MLNCSRWWQVVDQRAVELGFAVLVETDGGVQLGNVLARQDALEKADEFRWHGYIDHEIGTGEREDDRHVGFVSDQSIDLD

SEQ ID NO: 1020950 - protein, 102 aa, Homo sapiens
RCTAFQTISLHWETPKRMRALQVSALTLKVRLSSISRYTPSSAIRAPVHTQAEQVKKTTSTSRTPALNRLPITHNEEMPTQKANFFHWHETCLSVLTYTGKF

SEQ ID NO: 1020951 - protein, 181 aa, Homo sapiens
TRIVLGPAQWMGRLLNHTVVTDVTLAGEQGGQLNPLIKMKNLGDTLMGTAEVAVATYGGLKALERVTDGNSAVGLTTKFVNFFSGGWDAGKGLLDAMSPFIIMAIFALFLLGATLSIYLPMTPFIIWFGAAINWLVVVGEAIIAAPLWAFTHLGGEGDGMGQRTAHGYLFLLNCLFRWGIL

SEQ ID NO: 1020952 - protein, 226 aa, Homo sapiens
IRRFIGWRPCVVNLYQGAMDAYAVQKSTNTNANPLGDKWSSGHSGTSKVMSHLFAPMQKITTSLVTDVNFNGEQGGQLNPLIKMKNLGDTLMGTAEVAVATYGGLKALERVTDGNSAVGLTTKFVNFFSGGWDAGKGLLDAMSPFIIMAIFALFLLGATLSIYLPMTPFIIWFGAAINWLVVVGEAIIAAPLWAFTHLGGEGDGMGQRTAHGYLFLLNCLFRWGIL

SEQ ID NO: 1020953 - protein, 101 aa, Homo sapiens
DLCLICTPNSSQFQAVTLCLRLAHSRSSPLSQSCVEIGCSASRSSQCLSSGLVFRSLFVASAFRREFLGILFSEDWMLPLYLKVILSGYKILGSHIFPCVS

SEQ ID NO: 1020954 - protein, 164 aa, Homo sapiens
MLISVQLLRALAAWVVVGHHVMQLFFNFEAHNAFEDLLVEKGGAGVDVFFVISGLVIFLASADKALTPWRFMLMRVARIAPAYWFYTVLLAVLVTVMPWMFPDVQLELGHALLSMLFIPAQNPAGYGVYPLLDVGWTLNFEMLFYCLFAVALLVLSGSVTDPLG

SEQ ID NO: 1020955 - protein, 163 aa, Homo sapiens
CCYPFTATRGGRAGREPTNSPNDPPYWTPGSPLLPAISHHHGTPSNSRPELPFTPSSPPRLSLINVTSTHQPLPSIPRTPPLAPDPAPAGHRNHHYSSRLITLRPPPGPTRPPREPTSPHLSPAPNGQPRPRTDLHHAMPPQSPALEVVHHSLPPSIQQQPFA

SEQ ID NO: 1020956 - protein, 69 aa, Homo sapiens
MTWRTREKVESSDLDPSNVDLTQSGDCVLSTKKIVHCKTERVKGSRIILERLKAFLFSLRPSLYRMESH

SEQ ID NO: 1020957 - protein, 46 aa, Homo sapiens
MSHYHPMLCHCGGLDIALSDSKVHGGHDATQAKSQEHACSCLPVKF

SEQ ID NO: 1020958 - protein, 179 aa, Homo sapiens
MVHARTHPSPLFHPHALSRAVLQNPHPQTYPDRSKGQTHRPGFSVDPAHQALFANLHVAGSRRTEKGSLKHQHVTSPQAAQLVHGQPQVPKRYVNRQPKLRRHLAQPWIATAPPCIAPESSRQTATDSPPRERPQASRRVDNQSSWGERLAANAGPKQSLHLKSQMMLEQLPEPVRIIP

SEQ ID NO: 1020959 - protein, 56 aa, Homo sapiens
MIILLMGVNHEKYDNSLKIISSASLHHHTCLDTPVASVHPVTTFGICGRELMTQQS

SEQ ID NO: 1020960 - protein, 97 aa, Homo sapiens
MTTSNQSGGEPKFFSPSNLLPLAPKYSQISMAHFTASSRIVCISGQPGIGANTDMSSPPSFPEQVKAALANVDKCLAAAGASKQNIVRNTQYMVPHG

SEQ ID NO: 1020961 - protein, 64 aa, Homo sapiens
MESTYVVGSTSKYGPMNGNWIAANGGAIHGFLFSGRLTIGKQFKQNGDILATLRSSGRTGPDTW

SEQ ID NO: 1020962 - protein, 80 aa, Homo sapiens
MSQVVDAGTARRVSGSFKLPDGTLLTMGGKTGTGDNRIESFGAGGRLIGSRSLNRTATFVFFLGDNHFGTFDGVHLMPLA

SEQ ID NO: 1020963 - protein, 91 aa, Homo sapiens
SVEVVLAGVGQVGTTTLYPTAVISPGNDGSPIGTLTVNGNLTFGESTIYRVHADPASTASDRIHVTGVAYLDGSVAHVGPEGNYAPRTSGY

SEQ ID NO: 1020964 - protein, 87 aa, Homo sapiens
ARFPSYSTPNFPALMTLPLVFVEHRQLGGAAAKGARVNYLRNLWVDQVRPLPGIEVLTSDDPRLYCGITAFKFIGRDQQMMVETLCR

SEQ ID NO: 1020965 - protein, 53 aa, Homo sapiens
PQQLYVIDSSTRVQSVETKVTKWSETQAPRGRGTPARGSSLKAQGRLEEPCVG

SEQ ID NO: 1020966 - protein, 120 aa, Homo sapiens
ARPDGPCPQCIRLMPPSEVKWSECFSFHILLVFFHKYNFHLLNIFKDSPCYTQRNPNSPSGPQSSQTLFASGSKLASASEKGTVIRVFSVPDGQKLYEFRRGMKRYVTLSSLVFSMDSQL

SEQ ID NO: 1020967 - protein, 144 aa, Homo sapiens
ARPDGPCPQCIRLMPPSEVKWSECFSFHILLVFFHKYNFHLLNIFKDSPCYTQRNPNSPSGPQSSQTLFALFCLHAFPWVILFSNITLCIILGSPEKEQRDRGRDIHIERDRLICCKGWLTWLWKLRSPGVCSQQAGDPGQPMI

SEQ ID NO: 1020968 - protein, 169 aa, Homo sapiens
LVHAGLEDLDFFPNMWIDLEDLDLVEDVDLFWKTLTDWKTWISFWKTLIDWKTWISFWKTLMTGRSRFFLEELDLLEDLDLVEDTDFSGRHGGHVEDVDFLEDMACLEDVDWQEDPNDPEELDCWEDAGFSGRLGGYWKTWIFWKTWIFWKTWIFRKTYMLEDLEPTVD

SEQ ID NO: 1020969 - protein, 66 aa, Homo sapiens
LVHAGLEDLDFFPNMWIDLEDLDLVEDVDLFWKTLTDWKTWISFWKTLIDWKTWISFWKTLIDWKI

SEQ ID NO: 1020970 - protein, 93 aa, Homo sapiens
FKIHLELCQTQVRWGGRSSTKSKMAASRRLMKELEEIRKCGMKNFRNIQVDEANLLTWQGLIVPDNPPYDKGAFRIEINFPAEYPFKPPKITL

SEQ ID NO: 1020971 - protein, 58 aa, Homo sapiens
ESTRQPGWQRCRLVPFFSFLPWKAALPGDLLLALRDVQMGTINKGTLPFLSSSQSALP

SEQ ID NO: 1020972 - protein, 32 aa, Homo sapiens
MREAVHRCASFMDCARIQVVLCSCVLCIVCAV

SEQ ID NO: 1020973 - protein, 59 aa, Homo sapiens
SAAHMPPEKGKEHARFVDRQVFLHFGHLCLHLCNKRIGAVLHVEDLAQVAQVLLRVAWY

SEQ ID NO: 1020974 - protein, 56 aa, Homo sapiens
ELPEHQVIGVFIFNEEYALVTDSQLISEELDANCGGSGTILAVFHSIYGKSVEGSL

SEQ ID NO: 1020975 - protein, 54 aa, Homo sapiens
IGHRSSHNNKRDGPMQNSTQAANAWRILFLLFLANLFNFFDRTIPAIIIEPERP

SEQ ID NO: 1020976 - protein, 119 aa, Homo sapiens
SGTSTVVGVAVGWGEDRAQISRGACRRRALILGRRSSGCVPGRCAFIDVFIPSSGTGDYCGSFESNLAMGLLQICGGHDVFFDGGDRRRIDDGGRWRLLAIWGITGSRVLNEIYVFLRG

SEQ ID NO: 1020977 - protein, 185 aa, Homo sapiens
VNTICIWHCYELDSAVLEFAGFLQRRRSGCYRRSCGNDTQLWLFYPAIAAKKGMMPLSQSTTARTLKHTRAITIEAFSRDDGLWDFDARITDHKERDIQLASGTRPQGVALHDLTLRVTVDLQMNVVGVAACSDAVPYPGYCESIDPDYKKLIGLNLMRQFRQGVKDRMSGIQACTHLTELAQIM

SEQ ID NO: 1020978 - protein, 44 aa, Homo sapiens
GTQRKARTCWSLCFKRPVDGDRDKQASGDAVLTPWQHWTLRAHN

SEQ ID NO: 1020979 - protein, 174 aa, Homo sapiens
MSFPDFFFLSLSVLLGRIVRYLMRSREIILVSATKDNLDVMWTCLWRVRPGRYPGKQGVIKLKYNGDFFIANEGRRPIYIDGRPVLCGSKWRLSYNSVVEIASLRFCLPYQPGPSIALIRAEAAKIHHSDGVVAGLSGPSPACFPCHSSPLELGTQAQWKNLGRWEAQHAGQLI

SEQ ID NO: 1020980 - protein, 124 aa, Homo sapiens
MSFPDFFFLSLSVLLGRIVRYLMRSREIILVSATKDNLDVMWTCLWRVRPGRYPGKQGVIKLKYNGDFFIANEGRRPIYIDGRPVLCGSKWRLSYNSVVEIASLRPDEGNEVLVDKEDDSGILY

SEQ ID NO: 1020981 - protein, 132 aa, Homo sapiens
KQLIHDPGQEPGLRAWWLLSVIPVLWEARQVDHLRSGVRDQPGQHGETPYLPKIQKLIGRGGTGHTVPATWEAEAGESPELGGRGLQRAEIAPLHSSLGDRARLCLRKKKQWLEWPYGYLPDLRGKAFSCPP

SEQ ID NO: 1020982 - protein, 64 aa, Homo sapiens
SDRPKVPLKLIDDPIGAKTISSYPALKHKPASLQVKGFVSSSNARLCQTSLQFISIYLPILSSY

SEQ ID NO: 1020983 - protein, 51 aa, Homo sapiens
MIRIELGTLIRGNVQKNSDRISACSSSIKDMGQHSHNTELVLLTRPLGPYR

SEQ ID NO: 1020984 - protein, 321 aa, Homo sapiens
MRLKKTEREQLRLKYRWPLSLCEELCLMGNRWHEDQLEPIIRQVDKPTERPENHRLDNMMPACAPCNRSKGRQELEGWRNWLAGHVNSLNEYHGIYRMAKAFGLVVETAAPVVFYFEKCQAGLRMKALTIRQPWAWLIVHAGKNVENRSWRSHYRGRFLVHAAKGMTRREYEEAKAWSCACGAIEIPAFGELDRGGVIGSVELVDVLDHSDSPWFMGPKAFLLRDPQPLPFVPLKGRLGFFEDQPLMTEIDELQEERRLCSICDDPMIEGQAFHGIRQAHWDCAQQAPAETPAQGFICSCGNRGRGCYGGSPAYSLTPTPI

SEQ ID NO: 1020985 - protein, 69 aa, Homo sapiens
PHSTEKASTLPIGMELGNVEPKEIARTPVCLEQEEYVESRSGYADQHHLVIYSASIDEALSMLPFSGGV

SEQ ID NO: 1020986 - protein, 54 aa, Homo sapiens
NNKKQHAHTLLGLALLGGLMTTGKCAGGRLLHANLRCAWLGARVWWRFIVQERP

SEQ ID NO: 1020987 - protein, 153 aa, Homo sapiens
WLTLVGSLLLQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQLAPELAAR

SEQ ID NO: 1020988 - protein, 74 aa, Homo sapiens
VLVPELSPSPRPPNCLASLLPPPSSASCFCRLRPYHPERARSRLISEAKQECEDSLGELLLTKNIAIIVGQKQE

SEQ ID NO: 1020989 - protein, 56 aa, Homo sapiens
MAASCFSASCFCRLRPYHPERARSRLISEAKQECEDSLGELLLTKNIAIIVGQKQE

SEQ ID NO: 1020990 - protein, 100 aa, Homo sapiens
CVCQFSLPGMQLHLLKVFPGSPTADHFPPHLHSLFPLYFIFLQITSTILPSASCFCRLRPYHPERARSRLISEAKQECEDSLGELLLTKNIAIIVGQKQE

SEQ ID NO: 1020991 - protein, 43 aa, Homo sapiens
TPPEKVSFHKQTTTQENDHHQLVTCAHLPTPVSHQGTPSPVAW

SEQ ID NO: 1020992 - protein, 38 aa, Homo sapiens
VGPCILYGEAWLMGQDSALSTAFSLTLTGQERQREGRD

SEQ ID NO: 1020993 - protein, 64 aa, Homo sapiens
AAPMLHSRFIARTPLFREEIGAFTTSEFAFWTNCNEPFFTISWITRGASSADGTRCAGLAGGRE

SEQ ID NO: 1020994 - protein, 131 aa, Homo sapiens
IPVRVSSKGTLIPCAGERRQTTPKQVTRRRRLMRCWIPGPSLAVSLVSAVSICVCLCLSLCLSRSACLSLSVSLSVCLSLSVCLSLSLSFSLCLFLSVCLCLSAFLSPSLSLCVSFCLSVSVCLPFSLPLF

SEQ ID NO: 1020995 - protein, 30 aa, Homo sapiens
MGEDCAHLLPSVFFSSHYICPGSSISINPF

SEQ ID NO: 1020996 - protein, 122 aa, Homo sapiens
LPDRTLLVVCGNEQVRFRNTPWGRLCRQLVAQFTAFALRGGDPQRSLVQHIGQEHLAGVLHQGDELTCGRRNGGSHRHGVSMIVADGEQHAAGQAHTELDPIDSATPGRDHGQAIVDIGVAR

SEQ ID NO: 1020997 - protein, 95 aa, Homo sapiens
NHSVPCSSVMLILLHDLRSESGADNLSAADDRFAGSTGPLRQDSDFLCGGKCADIAIRIGGANPQVILTGCWSRDLQFCLIQFFGEVQRMEGWIG

SEQ ID NO: 1020998 - protein, 57 aa, Homo sapiens
WRETLYPNASLLSRTVTQNDTGFYTLQVIESDLVNEEATGQFHVYPELPKPSISSNN

SEQ ID NO: 1020999 - protein, 36 aa, Homo sapiens
MDEVVAGLDGEVVASPSGRSCCATTSSIVICGVWMF

SEQ ID NO: 1021000 - protein, 197 aa, Homo sapiens
HIRMSRTQLDACREVFAKWLDFYQVNSAVMRIAPLTAPGLSLGLDRRSHQQTLPDARYLNLTKMLNVNVGVHTNPRAATSHGCKKSCTYLDLHSSNSAQTALNFMVVGADPRPVFQRGPSASVGASLDEAARAQLERWGAEGVEYPLSPGRADSPRRFALLMGALPSSSAREAAGGAYLYCETQTYWGILAATLAWC

SEQ ID NO: 1021001 - protein, 150 aa, Homo sapiens
SYRDIQVTRPYGYALVGCEALIRDFKQYDNGLLGIRVEGGRRFRVREAGVQKDQLLVADVQWLQELPDQPLGEEDADLLALLEALAEHPMVASLDMGGQAEGQQALSNQLAYLLPFNEADKIDLLQLDDPGQRLDAIQLLLDELQGELFT

SEQ ID NO: 1021002 - protein, 124 aa, Homo sapiens
MGQALRKRKPRQSSPDSFPLASRGSAISPPLRDGENYVVLLKTTLPRSQYDYILPQVSFTAVYHKHITIFNPTRKLPEQDIGQRSYHCLPLTLAVLLGRYHHDKLISLLLQLTSRLQAVRFLAQ

SEQ ID NO: 1021003 - protein, 192 aa, Homo sapiens
QPMAIHDHIWHLLRTGERQPDFISQLRVQHTSGHRHHLIAVLTLNQEVPSTAPSFWICVTSDPLISPNGKPIMTMTCSNTAFGLIALLLIFGNQAKADGMVPDTSVVIVHEADGEASVSVTNSDSQLSLLHVTLQDIPEDTEPLLVVTPPLSRVDASTSQLVRFIQQNQKPLLTQRLKRTVYEGMPQDRAEF

SEQ ID NO: 1021004 - protein, 184 aa, Homo sapiens
MLTTECTIRPGEQLHVGMDFNISRMAATVHVIRDGLPLLLEEATHLFDTPAMIVELKRRFSGHSITVYPDASGKNRKSVNGSESDHSLLRAAGFMVMANPSNPAVRDRVLAVNAMFLNIDHKRRYLVNTDNCPVTTQVLEQQAYTENGEPNKDGTEDPVDALGYFIVQRFPIAGSYTLANVSNS

SEQ ID NO: 1021005 - protein, 332 aa, Homo sapiens
YRIPGSRSNASVHATCSSSLDITVLLKPRPSCCAHRPPGYLRRGDNPHVQVRHLHLPINVQLKNVCKGYQPTKRGIRRVPAIHQDDAVRWLRGQYVLSNPAAAVGKALTHLKFQIPAGISGERVNQSHRLRSTGIALARAQSHDLYVVGPQRCRNGLQQRGFTGAFGAIHRNKQRTSHTERCIIVQVVQFHGASGSVRLGELASIMGNPIAQCEAGLADVPSPRRQSVIQHPAFRHTSLIPQRPWRNQPLRGLAGFAFKHEVAAFLGKLLAVFHHVESHLSQLLLTTAFNLLSIQHGFSRACVKVLIIGRRHGQPLAKATGRMFDRRYGDHS

SEQ ID NO: 1021006 - protein, 72 aa, Homo sapiens
GEAAVQFLCKETDKEGVFMNLMALIRMFTIRFRMEGAIGVVLLLLGLLGGVGMWSMLRIYDLHQDFIQVHLA

SEQ ID NO: 1021007 - protein, 51 aa, Homo sapiens
LSHARSGILTISSISASLHAASLTSSTAPAPLSCSAARYSPIAAAPFSGGV

SEQ ID NO: 1021008 - protein, 54 aa, Homo sapiens
IGWAQIRCNSLRQCLILNLLIKTRIKPLSFWTLCCILNLLSHNGKSMLQLLVTE

SEQ ID NO: 1021009 - protein, 143 aa, Homo sapiens
RLLLSRARSSRSVSSTPIWNPTASPPRSSQVLIIMAQFGVDTPAELCRNLSLDSGSMTRMLDRLEQKDLLSRKRSELDRRQVQLVLTAEGQRLADMLPHIGAKALNQLAGVLEPGELETLERILKKMLIAAGDPITIQRVGSS

SEQ ID NO: 1021010 - protein, 148 aa, Homo sapiens
NFKSGYLSENVLVALGSLIAEPYSIKHEGPKLVNDLVPNLGGSRQSISWQRYRYLELDLHTENAFQAYDSRGDTCRWLFCFSAFAVTLPGLGPKTWVADAREALQVLEQADIEILYGKHFIIRQPYRWRNSAAGAKETHVYPILSGPL

SEQ ID NO: 1021011 - protein, 208 aa, Homo sapiens
DSIARRQAFQAARGKIGRFLQRKGKHRTDWSMRWASLHRQEIHQQQALCVIEANAPVALIKDLGQQVQTRDDLAELNGKAEVTALLWYLVGKQQQHAIGILTLTEQPGGLFDIARGIADKLRVDRVGHIKLRTPAVSGHEHAANRVDERADAVAAKVRAQGITQGSQVTTISQCGQGTAIFDGLTDLPGGGHCIRIPRLTPLENDPGI

SEQ ID NO: 1021012 - protein, 63 aa, Homo sapiens
CRAGARGLRYLSWRKKTPRPSTLPKITLSSQTVCVDSRPPCISKGKGDKHANFDSRRRHIATW

SEQ ID NO: 1021013 - protein, 76 aa, Homo sapiens
DGQNTTHTEKNEKACITGPNKCSANAVSGDREPLNQDQARPKSGEVRASRATSVLGFGSLMWHPCEAEERVPKRLL

SEQ ID NO: 1021014 - protein, 82 aa, Homo sapiens
LVEVAQGLFGELAFGLVDHKDVETIHRAVTAKPRQVLHQRMAGAAIAMRRHRHEAARLALERGGDLVCAPGIHLVAEHFAMS

SEQ ID NO: 1021015 - protein, 65 aa, Homo sapiens
SYRKAFRRSSSTTSMPCRRPVALTSSNGGSRHSIHRNSSRALHRNMPSFGRNRLFRTDAHLACPD

SEQ ID NO: 1021016 - protein, 223 aa, Homo sapiens
MVIKPRRIPLLARITQRAITLFARITLLREGRRTKRMIRLASDDPRFTVQFQRTRAQMIAKGVTVLIIRQLLRRRAFPMQHLHRGAAGLDGDDVQFLAIPIARFQPWYISGLTDQGAGVGLRRAHLALAHAVGTVDVALGVIEAQRALHHMHMAQLVTCIPTQCSAAVQHQQVAVGIEASESQLRSVASRPPRAGSDYCACRRLHTPMLLWPWWISSSNAASS

SEQ ID NO: 1021017 - protein, 105 aa, Homo sapiens
MQRTMQVHCSENDQRQEWSCCSRRHVGILGMLKIPSEEENRSLKADLQKLKDELASTKQKLEKAENQVLAMRKQSEGLTKEYDRLLEEHAKLQAAVDGPMDKKEE

SEQ ID NO: 1021018 - protein, 41 aa, Homo sapiens
TGYDSAQYQIGGQCIAGADQTLTVLQAFLFHNRIEHIGPYR

SEQ ID NO: 1021019 - protein, 46 aa, Homo sapiens
MRILLPSDVPPPDTVPFSLNAVTEQLVSCFFSRSTSFFKNLLEKTA

SEQ ID NO: 1021020 - protein, 193 aa, Homo sapiens
RWLAAPMLVTIFLAHYLLVPAAGQSSVKVFDVAFQLRDNPRDISGLVLVETILGLNDNSCMPECLQRGSSFVLYLQLMDKVKCVPTVQWGYEICYDIQKARLNQAKPRALLNDDDPINEETLWHDSKEMIYSMHGMPRVFLYGLVKMTCYYIKTLTKQFGRDKMPLMDVATTPYDVPITLKMFNGYPSLWNNA

SEQ ID NO: 1021021 - protein, 91 aa, Homo sapiens
AASVLVVPSGQGRLSCKERCGTRRLVCSGQISTVESDTPLRRSDRCVQFGNGWGVRALSLSTERTATVLVFLKPERLGAPAWPSAHAQARD

SEQ ID NO: 1021022 - protein, 41 aa, Homo sapiens
MPLWIETGGELVTRMEHETIVDVHQLARLNVQRPRYAFKRV

SEQ ID NO: 1021023 - protein, 103 aa, Homo sapiens
MLRVLLSALASVELIATTRVAAAPKSRRIFIVLPRKCCARRMPSDVNLLLCGAPRPLHAHQSRGCLVSGGLTLRSSTCCHKRPALTATSGKQETTSHRQQDDL

SEQ ID NO: 1021024 - protein, 225 aa, Homo sapiens
DVCLAQRRGWRRSEKPPMYKQVFCASADLARSRRATASADSLKRRISCCAPRWRFKGVTSLSPQWRLLLMPDVIENIDNLNPENSQRIITSRQRTRHRQTNKHQVRDQPSLRRSIPDQVGIASSEEDREILPPIASRQLELSQHETSKHERTTTLDGLYGRATWRETLQRPLSGRVVVAYLASMGSQLITHKRHTRKNKTTSGSYPLVGSVTKKQVSVHQITYAL

SEQ ID NO: 1021025 - protein, 247 aa, Homo sapiens
QYEMEGGKNFPALTAGPESRRLIKPTVTAVTPPADGVILSGGKTDARDCINFTHEEMAKKLGRAFTWPLLNVESGQTFKVTWAYTAPHTTRGYRWLITKDGWDPKQRITRAQLEAQPFAEDFYAQVPYYSHAGELKAKVDHEVKLPTHKKGQHVIVLMWIVANTGNAFYQAFDVDFKEARAVKPTRSEGLEHVKIDFTSLQSPLNDAASPMPSIAGKKILMGFWHNWPAGPSDGYQRGQFANISLVD

SEQ ID NO: 1021026 - protein, 182 aa, Homo sapiens
MAIPITVLDCDLLLYGRGHRTLDRFKLDDVTDEYLMSMYGFPRQFIYYLVELLGANLSRPTQRSRAISPETQVLAALGFYTSGSFQTRMGDAIGISQASMSRCVANVTEALVERASQFIRFPADEASIQALKDEFYGLAGMPGVMGVVDCIHVAIKAPNAEDLSYVNRKGLHSLNCLMVCDH

SEQ ID NO: 1021027 - protein, 59 aa, Homo sapiens
SRSLFLRFCFLLLPLPASCFCRFLLLPCKLAASCFCRFLLLLPASAIHVRCDLLLLTFH

SEQ ID NO: 1021028 - protein, 51 aa, Homo sapiens
PSTSLIDGQKQEAAEAGRAEAGSASCFCRFLLLLPASATHVRCDLLLLTFH

SEQ ID NO: 1021029 - protein, 169 aa, Homo sapiens
KPPPPGVVMGPSDYTLLVAVGLGGPGARRRLIFSLLCHPRWGGREVSDSSFSLALLFPKPPWPQYKCGELSASSPEFCLKSGPPALVWGTMGHDVVTTQSCLGPGAPKAGATSGYRGHGVPSQFEEGPLFACVPAVPVPVPECGEVSPPEFLCRALPSVPVLAPSAPHA

SEQ ID NO: 1021030 - protein, 51 aa, Homo sapiens
RVAEHFIPPRSKAAVRSMLQFEDVAVVGLPAESGNESVVAAILPRQGRPVT

SEQ ID NO: 1021031 - protein, 137 aa, Homo sapiens
VEHRMCTIKSHACANAWMTFWRIEAKSRSASASVWLPIGTTLPVSKDNAGHNRSIRFSGRQDGSNGKWTGRQYYGPFIDTAHRFGMVELFRRWLGVSDDEIRIQTVSRYLNLVSRSGLCYLLNFSLMRVEEAGTCVD

SEQ ID NO: 1021032 - protein, 96 aa, Homo sapiens
VVDGRENGCWIILAEFLEEPLGCALIHTPSLGDLRQRPIDVAAQRIIGELQLSVEHISYRFAFKHRVVVLPVLLLVLRVEFTPELLAKRSSSNKPL

SEQ ID NO: 1021033 - protein, 47 aa, Homo sapiens
LPARELTLDLRSAAGIMEIKRRGQSVIGYPALVDRGAHCDLDVFDDP

SEQ ID NO: 1021034 - protein, 113 aa, Homo sapiens
TDIEAGAVAEAATLWKADAEGDLGFRERLVDRLKKGKRTDVWSNRLKPYPLTGGPTSAARSLDQPQRCNSWELRNCRDGDSFILLFFFTFLLVYKYRAIEGYRKDKFLCSIML

SEQ ID NO: 1021035 - protein, 50 aa, Homo sapiens
MLDVTQNVMFRKVLNPQSRSILQGPGYRKVPVDNNRVHCHDDQHNHGRGF

SEQ ID NO: 1021036 - protein, 52 aa, Homo sapiens
HGGPPRTEKVIPFPCLVIASARSLLTVDHNNFYRLSNCKLALVSNSSFSGGV

SEQ ID NO: 1021037 - protein, 35 aa, Homo sapiens
EQVAASVSCLFQLQSIHCYLVNSTSRGISIPRSLT

SEQ ID NO: 1021038 - protein, 131 aa, Homo sapiens
DSCSSWEMPSSSDSPDSSLMKLEGNIPVFPLRTPSHHPSSTFSTGRKSFSTSIDLGLSLIGLSLKMSPKPTPLTFLGWIAAVATVPLAPSDLVLLESPPSLSEPVVSLKLILDSCSSWEMPSSESDGRCIL

SEQ ID NO: 1021039 - protein, 182 aa, Homo sapiens
DSCSSWEMPSSSDSPDSSLMKLEGNIPVFPLRTPSHHPSSTFSTGRKSFSTSIDLGLSLIGLSLKMSPKPTPLTFLGWIAAVATVPLAPSDLVLLESPPSLSEPVVSLKLILDSCSSWEMPSSFVSPDSSLMKLEGNIPVFPLRTPSLLSFLYLSSQLYDVANFQLKFIVTLGQVAECHLAK

SEQ ID NO: 1021040 - protein, 113 aa, Homo sapiens
MPGADISRGPIIMKKTKTRGGEKVGGRLWNWRPWSPNKNTGELRDPKKASPQRWASGQEIATTEGGALTQQSYVSQKEPHNGSGNSRKYNNTKCFTNTQETQGHSRGHNSTHA

SEQ ID NO: 1021041 - protein, 147 aa, Homo sapiens
GDLAGSLTRVISPWGVSSNTDTGLGLGLRRHCPVASAHTLAQAIRARIKMKAMHAGSKRLKGMGEIKSRPQLGVSAAYNLGGVIIGATLEHALEEDKHKETGKAFTHLELSLGTNLYEGRYGSVDAAINSHFGDRNYLQTWYGVTAD

SEQ ID NO: 1021042 - protein, 74 aa, Homo sapiens
ELGTTTPPEKVPDRDVFGRDQRIPDRRVVLALILRAGPRTADGAALGRLPFPVLAREDIAGWSISLIGLLRWLG

SEQ ID NO: 1021043 - protein, 35 aa, Homo sapiens
CASHRRMQTCPRCQPFPRSGPILLVTWPSGCIPTE

SEQ ID NO: 1021044 - protein, 51 aa, Homo sapiens
PRYEMETWKISSNGHGDWSRGTLTNQVSRVYNDIGGFRICHHRTISQQRFL

SEQ ID NO: 1021045 - protein, 82 aa, Homo sapiens
ADLPRGAPFDLQVLETFGVSPQLAARYVESGWLVRIGHGIYAFPNDNFDVTGALRFLQQRVAGLHVGGKSALATQGVRDTLS

SEQ ID NO: 1021046 - protein, 83 aa, Homo sapiens
PPRQSSSCASSRPSGQRTSARRLGEVTLERVRPSAPGLSLRVTQVGREARAAGSSTAQSPEVLHGFEQQHAVVLEQDLPRCQR

SEQ ID NO: 1021047 - protein, 56 aa, Homo sapiens
YRVDTLATIRLALAGLLALAALPALALEPFVASYQAWHEGQQLGTATLQAKPTGGN

SEQ ID NO: 1021048 - protein, 207 aa, Homo sapiens
DLERSVTHSADRKVPLFMPLRGKLTGAGITANGIYTVVTCYTAEKGPGLRSTAWGSMDSEATAATNALEHEADIAKARIGLGHANISTTKIYDRRQNRPEDSPTYKVRVLENHDDSEAPLGYRDSVRACASTSLLMIVLRCRLIQRSVKLIRRDGFPSGTKNPPIGGGMSKTGRLYRSGPEALEAKRRARQKLEPYRLLSHTDIPSV

SEQ ID NO: 1021049 - protein, 46 aa, Homo sapiens
VFHQSHSQHGIRATSATYTTAHGTAWILNPLSKASDRTRTHIVQRL

SEQ ID NO: 1021050 - protein, 124 aa, Homo sapiens
MQDATQKLRIEALLKLHGANTAQVWESIDRNKGSVQHLPFLSTVERACYKTRDELNPLLALKAIETKDIDRQLMAMRYLLLGLMQDCPEYKVALQVLEEAAPSVVALSNVQHAIWTCLATRPVS

SEQ ID NO: 1021051 - protein, 134 aa, Homo sapiens
MAAHCATCKVDHRRRVVLTVDAVDHWRLDAGGRGIVIGGQAQIIVAARASGAVLAIQGEGLQGVQIEYVGNACAGLSRNGRGSGGTVGLTVVIERALVDDICLFFQVAGLVEVQLVPACGGDAGGSGHQQGGGK

SEQ ID NO: 1021052 - protein, 79 aa, Homo sapiens
KPVSRIKHTDPAISQRFAPQMKYAFAFLQGARPMLLSALAKTMQLISLKLRYSEQSVHVIVVIPYTLVFPSLTVHSIYA

SEQ ID NO: 1021053 - protein, 127 aa, Homo sapiens
MFTKLVLCRRVRRGLGAKRPSWLREHGCGLGAEGLPAPNPASPRRRTRGQCDSGAGNPQQSSRAHVRHNRGRERCLTQDPSPVCDLHDSSWQHWILNPVSEVRIEPATSWFLVRFVSAAPQWELRKT

SEQ ID NO: 1021054 - protein, 118 aa, Homo sapiens
SRIPCSTNVLDTLDGQSEDYEQARQHLMTIAVFTSEPEFQVKAIGYLQAQLALNEAGVNEELVPFTSKLSPVLEQLPIHAPPPHTSDIADYQQIVEMSDSMIKRLDYAQSRFTFGGPG

SEQ ID NO: 1021055 - protein, 241 aa, Homo sapiens
RKERPQYSAQAKRQAYLDTLDGQSEDYEQARQHLMTIAVFTSEPEFQVKAIGYLQAQLALNEAGVNEELVPFTSKLSPVLEQLPIHAPPPHTSDIADYQQIVEMSDSMIKRLDYAQSRFTELRKFGPAGFDVIRESKRKLPRYMSDDLRALQVTLARHLCLAPESLATEPHAWEMLNDTLDSADVAVQTLRDTLDERSEYRLDERIDALSNLVEQSSSSMSAEGLSQSLERPGTRTPGGGP

SEQ ID NO: 1021056 - protein, 225 aa, Homo sapiens
YRNRSTDAHVAAERRDAVERSMTHRMYGEHRVESTYTSASIPGRYRFRNEFLPGRWRLMENYRAPVEGPNATDVTWHQYEMISRHNNFYGVLPQAIVRWNVQNNEALLATQQQEGMLERFLASEGNGRSTQRIMTAFGLRATGITRQEVYDYQLGADVDIIEVHVEPQPVLEPAPMVRSPSLEALTRAVERDLRRAARNPVSRVCPSMFGETCIESFKVAVPDVP

SEQ ID NO: 1021057 - protein, 45 aa, Homo sapiens
APRGSYAPYLLVFQAIFYSLFHLSFACAQLTMIYILNHYLYDLNH

SEQ ID NO: 1021058 - protein, 71 aa, Homo sapiens
HLRIGARLWSGLALNDPGAFYIFRNGQLTPLGQPNPQINPATIGKTELVYYKARDGLDIPGFLSKPPAEIY

SEQ ID NO: 1021059 - protein, 62 aa, Homo sapiens
ELARGYVYGGQACRQHGGLPGASADQPAWTCACMRVMRHVFVCQCVCRQAHTCVCLCVRHNR

SEQ ID NO: 1021060 - protein, 35 aa, Homo sapiens
MLTPENTLRPKGLTLKPSTLALNGWLTVEWHYKFR

SEQ ID NO: 1021061 - protein, 122 aa, Homo sapiens
MYDSVWPYLFSLLSASQCFCASSLKLLLRMLGMHAAPFRASLAVQHPGLLLLQLPVAERDGPVCPGARKPPVSSGTAARSASRSCRKASYSSRVRLFLSRKVLLELRELDPLPEPEGPRKVK

SEQ ID NO: 1021062 - protein, 111 aa, Homo sapiens
TGPKLIVLYLYDNYSYDPLARVDGTGKHQCVRYYHNDLNGLPEYLTETDGLIVWQARYEAWGAPLEEVREAYFIEEQNLRFQGQYLDRETGLHFNTLRYYDPDVGRFTTPL

SEQ ID NO: 1021063 - protein, 131 aa, Homo sapiens
MAVTKQCRTHETIAFDVRFADGAKFAVVENRVARADHVDVRFNRFIVRHGAFLVLVDRRNGLGDKKKSTLQQRADVTSNNKMAFEQSAVAGHEQDGTLASMKTRKLLCQGLTFSSRLKESGISPAIADIVV

SEQ ID NO: 1021064 - protein, 130 aa, Homo sapiens
RAPCQTPPTSISKHVAVTHGLGIVIGIRNVLTEEISDIAGYRPIVGLGRVGQKDLHISATHPDDDVKLVIDGQHTDSPSITGQTPQLGDELIEVISEHRFHRNCDALTVIVVEGYYKVDLILAGVLEIVV

SEQ ID NO: 1021065 - protein, 96 aa, Homo sapiens
MHSKRLTYGSNRVFDFLVLWILPVGLLLLLSALFFVGNRNVLHRIVYILFSVPTLFLLCMRPREFKDLLREPWHRVPGVLRLGVDQSAPEPAPRDY

SEQ ID NO: 1021066 - protein, 244 aa, Homo sapiens
ARKLIVLMAEQEHGKRQRFLRRYRDHIKKAVEEAVSRRSITDMEHGEQISIPGRDIDEPVLHHGRGGKQTVVHPGNKEFTTGEHIQRPQGGGGGKGPGKAGNSGEGMDEFVFQITQEEFLEFMFEDLELPNLVKRNLTGTDTFKTVRAGISNEGNPSRINIIRTLRSAHARRIALSGSSRAKLKQAKEELARLKREEPDNFGDIQEIEAEIEKLSARIHRVPFLDTFDLKYNLLVKQPNPSSRL

SEQ ID NO: 1021067 - protein, 217 aa, Homo sapiens
MTNDTFLDTSPGRSRYLERTIIALEDRLGLTLMDRFPWINLSKAPGPMQWSSRTRQQLNVSWEPCLWFARDPILCKADNRRVLRPHTERHAKLLSQGGEHRSTSYGDRAYRVRPGSFGGITNGAIPKNTLQIGHSCARGREHRKALTSLGLTQHGAGWPFAVPDFFIKFLTEPGDLVADIFSGRAMTGRAAEENQRRWICVESALQYVRGAAELFRS

SEQ ID NO: 1021068 - protein, 121 aa, Homo sapiens
DTIDYSHQNNRRKNKGIGLVQDVIINQSAPVILLLIFYVVYFFKTNFTPIILESSSLCSSKGRAWYIPTNDLESLFSTPKSREYKLCPNGVLNSYRLINMRAREFIGKPTWLSPWGRLDIS

SEQ ID NO: 1021069 - protein, 130 aa, Homo sapiens
FSVQVYQQYVIAPQVNQSLTSVPPMNPATTLPGLMPLPAGLPNLPNLNLNLPAPHIMPGVGLPELVNPGLPPLPSMPPRNLPGISTSSPGIRIPSGIIPLGPKKSSFCKQGSRESWLGFPFRAQQDKAPF

SEQ ID NO: 1021070 - protein, 129 aa, Homo sapiens
MTSDGYARYSQAKRLRTHRFGKQHPPEFIAVILGAVAVMHGHRDWNTVSAAMSKVPALQQEREPLMVYVTPDTSAAKLRGDVENLLRRAPMVLRFRLDTGIAFEQARFARSVATEVEHAGVKVEFDSPL

SEQ ID NO: 1021071 - protein, 46 aa, Homo sapiens
MYGIHCVQFKSIAPHCMESTAFSRDPLGHAASNPLHSIGIHVRHNR

SEQ ID NO: 1021072 - protein, 203 aa, Homo sapiens
MGFIEEAPMQTWQITFVDDHGETSVQQFTCEQKPSLEDAAHMIRAKLVPIAAKLDLNDLEGRKPEPTVKILKDQNSIQILDISPSVQTFFTRHTSTSGGGDSFTLLCNRDQRMNAKVWSCQLHACFPAVMLCRGARASRARGFRKHGKSIHRCEEDVFMSTAYQEDISTNVLRRMKEGGFDFSRFHPIEFYAISPDEERARRL

SEQ ID NO: 1021073 - protein, 99 aa, Homo sapiens
TRIGVTSTRLGAARTCNAPASRARNARLHTRAIKEISMNDSSASPAKVLVWDMPVRLFHWLMVLCFAGAYLTAETERFRLVHVTLGYTMAGLVALRRCG

SEQ ID NO: 1021074 - protein, 202 aa, Homo sapiens
FTSSSSMRHFTRRQRSVFSAVLQLDPAHTGGQTLEQRAQTCGHIAQPVVEVVGTRIKQRAALVRVRQARFVAAQGIDAFLVFRLTGWQHPTLVIEVEARLGLGQVSVFSRLRLGAGEVFTQGAGKVTHLHQHAVFPARHVVHPQARRETIVGDVAAWLVQQGADHGLEGFDGGVTHHHLLAFLLGGKLGILLHRKQRRLLAP

SEQ ID NO: 1021075 - protein, 113 aa, Homo sapiens
EDYSTEHITPDKNTSLRQVAGVLLERTDHERADIAAEVAHRVDQGNTGRRTGAGKEAPRQCPEHGGAGKHGKRRQAQRGHLQYWHREPGAAEQADGAQHIERGEMAVTVVQTV

SEQ ID NO: 1021076 - protein, 125 aa, Homo sapiens
ACLANIAHGRAPPQPNPGIANVARFAAAAVCGFSASHSCSFVPTAVAVLTIGVDCQGALRLDVGGVEKIYSGGELSLRLVMILELDCGNSFIKWRVLESSDASVRAEGIAGSDIALIDSLVALPG

SEQ ID NO: 1021077 - protein, 125 aa, Homo sapiens
ACLANIAHGRAPPQPNPGIANVARFAAAAVCGFSASHSCSFVPTAVAVLTIGVADIVFVMSCTEIEVLPFSTLRLPSRICSWPCNIPPGSWEFANVSRSPLLSQGSIPLERLSRVCCCGAPVGPT

SEQ ID NO: 1021078 - protein, 108 aa, Homo sapiens
KDQLESNDCYHWVPGSSQVVEPDREKPVEIQAYFYLGFDPAIQTLSMTPSLILRFRGKANESRCSRFNQRQAGENRGWRQSRRVLRRRVSLTLLIDLDPSRHCPCSIR

SEQ ID NO: 1021079 - protein, 178 aa, Homo sapiens
WRDTRCTGFLNRSAERLVSAGAALESSSAAVASMRLSNGMTLKADPLSSISDGAAGVLVIPSLGLDGMLDANGHEPCGLDARYTDGIALRPVGHAGCPASGTLGLPTSTRAGGRVVRQLYGGAGAGGRPGLLDGRRVTSHWGNWGALLCKAFTAGHRLDPGLQWLPEEGRPTTLPANM

SEQ ID NO: 1021080 - protein, 50 aa, Homo sapiens
WENLVNKDVRSRAHPATPCKARSAAPPAPPSDARRTGAMRSCTTLLPLAP

SEQ ID NO: 1021081 - protein, 70 aa, Homo sapiens
MRGNAYRGHDYGGIVSAKASDYDGYYYEEDYYKCMGCDDNVVDVVVTYEVACCPARSYKEAETVLDSNSD

SEQ ID NO: 1021082 - protein, 208 aa, Homo sapiens
GIERYPTVSSGADTSFDSLRIRGFIASNDFHLDGIRDDSQYVRDLHNIERIEVLKGPAAVLYGEAARDGIVDRVSKVASPGQKSSIEAQGGSNDERSLYATVSTDPTDNISLRLNMGNQDNNSFRDGVSGNRQLFAPSMSWQLTPELNWLVQYEYSRYNRTPDRGIPGVNGRSGDVSRSTTYLITAITYDDKSQSLRSRLAYELNAEW

SEQ ID NO: 1021083 - protein, 135 aa, Homo sapiens
MFSASLYENGRVSPAQLALPTERLEGLGAPLNTIGPTGNLSLSWNHLHFSRDNRMLLWPPGNYQLHLDGNRFPPVTNPALRQILYEFPSSVQHYASLNLMTDRPYDAKRAAVTSPMDIFSFPVKPGHSKGRKQNW

SEQ ID NO: 1021084 - protein, 176 aa, Homo sapiens
QCSTEWYRCGAFAKPVKVHPSGYYAWLAEPQSARSKEEPRLLGLIKHAWLESGGVYGYRKIPDDLRELGEECGRNRVGRLIAGGRGCVLKRAIGGVPGFYGGKPTVASPKPPRAAVQGEVSPNKVWVTDITYIRTYKGELYLAVVLDLSSRQVIGWSMKPRMCSDLDIDAMTFRAH

SEQ ID NO: 1021085 - protein, 66 aa, Homo sapiens
MLEDPEAQRRTGRSRHGQLIFGDNVRMKDPKLPDALTPGQMISAHRPGKKAGPSDALITYPSSVLS

SEQ ID NO: 1021086 - protein, 80 aa, Homo sapiens
MNGCGHSCVVRALSENPYCTRRKTTLHTPKCPYPLVTQVCLDEVVAQQLRPRDLRPSMVIRRVQQQLRPSGLEVFGHSAC

SEQ ID NO: 1021087 - protein, 54 aa, Homo sapiens
MTSNWIYTQADPVIGVHRQYASKEIRKGTVFVNASRWSSPETDKLMDAASSEIR

SEQ ID NO: 1021088 - protein, 144 aa, Homo sapiens
MALGPICYVAAESLLWHNQRHDFFDRNLDQSCSPEQFRAMAEGGMQLLFLVDATGKKNHRLKRVLNRDAFPKELTNKKRFMSERAQRKSNSHKLNEIPEAVILQLGKRSDRDLSVECGISAYFLKQKRLAWGIDQFKRGVYRTT

SEQ ID NO: 1021089 - protein, 89 aa, Homo sapiens
QSSPIGFYTLTFVGYQKAVTTDGTKMRLRPISILPASTDILERTIRAAVEQHLFDLQSSIDHDLKNLQQQSVVCNNEAESIHSRWEQDA

SEQ ID NO: 1021090 - protein, 128 aa, Homo sapiens
MPMAIMRIHDLLNLRVWIFCRAAYSETPDNFSSWALAAVPAPQLHMYLSPSRNSLACATVAPPAREQAISIIPTERICILTYPPENKSDFGEDFVTKGPLNCLTAQSDSLDASYQGLSSNSAGIGGHC

SEQ ID NO: 1021091 - protein, 128 aa, Homo sapiens
SEILNYSRYPSIHPIWPKKLATILILRENLHAASETQGSGWGEPYIGYFPSCTAHWADSLKPSKTITWMARDRTGLPNNTMNSAHHAKKTASFQARFYWSNITGGCDSKIPSFPSPGLWIRSGFWLYD

SEQ ID NO: 1021092 - protein, 241 aa, Homo sapiens
ALPRARVSPPGGRKTPRWRLHREHPLGSGCIGTDVRAPQPHTTVALGHAACTPACPLGDTGSLERMSLSGRLGGEKPKMWPKTAKFNLTEPCHGGWGELYLAVCLFRVAQAGTLPTRPTTAPPEGPRWSKPQIHTPHWAQPRSPALANHVIYCLRPCRALGHLAWRLFPHGSQVPPTPGRPFPEPSHGTQPKGPQVHTLLRAVSCASPAPYPRYFVLCLPGSGRGALSCFLSDREINAPEG

SEQ ID NO: 1021093 - protein, 54 aa, Homo sapiens
TLDDPQLRAGDFTPSADVEIMNPDLHIATLEEGGKLYMEVRVDRGVGYVPAERH

SEQ ID NO: 1021094 - protein, 48 aa, Homo sapiens
MVNEQCRARHRALAEHWLAIQLFLDPLKLRLDHRIGVARAGGQVVDVN

SEQ ID NO: 1021095 - protein, 114 aa, Homo sapiens
MESNLSELLNRRLALLGKREHLSLLEQCLHGIEGECLRVTNEGRLAQTPHPEALGAALTSEQITTFFSESLLEFITPALPNPADTLSSLDKIRRFAYTKLGSEYLWSPSNIRCS

SEQ ID NO: 1021096 - protein, 73 aa, Homo sapiens
MTTLLLLTLEDETAARSVWTEVVEISMDEGHNFSIAISLRYLSQSIAFVWYFGVCKNNFVHHDLCHQGVGSPR

SEQ ID NO: 1021097 - protein, 63 aa, Homo sapiens
EHAPLIASGNTSPISDYERRHQRAAVESRFFSGQRGGQAINKCVRPSTLRIHCQRKGPSASVA

SEQ ID NO: 1021098 - protein, 64 aa, Homo sapiens
GSQLETLESLGPDEQGFVVGLAGTPAQQASDIIIALESAVSRLTLRLSGSSRHARASPPASRHK

SEQ ID NO: 1021099 - protein, 315 aa, Homo sapiens
TECSAGRGQELGGQQAARRCLGAEALEQCCLLVGTEAVPDFDHLQGSVEYSGSGVSEGEVVIVKVSDNSGSVESAQRRAFHTVWYGVISAFALDWFCFFGLRLLVAGLLRCWLLSWVQVWEGEIRYLVHRGRSSQGLFFPSQVIPRSQKALAGYSTVNDKKTFISTDAQFLMVQAQVTEVTRLERHLAQDHVAVHHKIPQQAVERVLKGGGAVLIEEEVAYPGKAVACQGQRQQQNQGASADGVRENAYYQGGADKVQASAGAVAMFAQVVRVELGKTVEFLDVFHGHRPSGCCAAHGCAAGSLFESRVISANSQ

SEQ ID NO: 1021100 - protein, 39 aa, Homo sapiens
SGIKWDGGLKNQALVQSASLPEKSKIHQGCYIRATLAST

SEQ ID NO: 1021101 - protein, 115 aa, Homo sapiens
TLRIYKRREDTVNVLTDVLDFDSEDIDGIDNDVGEEQEPPPTGHWTATSSYDIYTGGTPGKENNGDEATERQTPLGKKPKHGHHWHCSKPCHRNTGTGQENNPDGAKEEYNPLCV

SEQ ID NO: 1021102 - protein, 35 aa, Homo sapiens
MTVQTRNHAGQRPKRDTTFKLIKSNATTETRLENQ

SEQ ID NO: 1021103 - protein, 69 aa, Homo sapiens
TTTACSAIETAVNDSSYTINKCIIVDFFSVKYVDTSISYSSFSSKKNFKKDGFDTLTILIILQSKYVFG

SEQ ID NO: 1021104 - protein, 101 aa, Homo sapiens
MSQRMTPAKPQPTLDFHRTGAVQPRPLKRQDSIQRTIGEGQQFLAGDHRHRAAVGNGLVRWRRRIPLRIRRHRRHIIHTLFLRQHYVLPRSPAHRVRSGRG

SEQ ID NO: 1021105 - protein, 201 aa, Homo sapiens
HAVPERVGAKLRTCSGPYMSEVLVVVLAEEDARREGQSSFADVDGIGPACRTISRNQPRLPRTPYRHGDGDEESEQTDTTRNRTACVEDVRRVGIKEEPPFEQAPRVIKPVHLEDRTRANRGVLDSQGSLLSICVAPQTPGDHDADYHSDLAEQNVRPLLDLSSDFSCAGVSLKSVHTGCRRLRNRSGLVPVREPSQDNDR

SEQ ID NO: 1021106 - protein, 76 aa, Homo sapiens
HVVNWTATLVERLRRRYGDRMTIHAGDALAFDFDQLKQPGRPLRIVGNLPYNISSPLLFHLMEFADHRAANNGGSS

SEQ ID NO: 1021107 - protein, 76 aa, Homo sapiens
CVIRDHCHHHAGLVSTVSSANNISLWVEVVGQALQFLLFSWGLVAADHHRGRILPVQDIFAVFQVFPQSRRHSSSR

SEQ ID NO: 1021108 - protein, 108 aa, Homo sapiens
MVRMVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYL

SEQ ID NO: 1021109 - protein, 75 aa, Homo sapiens
CIVQQLRVDQPKEKGEILSMFSSVASLAPTESPALDQLHITQDFNGAPEDSWVEEDYDKCMGCDDNVVDVVVTLK

SEQ ID NO: 1021110 - protein, 82 aa, Homo sapiens
RLQRNFHRVLRERVAMETLTPSELRRPGQPGSCPSHAENCGPEEKIANLGSWNDSQLEFRSFWELIGEAVKSVKLERPVRGH

SEQ ID NO: 1021111 - protein, 100 aa, Homo sapiens
MKFNFIKVDVSDQVARLTLDDADSHNALTEGMQREMMVALESFKERDDVGALIITGSGKAFCSGADLKWLTNQSKSGPCVNPKALQMLDDLANMDVAALL

SEQ ID NO: 1021112 - protein, 119 aa, Homo sapiens
GTGSDATWGLELPKSDLASTLLTPKVAPVDTLGVTRQFALNPAMTRMATLFNTGKAAIQLNVGPLIVPLTRDNYDSTDHKTYPRPPQLFSHNDQQSIWQSSNPEGAKIGWGGNIADVAS

SEQ ID NO: 1021113 - protein, 177 aa, Homo sapiens
SVQAEGVEFDALDSRRHRGVIGHLWWAMRRAMPGNIRKPSKLYKARAVNKAPTARINPLGMGERHLCRTRVPWSMAREFGFEEPWALGNFLQMQDQRLQRRLSVSGGKVGSRCYNLPFAHRAPGFFCAAQHLLTPVFHADLCQVVAANQHAIVGGGQQCGFEQALIVAQQIDRAEGA

SEQ ID NO: 1021114 - protein, 174 aa, Homo sapiens
AIHSYTGVTTVYEVSQLTRKCQFAWLGALPYWSNGIERPTVNDHRNTESLFLAVLALLQRLLGKKTDASDASPIPAYFQKKAEQQGYTLSDGQIRAITALNREAQHLLNGQATRRLYLHGPVWRGKSWLLDGFFQALPIAEKQLRAFPPTSFARMHQGMFLNREHDEALGATLA

SEQ ID NO: 1021115 - protein, 55 aa, Homo sapiens
MGSACVRGWVLEEHLSDGCLSGHIFGNGSFPGMRDFSWDKGPRGGWSAALRTWRL

SEQ ID NO: 1021116 - protein, 54 aa, Homo sapiens
RNYHVLHASEALWSLLWLGQELHWAIPLWLDHISVWHGAPKSIQLIHFNASSSL

SEQ ID NO: 1021117 - protein, 78 aa, Homo sapiens
PGHSTSHREITRVGDRRHMRVICIVDLVDIALVAMGIDGDLGDSARSHKGVFRVSLTLQPVASHVLRGHVHVVASSSG

SEQ ID NO: 1021118 - protein, 83 aa, Homo sapiens
MRSMTLTWRGESGSWGEERRGKREEAVGKVEVYRVESQVRAMGGWKWRPVVGVCERGYVVSVFRSSGGVQNSDGAPLTPDRII

SEQ ID NO: 1021119 - protein, 209 aa, Homo sapiens
MLLPLLLLLCWAVEVKRPRGVSLTHFYSKAFLPGRFGHHPNLISKIATAKALTNAQLPVLKASAPLAKPCTPPTGSMVFVTAAMETSTAASSCKTLQRKRPEEKSPNKRPSPAEIPSEENPERGLEKEHGEKKKKLIELQAGKKSLEDVEMLRTVEEAEKPEREAKHQKLWEAAAKAQQEADDFKDDDDVSMTELQTHQEMEPAGGELY

SEQ ID NO: 1021120 - protein, 137 aa, Homo sapiens
PPMESADKCAWGSFLELGFRQRTGDVLNAGVPGGFQNVDSRWVDAFQKKELDLALIERSLAHLRKPVSRRKLAGSRAAQADPDGRKAVTAETPFGSVLRGRYASIRTPLNTYSCDVKRSQDDHELFVCSVDDPSCPD

SEQ ID NO: 1021121 - protein, 195 aa, Homo sapiens
WPGLRHVGGVAVEHYLWRLAKQDLAAQRLLEDGGGAANGRIRVGQRDAWRGRGGARGALGGACRGPQDGALGKGQRRHSQGQSGRDRPETAGHGVDPGAVDRRRDSTARVSADVGNMLGCRVPEGGALIRENHMGLVDFIKKQFIDVIEWTESTDGVLAWRYPFEDREIQNGATLVVRESQMALFVNEGKVDVAS

SEQ ID NO: 1021122 - protein, 94 aa, Homo sapiens
NLNNAEQLCRYQCPVLLIRRTKDEIITTTVPEDIIVQPEAMNSLLKLLQHRYSPGDWQRRGLRRWVSGGGWEASFNSWEESLNFISRMGGLKKD

SEQ ID NO: 1021123 - protein, 195 aa, Homo sapiens
TPHRRFKSRNARAAFRLPQAVELDKVNARMRLAKLGWVRVRMSRDVCGKLKNATVYREQGNWFVSLQTERDEELVPRTGTAVGVDFGAVRAGTSTDGQTLVLEARLSKGAARLRYLQRCMSRKQLGSRRRQRAKARLAKVHARVVRIRNDAMHKLEPSAYREHAVVCVEDSTDCDDGHRPARISLSLRSTHIVHA

SEQ ID NO: 1021124 - protein, 56 aa, Homo sapiens
MTSRKCSQEMEPRMCRTSQASIHHIKPTELSSLCACNGNVHIAQRGICVTQRNGRQ

SEQ ID NO: 1021125 - protein, 80 aa, Homo sapiens
VPCWRIVVGWVITEMYGRPAARKLPSAAEVLAICISENRLSCMRAPPLAEKLTKGQPSSSAFSAPRAKRSPTTEPIEPPM

SEQ ID NO: 1021126 - protein, 156 aa, Homo sapiens
RKQNTLKMIYASMQNPQWHERIISPHTLVYTGFRWHVRAYCHQSKQFKDFLLSRIDRTPVVVAIDTVDPVQDQHWHEEILLTLIPNPKLNSSQQALVEKDFGMPDGRLQIPVKKALALLYFAMRYQAAITLAEADDALKYAFGTTTLRYRKAVILP

SEQ ID NO: 1021127 - protein, 167 aa, Homo sapiens
SSWAWQRSSCSDPSRGGKPALALLLIPKLDAKKSQHRAGFGFQVSINWLLGRLHVVRDERDESILLAVGELTKTLQQFAFVQGQLLTLSLRAKGHIPIERTPFDSDSALAWTKVAELRCSCGKFFQPVRKNANQYWHKAFRRFNICHRIDANEMANLRHDAASLQFA

SEQ ID NO: 1021128 - protein, 86 aa, Homo sapiens
MAEQLLTLSLRAKGHIPIERTPFDSDSALAWTKVAELRCSCGKFFQPVRKNANQYWHKAFRRFNICHRIDANEMANLSMMRPLAIR

SEQ ID NO: 1021129 - protein, 79 aa, Homo sapiens
YNAKAIRTCRPAERGVKTLLAVLPQPRVVATAIFHPNLRLQMVGEHDVSKDGMRNTFARRAPCGKKRIHFTDQKIALAL

SEQ ID NO: 1021130 - protein, 39 aa, Homo sapiens
VQQCSQSAMFQCSLRVFVQCPHSVRMQSGAQGSLTHQLG

SEQ ID NO: 1021131 - protein, 148 aa, Homo sapiens
MNSVYIQRAQYLDGQNRQALLLDALANAGAPLPPAVSSQPMSRRNGQLGERLIELFNSPAMSGNHLRPDLRHVRIVRHRRAQGARRPLSRWCTPWLRLVLRVRLDGVAFYTEHRHLFAWYRTPEQASLFKTENYGRDKSGWIQVFDRA

SEQ ID NO: 1021132 - protein, 219 aa, Homo sapiens
WVTLQDRYTVRRIEPPTVSGLNRSLSRRIATAHCQADCNRSLSSGLQPLTVKRIATAHCQADCNRSLSSGLQPLTVKRIATAHCQADCNRSLSSGLQPLTVKRIATAHCQADCNRSLSSGLQPLTVKRIATAHCQADCNRSLSSGLQPLTVKRIATAHCQADCNRSLSSGLQPVTVKRIANAHFSDATYLSDATYFSDQPFNRCTSFNDHALNDTRLTM

SEQ ID NO: 1021133 - protein, 58 aa, Homo sapiens
MRTGNAINQCSPLERFNIYQHTTAQRCTQMVLGYCTITLHTWSHIGTGTHRGRYKCAQ

SEQ ID NO: 1021134 - protein, 207 aa, Homo sapiens
PVSCSASTPGTMATENGASCMPVGRSGDPFVFCTEGMPQHCWVALNPLAGTTMKICKYYNRMWIETYRKICPKAMRMGHWQGKGAPNSNAVCALNAGPWLMRDVCLPFIGLTSELSNRNTIMKNKTLHSCRPAAWALAVGACLLLLGTPARAQWLVQDEKLYKLVKEGIVDKIATSGNGKGSFKKDGTVKDDSHEFHALTLTTKELL

SEQ ID NO: 1021135 - protein, 92 aa, Homo sapiens
QAQEKPCEVGCRVLEELTVVQGNLPQDMSAWPSCGAALNPSTRKPQLEIAKMRSRWWFQQGVSFQDHEILQGDLDFVGHLSGSGPLTPQFEA

SEQ ID NO: 1021136 - protein, 77 aa, Homo sapiens
LLLPFTAISPIPHPLSPIQQPPLSWSYHPPDTTYYTRIPDSPAQAAHFTDLTASETSSPPDRLFTNSSDPPSRDTPT

SEQ ID NO: 1021137 - protein, 108 aa, Homo sapiens
TEAAAARNTGHRHILEEHGHLHLITELSMEDHCRHDAVPRQQPRDDTTFKTHDQQQTRTNFKHHRRPEQHCRQVHRLHITAYSFGVIDFANAGQNKEQSHQHACSDHY

SEQ ID NO: 1021138 - protein, 129 aa, Homo sapiens
MPSPNDTTHIDIAGQQVPVVKGGLYDRFRSNPPLSVVAAELPGVDLSWFKGLQKHKVDIGFESYSPNFYYQNSRVTAVYTADIDKLRALMPPQVLAAVQPLQVWPGRGLIAFTAYTYEHDSLDHSRILY

SEQ ID NO: 1021139 - protein, 154 aa, Homo sapiens
AVQDTEGSQRRCGRRKPLGLSGWVGWCETWHLGRLPPGGQEVRPLGLWWTERWEGGNWHWLSLGKVQPPLASPRHGPKPHVWRLEKGKSQCQSRSESQCAEGSAVAALGKRPKLKGRTANTEPMHHPVSYHPSAGATRDFMTPSADTRSFPDPR

SEQ ID NO: 1021140 - protein, 49 aa, Homo sapiens
WYQLSIRGILGTLSDGPSSPKLAKRRRMCLSPRSHDRYHVTILMWTQDV

SEQ ID NO: 1021141 - protein, 113 aa, Homo sapiens
MLYCNPIDPQDSTDRPLRNRSSPPPPNLIPKPSHPSSPSPSHPSSSSQPWGTSSSNLLPQSVSRGSTPAYPNRFHRHSGVGEGHSPSRGGAHHPLTTCPCQSISGIYTLRPGT

SEQ ID NO: 1021142 - protein, 41 aa, Homo sapiens
MTDSSLHQVLVGKKVAFSSGCVTWTFLKCKPIGLMNLSYLG

SEQ ID NO: 1021143 - protein, 235 aa, Homo sapiens
MASGNARIGKPAPDFKATAVVDGAFKEVKLSDYKGKYVVLFFYPLDFTFVCPTEIIASTNRGKRTFARLGCEVLGVSVDSQFTHLAWINTPRKEGGLGPLNIPLLADVTRRLSEDYGVLENKLEGIVYRVPLIVTRWARVSFAQNHLLSDFACGTAPVDEALRIASSAFLVSQTTIVESLAPRELESLGSMTRLRPSCGLTRLGHYFSQTAVRVGNRIVRLVPLPMFLWLGVPLV

SEQ ID NO: 1021144 - protein, 48 aa, Homo sapiens
EIAPQHGLDSKLVVHKSFQGHRLCLPVPLLLSVVADASPAFCCSQTGP

SEQ ID NO: 1021145 - protein, 75 aa, Homo sapiens
PVSQQLVATHTLLLRYINATCNEIAEIHPGPAPPAISLPTAPPSMIRAQAVPASAPTAVSSCRRIACFLLQPDWT

SEQ ID NO: 1021146 - protein, 171 aa, Homo sapiens
DLEDPRTDWTVLHEILFVEEYCSLFTSCTVQRDRALLMGLGAVIKSSMQIVKVSYSHQETRVKGTSPCGLCCLEYFVLSQFLRATGKEEGSALHKRGGVTSIDSPQTLWAFSINSQVQSFLLQINVTEGCPGLHTFSSKPSLRLEINWFKAPALKLHYCLEVLIVFSIVRL

SEQ ID NO: 1021147 - protein, 225 aa, Homo sapiens
MANRMEGSLGCTVDCLNHRQACISEFVTFEPNRPDEPDTRQRLHPISRDVVALIILGGFVEPQYVPALLLGQHQRYFNHLFSHTALPSVSVSATRSKSWPYWWQLQSTTFVSPTDSHWHSCATSFSYKVASIPSATSARDRLTLRRSVVDGCLYVKVSASPRRRSSFGKTCGLEFGATWAQRQPPYRLAVNELDLIPRNRVTLAVLAFTAANLAVFVLVRIRGVL

SEQ ID NO: 1021148 - protein, 126 aa, Homo sapiens
GRGESPPGSGSRTRCRTHTALQGMSLQVEDAHAIHGNEQMLRLAVTDADALQVERRQTAARRQAGIEKLRGTAVPHDPLDIRKGRGMHRRVGRDHFRQVGRTGQTPLKRLQHEYLVPRILTAHACD

SEQ ID NO: 1021149 - protein, 83 aa, Homo sapiens
CTCSSASLIRIIFAASGVPGIGMVMGEHLAIHPRDIASPGTTFSINFLTMWIFEKCEHQFRPLLIGTWSWCDDRAASLCDHLV

SEQ ID NO: 1021150 - protein, 223 aa, Homo sapiens
SVLGRGLGGGMAAPMYPVRAAKRTAAAARAPRGLEVTDAEGRVEDAEFDSDPGSYPGPSTRAAGRWERQDYPFNQWGRAASKVSSSRPRAEYARPDNQPKSRAGLMTQPRFYDCVKELARMSRGNLRKVDECREKTLVVVEMAEQEGDARKIKQEQFMRKIVANPEDTEIPGGSELLPLSVKDPQDMKNTWRNIEKDEAHKRYLLMSIDQRKKMLKNLRNTEL

SEQ ID NO: 1021151 - protein, 92 aa, Homo sapiens
MPTGEAQAETQAVFELESLADVVVLQFGTGEHRHADPGFDVGLERLTGKFIHKDRRERQAAGACTVITFPIGIGAAPIAGQATDITLHSSLV

SEQ ID NO: 1021152 - protein, 143 aa, Homo sapiens
ARSKIHTDASTEVVKKSVVECDPGRFTQAHSSRKCNTRYWFMISLINSHHFDDIGDSLHSVFQASVEESPFLEKKPTNPSLPPAIGFIIYGSCVSHDFLPFIHHHSNETRLWTVAETPSVGREIFPAYVKRVIATECSNLVSA

SEQ ID NO: 1021153 - protein, 70 aa, Homo sapiens
RIAAGRIGRVKDDFQILDVIVKRWRVEGFDLILDISVNVRNITAKALALVAALEARHLQKQVMVNKAIGH

SEQ ID NO: 1021154 - protein, 212 aa, Homo sapiens
HFYDESKAFTCLDGFGTPSHIDQVNDDYSDCKDGSDETEGDGMPVLMAASTAHNTGYKPLIVSPSNQGQQMVSCAHAAMATGRVQQAASSVRTPAKRRAGKERESLTAVMAEVTREGFRLKKILIEDWKKAREEKQKKLIELQAGKKSLEDQVEMLRTVKEEAEKPEREAKEQHQKLWEEQLAAAKAQQEQEAGVLTAFKELDDDIGRDGLG

SEQ ID NO: 1021155 - protein, 142 aa, Homo sapiens
AVREPSMGGALDQRRQVRFQLFHLRRRQGLDELGEQLIMQVCMSIKPPMEEPPHSGWLENRLFEAGQVAVGIVVDHGQHHRFGRQFGGKPGDGHHVGGGGEAQADGVGAHDAFHHVDAVLARNLEHAFNHIEVEDARDQPNL

SEQ ID NO: 1021156 - protein, 53 aa, Homo sapiens
MGENEFSQCVPDARSPVTLNTSLDDYFAAECLQIFAQVEDLFLYQTSSTKYLT

SEQ ID NO: 1021157 - protein, 305 aa, Homo sapiens
MEVQKEAQRIMTLSVWKMYHSRMQRGGLLAAPGVCSCLLVMRSARELYLSAKVEALEPEVSLPAALPSDPRLHPAPRSRCPRPETADPLTGDAPCFRSQWTRRRRLTAEETSACCDPAPRQSQPQTTQQQPERRRGRWTGPEQESPSGRTRKKRRERHPKSPICLQAPPAQAEGAYPKLARVLQRRFSGLLNCSPGAPPTAPPAVQGKGRLPPGGQNAQRARAGRGGFRTPSGACRSPESRRTFARGSIPEAKHPFLLGERHENEKKHSGSKPESLTRDTQKDEHTITRRATKQHVTSHNNTPKK

SEQ ID NO: 1021158 - protein, 124 aa, Homo sapiens
PNRRKKNRLVEKVGAPTLRRHYQVLSRLRIWLSDREAAAFLFIGMTAALLFVVAISQLAMSPAVKAGHIYAVMTYLWTFVTSLDEAPGMVDQLARLKDIGKRVDPGLWGGLSLNETDPPHDASL

SEQ ID NO: 1021159 - protein, 154 aa, Homo sapiens
MDHYDSQQTNDYMQPEEDWDRDLLLDPAWEKPAEKRHSRDGVTPTSGRAGTQIENIEEIFRDGLKAHEWLLEVMLQVNSLSQARARQDESEQDLTCQQGPGFHSQQKAYKVVVHREPEEIVDGNVKMTLGMIWTIILRFAIQEITVEETSAKEG

SEQ ID NO: 1021160 - protein, 40 aa, Homo sapiens
ITQLDARFSEPRLHHCTPAVSNKRKTLSQTKQNIKTPYGD

SEQ ID NO: 1021161 - protein, 79 aa, Homo sapiens
RQQAGLLRRKNENITSSINESWTGFSAIWWVYFNGKRSPAALGYFERRYAISVTLHVISPAQNSCTTRFRTLFLLSVAP

SEQ ID NO: 1021162 - protein, 185 aa, Homo sapiens
MARVGGKARSRTLPCNRVRFLQKRRTKVAHGPSGDLVCGLVAGQHPRMDEVPPRGLPAGVSGEVVGTWVLNLSIASSPSRWVQKRSNPAVAPGRHRVSNIYTEMLLGSGRVRTLPEVRTTRATHITTDIPEKVGATSKSAASRGVAGDALLPVNTAIVPVRRSQGAAFRRRVGSRTFTGHERFTF

SEQ ID NO: 1021163 - protein, 206 aa, Homo sapiens
MRADVDMLKHYVPPKPETAIERDDSALASVLQKVAEALPYPSKDALAYLGGRGISERVAREACDRGILITIPNDPCQAKAFLTEVAGKELMERAGLWKPDKKAPACAFRPLWFRSQSHCAAEFRLMREPREGEKKAMRYGGKSPWIWEGEHTEEYMIIEGPIDLLSAVEMGSKRTIFGLPGCETGNRLVQMMAEERVMRGSDSWFA

SEQ ID NO: 1021164 - protein, 40 aa, Homo sapiens
VRFCFCYSPNLIQIISLTCVYPFYTLVDCLSDLQSLQRPF

SEQ ID NO: 1021165 - protein, 41 aa, Homo sapiens
MAHTCDPSTTLWTRVLARVEKFWFGVFPAATNSYNLQHNLG

SEQ ID NO: 1021166 - protein, 101 aa, Homo sapiens
GCCVTPQPVLSDGMPSCSSPSICRRWGRTWSVVLCLRADESIASVLRRVAMSDSPSGSPINSRFVLAAKAPTAAYIPLPPLPGSTQLTSIQTFFGFTITEK

SEQ ID NO: 1021167 - protein, 194 aa, Homo sapiens
RLLARMVKLNLVRWTLGQTDKREYKREDLTSSTPEFEPYEQWNHRGPPRYPAYRFFPQLTKKTESRDHKKDTYSVFYSDWRIVIVPHYNPGMRDRPALSDDDDRDGEELLEITALEISHELKYNPKPNKRPHGKNKGKKATLRGCAAERRLGMIERPRLVEAIRARRLRLRQDNVTSSAGRQEQGQRQEAESEA

SEQ ID NO: 1021168 - protein, 64 aa, Homo sapiens
MFTINRNTGVISVVTTGLDRESFPTIPWWFKLLTLRRVSTSNSGQSRHTIPPIFNPHVQGQVPE

SEQ ID NO: 1021169 - protein, 104 aa, Homo sapiens
SSITLNYYALLRSSPFQIPTMEGEDKLRSRHESGAIVVKLSVQQREVPTTMHLINLNRGKGGFMVAQKIVFLLWATTRPLFNKESAFIDIPSQPPPLHTCDPCP

SEQ ID NO: 1021170 - protein, 282 aa, Homo sapiens
MTSCPWAGTQGPLSDPIIRQALCAPVVRAEEVRLSQSLLELWRRRGPVWQEAPHATCVTHIGITILNAIEQHLGGWSSRGDTGCGKTTRIPQLLLERYVTEVPRCRCNVIITQPRRISAVSVAQRVSHELGAFLRRMVASRWGWKRPPSRGGALLFCTVGILLRCRATPAWASTIVGGGGMRRGRETQTYLLILLKGLENPGLRLVLMSATGDNERFSRYFGGCPVIVPGFMYPVKHYLEGILKLGKHQYLHRRHESEECALDLDLVTDLVLHIDARGDQVG

SEQ ID NO: 1021171 - protein, 189 aa, Homo sapiens
WRNVSGYLSECRWRSLCVLGPHGEQVGGAWVQVGEPHGMSHCGAWRWYVVGLARSLPGLMTDALVADLIRGDETIVFLGLLPLEEDHVLQWSEGQGLGCNPTGHILIRLESDLLALFAPLSVSEDKPHVNVPIGQQVLDGVAADTLLCLHTLSDGLVVAAAQGVVIAQRHSIGVATRHVVSPVFPLQGQ

SEQ ID NO: 1021172 - protein, 60 aa, Homo sapiens
RHEIPPTETSRQVVIFKYPTTTDSGRYQLEKDSDQHQLAVILMTINETPLPAYPALRVAF

SEQ ID NO: 1021173 - protein, 232 aa, Homo sapiens
MNDKNNPIFWSSCEALQGFEVGGTFPCLLNCSYNIKTGWTLFFSFELNLYNNLNAFSRMYQFKGFVDFIKRKIVSKFINFYLFGQIFRHQLWDTFYTLPSPKGSPFPCATYQPEWTSGNFFTCSSHSNHDADAPPLVKSLKCCSELITNTFKGIVHSSIGHLNEFLDGFTKILRVTSGSKLFGPCKFIFIDVHTNPGSTSHFTAHNCQDSQNKGTNRARVQLGSFHSSPITG

SEQ ID NO: 1021174 - protein, 59 aa, Homo sapiens
RLEDSDSTEEAMEKASADNGDEVQQVVGRDGGSCVREVTEHLGKESLRGCPPLCCPVLS

SEQ ID NO: 1021175 - protein, 300 aa, Homo sapiens
LLERGVVQQVKGHYRQAMLRKAMAALEGQDPSGLQLGLTEALHFVAAAWQAVEPSGHSRCFREAGFGGGPNATITTSLKSEGEEEEEEEEEEAGGQQGEARGRARHGNGEAGRQAAKGGGQARAELGGGQQAGGARRVMLHKLHDSKRRKMRRAPRRAWEAEDWAQGVVGGRLAAFGAYGAQEEAQCPTLHFLEGGEDSDSDSEEEDDEEEDDEDEDDDDDEEDGDEVPVPRLEGRTMAYYSHGSKRYLTILPHMMTDVQSTNPPHWNNDLVHVSKEEPRQEDAEYEVLDIKAELTGPRM

SEQ ID NO: 1021176 - protein, 91 aa, Homo sapiens
INCWSLISAAAWAKSMFPPPSISPSQWALVSNQSQSIQNLLISESETGSNNRPPKLNHMNDFPSWKNRFHTYVQGQSTDLWTCFINDQQFI

SEQ ID NO: 1021177 - protein, 169 aa, Homo sapiens
MLRAIELLPVALVVAYKASGLPPTTVLELRIGSQGASSVRAGCVLLGGAMAAHACPWVGGDPADIGPLSSLAPQCPIELPGLASHVATDVPADLTRLRDAAPFSVPASRSPGRSDPDFAVTDTPAPTVRQLPRSPSPLVWAAWASIALLPSGGLRGFPCPASRGPPALA

SEQ ID NO: 1021178 - protein, 137 aa, Homo sapiens
MLRADRALVLSLSSWVQGLPSSSTLRAQSAKAATGFIPCCSCALPCVGAMSRYCLLGAGVESCPVWTAFMRRKCRQCRLRTCLAGRDEGTVLSFLKKRLRKKKNRKQQQQESQITVAVTCWGPAGQAASSASGPGDS

SEQ ID NO: 1021179 - protein, 38 aa, Homo sapiens
MPYVPVAQLKDYVGKELGRSEWLTIDQARINLFAEATG

SEQ ID NO: 1021180 - protein, 49 aa, Homo sapiens
LALISSKRYPGKSTISVSLAVAAIPEGLPIVVTVTLALGVIEWGLLLRR

SEQ ID NO: 1021181 - protein, 144 aa, Homo sapiens
MCAQECFVHLDKLGLAHCTHLWSSCPRAVVPRLPDIAGVWTEPLPGNPYPRILVWLRLGVSWLIPVPTEGLPSDLARSLLDMLATLCSSRSSGVGTRQDRVVCSILGQRAEAMGSGPGGGAAGLGGLVGFVRDVGRGSGQGWGG

SEQ ID NO: 1021182 - protein, 32 aa, Homo sapiens
MGSGPGGGAAGLGGLVGFVRDVGRGSGQGWGG

SEQ ID NO: 1021183 - protein, 98 aa, Homo sapiens
LVTVNKGLVGGQDVYFHTLNPVAARVRQAAALRMREKHVHPLSYDEIPAIFRKAVIATEDRRFWSDPGIDPIGIARSVVVDVERDGYVEALVTWYAAT

SEQ ID NO: 1021184 - protein, 68 aa, Homo sapiens
MSCHIIVVSLYEILNYENYQLRNRMQLIMQRDGDINGVLNESPRRNYSWPSCSGSMTNNLLINDQQFI

SEQ ID NO: 1021185 - protein, 58 aa, Homo sapiens
MLVLSVQVNEEPPVVGGADDLGVLNVIAAAAGKLGEAARPGRPDEPPDIHLSVGGLTS

SEQ ID NO: 1021186 - protein, 69 aa, Homo sapiens
QAIRFNAHAFPHTPCHHMSLRKQVCNDSGDLVVYIDRCKQALVSVLESGPVRKAWIKAKRKAKEGEDGD

SEQ ID NO: 1021187 - protein, 132 aa, Homo sapiens
MVASGGEVLVGLGQVLGKPFRAILGRGSQWAIRKCEQVLVVDVLRTGARVEVLTFTGISGQHPGASAIVLKWGGSAGWEVLRPSESDLSGPPWKEVLPHVVASSARADQCGQFGFGLRKLGSQHPRDALSLR

SEQ ID NO: 1021188 - protein, 85 aa, Homo sapiens
MLNKLLVIDDGSSDVKCLFEKWLNEENSFPIHYHVKENGGKHTAFNVALEKARGELFFTADSDDYLTADALQTVNNWVINDQQFI

SEQ ID NO: 1021189 - protein, 238 aa, Homo sapiens
RRCTEPWRLPSHHMLPRIPNIQIHHYPNGIVTVNCARLLKADHHATNGVVHLIDKVISTITNNIQQIIEIEDTFETLRAAVAASGLNTMLEGNGQYTLLAPTNEAFEKIPSETLNRIPGRPRSPERPAGTTTVLKSAMCAEAIVAGLSVETLGGTTLEVGCNWGHCLTINGKAINLQLKDILATQRGDPLLLMSYSSQTHAKDDYLKFGWQSLMCPPGIDLCQTSRARQSIISWKVSG

SEQ ID NO: 1021190 - protein, 266 aa, Homo sapiens
MSLTSMYQEFPTSRQIHHYPNGIVTVNCARLLKADHHATNGVVHLIDKVISTITNNIQQIIEIEDTFETLRAAVAASGLNTMLEGNGQYTLLAPTNEAFEKIPSETLNRIPGRPRSPERPAGTTTVLKSAMCAEAIVAGLSVETLGGTTLEVGCNWGHCLTINGKAINLQLKDILATQRGDPLLLMSYSSQTHAKDDYLKFGWQSLMCPPGIDLCQTSRARQSIILMESERLTLTGSPEILDYKRWRHPSNVDAPYKEFAFGSRLN

SEQ ID NO: 1021191 - protein, 81 aa, Homo sapiens
MKIAECMGAEAGTSRFAMASYSYGGNPNLRAKRIVAIPNDVDVEVGDWVEVSITDCRLALKNKLWKQRPLSLLHPSFLSAL

SEQ ID NO: 1021192 - protein, 243 aa, Homo sapiens
KERHFVTISSPLATQIPQAVGAAYAAKRANANRVVICYFGEGAASEGDAHAGFNFAATLEDAPSSIFCRNNGYAISIAHRLETAICWAEWSFFIDEAPGYGIMSIRRGWLTDVFAVQQRSSKAGPTAALLAVVTRPFLIVGHDLQDRAPQLPVTDSSAYRSVDEVTYWDKQDHPISRLRQLSAEAKGWWDEELGGRPGAKQSRRKVMEAFEQAERKPKPQSQAALLSTCIRRCRPVRKQQESL

SEQ ID NO: 1021193 - protein, 71 aa, Homo sapiens
LEDLNKLLVIDAKTGIRGRKTPTKATHHSTVEQNFRIYKVHEHQHIPEIEQELAERDGEQTPISINDQQFI

SEQ ID NO: 1021194 - protein, 44 aa, Homo sapiens
RACQRVVVMVGAGIITPSGIPDFRSPGSGLYSNLQHHNPTTISH

SEQ ID NO: 1021195 - protein, 61 aa, Homo sapiens
SDDHPGDMYMVVNLLMAILLTVEADSSKLHASCQHSRYDSHRVITIRPRGTDASKFCNSVA

SEQ ID NO: 1021196 - protein, 109 aa, Homo sapiens
MQPAFAKGSNRRDYVFLNFGVEDSKDVNVNFEKSKLTFSCLGGSDNFKHLNEIDLFHCIDPNDSKHKQKRTDQTFNVWFTEQGRIVAESWCKVLQTERAKLNWLSVDFK

SEQ ID NO: 1021197 - protein, 205 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALATLKPLRDPGSRWDPPPLSCTRTATEKLRPEMEGPGSFTIFAPSNEAWASLPACEDDLQYSARGDSYGELPYLPRGVRMMNWESAEHYHTWFKEAYSINPIRTG

SEQ ID NO: 1021198 - protein, 307 aa, Homo sapiens
MALFVRLLALALALALGPAATLAGPAKSPYQLVLQHSRLRGRQHGPNVCAVQKVIGTNRKYFTNCKQWYQRKICGKSTVISYECCPGYEKVPGEKGCPAALATLKPLRDPGSRWDPPPLSCTRTATEKLRPEMEGPGSFTIFAPSNEAWASLPAEVLDSLVSNVNIELLNALRYHMVGRRVLTDELKHGMTLTSMYQNSNIQIHHYPNGIVTVNCARCLKADHHATKGEEHLIDEVISTITNNIQQIIEIEDTFETLRAAVAASGLNTMLEGNGQYTLLPTNEAFEKIPSETLNRILGDQKPELLKT

SEQ ID NO: 1021199 - protein, 77 aa, Homo sapiens
MSVEAMQSIEMDEENSASQTVCACYSFFSWSGCCVVSQAVEASYRVRRRRLPVPRGTHTPRPGQSRSMTNNLLGYRA

SEQ ID NO: 1021200 - protein, 114 aa, Homo sapiens
CSGFVFGFSLPSTNASRSLRRHSRRSVSLTAEHHAVQFKLLRVLIGDDIYNVRCGNCQDQSVTIKTMLARFREWMMKEYDDPVSSTKCELQLIFKKGHSVVSPTTRMTLLLLKR

SEQ ID NO: 1021201 - protein, 139 aa, Homo sapiens
MQRDTLLTQDELDFIQDMTHNPQLNLRDAWSSLTVNGGAQIRDLLTRLAAHDQVTIQAQFDNQQLTFPLHLVEDEFHAVHLRLGVPSIFEDGPMIRPWRLALETPVALENIKGYSSALWVHEVSFKGVLVEVRGRVKRQ

SEQ ID NO: 1021202 - protein, 115 aa, Homo sapiens
CQSVVQTQLGSHACPTPAFPESVCPDFTGLPLLQPSPHAHSQITGCTMAVPFPCTFFELKMLFFFGLLNVYMLIPESAPCVLPVSKTQLGYSDVIPEFHLRNSQSCLICSVKTKE

SEQ ID NO: 1021203 - protein, 106 aa, Homo sapiens
DLEDPVGRSLYYARRPRVGGIEGMHRTRIVAARCRSHIGDNAPPLRFACPADGQTVFLLFGDERRQDHDLAAVGAQLSRARHAGGHPDAEAGPPRRQWSTVIDQGT

SEQ ID NO: 1021204 - protein, 288 aa, Homo sapiens
MPFCKTFTGDRMKIVPHLEVSLESESRGFLQLHHGMNGSVQLKYPDCPSVSMHNRSSVLATVTVIACEEPGSYSAACILSEHDTLRTVGKHLHPRLDQVVEGGYQSSMSKQVAHPVVTFRLEDLGTPEVLGLRLVRSISPTVCQGQSIHGDSARGCVIMKTLPPLSEKSLLPTVELAIQRTRDDFWTSWAHSLEILTDADDGRRRSATRTGNTRLDGGVLRNSAPAFGDQPMQHYWAANWSISEDVDRLSSIIWQGSDGRWGQPSAHPEDPVGVERGLPGGPSRHTFH

SEQ ID NO: 1021205 - protein, 131 aa, Homo sapiens
GDRSCGGSRMTPLPLQQFLHPGFTERLCKMAVTSLIFRQPDYDRGLDLHQDQHRLRQRQHSGPGCQRRLSVVAGNQTRHPQRSLPMVPLQGRRHARGAHPYLSLEQRRALVLQACLERLQRRGVLRPYGAL

SEQ ID NO: 1021206 - protein, 193 aa, Homo sapiens
MSLLDDLEPGDANGFDVNWSFSSQLCQCMELAESVLPCAQWCAMAGMQCACMHVDVMCWCVWSWMEVTWASDEADKMDAGPLPRTEVCPPEERPPVVLPLPPPPPSSSAVFRLDQVIHSNPAGIQQALAQLSSRQGSVTCTSVVIQGTSLGPPQGPQGPSPRPPNRYEPQRVNSGLSSDPNFEEPGHGERGGW

SEQ ID NO: 1021207 - protein, 50 aa, Homo sapiens
RAQGAVCSHHVVGESEANVREIFDKDPPSCPLCAILDELDSTAKARGGNI

SEQ ID NO: 1021208 - protein, 90 aa, Homo sapiens
VPPCLARNVVGIILTVLVGRYAIVALNRYLEKQKQTEALPDIERRKELSYDTALARLAKKVCPGCERSVDLTNTAIDYCPHCGICLFDHV

SEQ ID NO: 1021209 - protein, 55 aa, Homo sapiens
MSLIQDKFASVFSNYDVTTQPRPDGGILLTLRNSEGKQVKRSISYQQLHTADQLT

SEQ ID NO: 1021210 - protein, 61 aa, Homo sapiens
PAWRAVGGFLSSWARVLSSPGLYGLTLLVWGRRHVASCCRCSSPLTRDYPPIPWCRLVPAT

SEQ ID NO: 1021211 - protein, 240 aa, Homo sapiens
ESWFVWVTQMNHIPMHIDHDRNMNWFLTQLQATCNVHNSAFNNWFSHLNFQIEHLFPLYHIVAPYSLCAKHIEYQSKPLLSAFAYFIFLKESGRFWLDAIFTNNNSHPAQSGRRGGRLWSQGRGELEGQCHYSILRGGWVWGHKASDSNSSLLSSSHSSKTQSGGWTQKSLGGKELLGQGCKLFPFSSLAHAGSWWTERTRRVTEEEGPTEPRVRKRFNTKIPLMPGVVARACNPSYPGG

SEQ ID NO: 1021212 - protein, 38 aa, Homo sapiens
SRGSRSSSTRMQAWMRILFPIAPHSCLKPIRVCSVEIE

SEQ ID NO: 1021213 - protein, 54 aa, Homo sapiens
SLLRSREPGCTFLSPHDESVVRYYRILQSEVVLTCELSRVDFPGNLVQGCAEGG

SEQ ID NO: 1021214 - protein, 132 aa, Homo sapiens
VSAGRFLADGQGAVAFPGNPHAVEWKPSIRKGFAILKIAFTVAGNHFVQYQRLAVPVDVHQVALEALATFVEGDDQRVMAFLQHPQRAGDFQRRGEHLGWLRCIFRIKGVEHGSSISRQNTTTRKNRHFASM

SEQ ID NO: 1021215 - protein, 353 aa, Homo sapiens
MARYEAGFGVDTFNPFLLVRERSSAGSLLGLQDADERPPVVPRHEELLTDMKREGVSKVFDVTVPELCCSKTLSSQPLPLFASATTNHLSTCSTFSSLVAKRGVSESPACETVSGIPAKDVPSFTFLAFTNTRGQLSSQPLQPSDAVALSEDAVEQSEVVEELSDARYEPELLPLLQQCQVVRLDDCGLTEARCKDISSALRVNPALAELNLRSKRSWAMSACIAVLQGLQTPSCKIQKLSLQNCCLTGAGCGVLSSTLGNPAQPLQELHLSDNLLGDAGCKLDLEGTPGPQVPPDRGCSWSIAASRLPVENPWSPCLGAKADCKELTVSNQATSMTLRPVLCPGLKDPPAVE

SEQ ID NO: 1021216 - protein, 387 aa, Homo sapiens
AWNVLALGRWGCACVVLVLTWAVKPSSALDSSELRKQSCAQPELASPNPVILDLIPPKKLASLVNGACPVLDEDSNWLPQPGLFVGKVHEELLTDMKREGVSKVFDVTVPELCCSKTLSSQPLPLFASATTNHLSTCSTFSSLVAKRGVSESPACETVSGIPAKDVLFPLPPTQCQLFTSTMSLDIQSLGHPVWSERELTLDRSLSSSLCSSSAKWSGWTTVASRKHGARTSALHFESTLHWQSSTCAANEAGRCRRALRAPGPADPLLQDPEAEPPELLPDGGRLRGPVQHTRQPCPPLQELHLSDNLLGDAGCKLDLEGTPGPQVPPDRGCSWSIAASRLPVENPWSPCLGAKADCKELTVSNQATSMTLRPVLCPGLKDPPAVE

SEQ ID NO: 1021217 - protein, 454 aa, Homo sapiens
AWNVLALGRWGCACVVLVLTWAVKPSSALDSSELRKQSCAQPELASPNPVILDLIPPKKLASLVNGACPVLDEDSNWLPQPGLFVVESVGWSCVCARSWEGVVLLLSIAVSFCPGTTWWDLDCRVPLNAACLGALREDVTSKHKLGMGTYVWPCVKWVCHPVGIGRNIDRKCGPQGTSRLITLGAECLPRPKGCPSRMPIGGETPMEVTFLDRPDVSPEYEPCLLSKDVFRESGPFKERAWVGGGPPPFIYSGNLVCEHMPWFITGTHGNNTPRFLPNGLVPVSLLGGNFGCFVRLIITVAIIATLSHCVQKLCYASGCDHGTSQHESVNDDVLAPECSGLHNRYPSSRDITPLVKGSTRQVSPRITKPLSRHQNRVSWFKKYPPSYYCTRYNSSVTLIDISVVLAPLQYEFATERSPRILNFPRAITILAIGRLAIGLIGTAMVAIEYLSEGE

SEQ ID NO: 1021218 - protein, 253 aa, Homo sapiens
MARYEAGCWCRHVQPVSAGSRTEVVPARSWVSRTPTSVRQSSRGPLVQPTTMSPGSSMLWSERELTLDRSLSSSLCSSSAKWSGWTTVASRKHGARTSALHFESTLHWQSSTCAANEAGRCRRALRAPGPADPLLQDPEAEPPELLPDGGRLRGPVQHTRQPCPPLQELHLSDNLLGDAGCKLDLEGTPGPQVPPDRGCSWSIAASRLPVENPWSPCLGAKADCKELTVSNQATSMTLRPVLCPGLKDPPAVE

SEQ ID NO: 1021219 - protein, 228 aa, Homo sapiens
GWEASCCRGCSDVHVCSPGSGDGKLLRARGGERVNLPGPFGVLGPAGPVVFNAVMPCCPRCLSCFFSLLLAAWLLLLPGPRSWALSQAGAEENDWVRLLQANADVCQMMFVWWELKVTPYDVKPGYDHMECDLARCYGILEHEVPLACQNYNLMSDLVGVDRQFNWTSHFGKRLLGVIACTRRGPAAIEFAKGMSETFETLHNLVHKGVKVVMDIPYELWNETSAEVA

SEQ ID NO: 1021220 - protein, 237 aa, Homo sapiens
ITVKCGDYPTHEHTQSWMALMSSDDKGIVSYLWTRDEGSPAAGEVLNHSDHHPIRFSFRDLVDGKPYIFSRSKCDLMQQGESEHRPGPPVDGEHAGSQVEKQPWLEESVFATINVMPANVRRLTGDVHPARCGVLLGGARIPDIIGAKRLQPGTGEQTNLKDGHFVVQKRCLPEQIFKGHEGGSDAQGVSCGQPEGRLFDIQSLGSLTLSMSAELFRPWHCDSFTKTRYLVTLLAGN

SEQ ID NO: 1021221 - protein, 141 aa, Homo sapiens
PRKQYDYYAQNSKKNKKTSSQMFNKIHLLPQTPALPCRGTVAPGLASLRVGYVTGDLTPVLLYLYTEKVSVRQGPLDQPASRRFITGEWFCWRSTLLGPICLGSPYTSSSVSWKPCSLSTKLAQSWQAASLKSLPQGCGGI

SEQ ID NO: 1021222 - protein, 117 aa, Homo sapiens
NEKEAMEDGEIDGNKDTLDWAKPKVKVASGVVVEAEAALEDEVVGRVRPSEGFWWQRPAQAMEGEEASEEAEEEEVTTSHKERRRRLNRLRPYAYPSSIRKKGQWGLYCYLNNDRAF

SEQ ID NO: 1021223 - protein, 93 aa, Homo sapiens
VDDQLAQEQVADLLDGERGGLGFVAAGGHVGLQEFQRGLFVAMVGQHRLADARGDRQDHDVVLFEVVLRQVAAGIDDDTDTHAALQTTTLAKH

SEQ ID NO: 1021224 - protein, 148 aa, Homo sapiens
ISRLLQVDPEARLTAEQALQHPSLSVVKAAKPWNPHPPRQRFRVAVWTVAGCSDEWPYAPIVYGHCSQEEHIVVGEHPKRVRLMPAPLIRTTWLAFRLYGHWVKKGEQQNRAALFQHRPLGLFPSWALNEEGDSAAITEDRGQCIVLG

SEQ ID NO: 1021225 - protein, 167 aa, Homo sapiens
STQVPLKTLCQPTQGSAFPQPWAPQPPHPPLAMVLPLLPDPWAPRQPSYHSRALVCWQSTPSPHWCLTAPYSRAWSGTPSPPSMQKQPHCMCRVRQQLQTCSPSSPESQHGGKVSTPGGGLRPACKTTNGGCKLMRSDGRKGPCAMIERDPYEHPERLREVCSRKLE

SEQ ID NO: 1021226 - protein, 226 aa, Homo sapiens
YKARYEAGGESGSEASTYPMIWRGALQRSSQPRTMAEVGSSVSCSSRLSRLRKSISHKRNEDCVVRAVIREIPKTFFPVIFSKASEYLQLVFGIEVVEVVRIGHLYILVTCLGLSYDGLLGDNQIVPKTGLLIIVLAIIAKEGDCAPEEKIWEELSVLEVFDGREDSVFAHPRKLLIQDLVLENYLEYRQEPGSDPACCEFLRGPRALIETSYVKVLHHLLKISGG

SEQ ID NO: 1021227 - protein, 187 aa, Homo sapiens
MMGMEAGDVLLLEATPDTAGLRWSPLSWEPVSAAAPIMECVQMTKEVQKAMDDKRFDEATQLRGWELREQLEHLQAPRPPEAPQWRMSNFSLAILNVGAPAAGMNCRPVQTRASAGPGISHGHTSTTVVPRLASEGLAQGTRVPEVAGTTGRLVRDVLAHDGDQEDLPGQLIHVEKSAYGSRPAAAS

SEQ ID NO: 1021228 - protein, 57 aa, Homo sapiens
MVEDRAVIARLLKGVTVDLMRPGLLGGRSLVSPRAGLGGSSHNCVVGMPTCPMNLPN

SEQ ID NO: 1021229 - protein, 133 aa, Homo sapiens
MRNQASPPEDTLSKPFVTHWGLPMKRYYNVVVLGDLCGKPDFCKHLLKRSFSRVFCLDGVKGDLLIDISSGPTIYQLLSACESFKEIAGTDYSNQNLLELEKRLKKEPTAFCLVPRGDPFGVTLKGTTFTGPE

SEQ ID NO: 1021230 - protein, 46 aa, Homo sapiens
GSPSVFKKRDDIFGMARVFYGCGLLISHREAKIHNSQGRQPAIAEI

SEQ ID NO: 1021231 - protein, 408 aa, Homo sapiens
RALSCPQCPSPAASSPFGGMEVMVKRQRKGSLDLTTQTEPGECVFVCDPLTTKYYKNQRSRTRSVRITTGHAYEREHTCNLEQSNNRTKQAYHAPPRTNGPTKRHKKRPPPRETQKRETREHTQRKNNLNDQRHTTSKEQTNKQKEERKDKRTTPERRTKHNTEHKTQNRQTTKTENETATRKKKTRTHTNRKKQETNPNKNAHRQDTTKRNQQKHRKHQQQDKQQNNKTYDNQAHRETDNKITTYQAKTLDKQNSEKTETPKRQQKTLSAATGEQPRHNKTQATRNPSDNTKENRHPHIDTGKRDKIGERQHTENKEQHTDRTERRKTADKTKQPQEQQERDREEEKQKENKRKQRKKKREEKHKKSKKRNKRKERKEEKRKRDEPTRRQQKERREDSHRREEKRDK

SEQ ID NO: 1021232 - protein, 188 aa, Homo sapiens
ERAGDRWGWCLWEDCLLIVFTRISFRRSTSYVLKLLGHEVDGKQVELALWDTAGRNMIVAFYHTDVSCASIDSLTANIPEKWTPEVKQLRAPKMPIILVGNKKDLKGKTKHTMGESLAKYEAGSPFGLRTGRDMANRISAFGYLECSAKTKEGVREVFEMATRAGLQGPHRTSVGVGCPDSLSIPKER

SEQ ID NO: 1021233 - protein, 119 aa, Homo sapiens
MPIILVGNKKDLKGKTKHTMGESLAKYEAGSPFGLRTGRDMANRISAFGYLECSAKTKEGVREVFEMATRAGLQGPHENKRRSGLSRFSEYPQGALTYMPSHPVHKGYRNYPPYKPRLL

SEQ ID NO: 1021234 - protein, 73 aa, Homo sapiens
DIQSALYLKIRVTYTHIDNNLTKEQVTLRIKRNPILESISTIGFTSLDVGSGHPDGAAAIKGSFVQRLKSYVI

SEQ ID NO: 1021235 - protein, 91 aa, Homo sapiens
MKFKRDHKRETHHKLLQHVTNSCRTRESFFTKSHLSLEEPALIPIDCCAALLRSPGDPEPPPQIQYHQSNHPLPRSQLDPIDSVLRCYVWD

SEQ ID NO: 1021236 - protein, 34 aa, Homo sapiens
ASTNQTSMYLCASSHRDSGHTVTQFFGPGTRLLV

SEQ ID NO: 1021237 - protein, 68 aa, Homo sapiens
TLDRRCKILHTSIAENLAVRLGGGPFRDPQAGGIGAECPGSQCSLWLVSILQVALPHITIWGLEEDRG

SEQ ID NO: 1021238 - protein, 53 aa, Homo sapiens
HTRSSLQVLHTSIAENLAVRLGGGPFRDPQAGGIGADVPMCSHVHACWLSVHS

SEQ ID NO: 1021239 - protein, 130 aa, Homo sapiens
MAEEQPQVELFVKAGSDGAKIGNCPFSQRLFMVLWLKGVTFKCYHRVTPKGGPRQCRKLCPGGQLPFLLYGTEVQHRHQQDVRESLEAVLCPPRYPKLGSSEPVSPTQLVLGHIVAKFSGYIKEFKPSIK

SEQ ID NO: 1021240 - protein, 39 aa, Homo sapiens
SPLLLILTVFSISTREKLKNAFSLQLFTGGIPPVCSCVL

SEQ ID NO: 1021241 - protein, 87 aa, Homo sapiens
RTASVLRKVEIAPGDPELTKSQRFLEISGCCTTRKGALGMAATPVCYHLVITLSCDKHLNPGRGGCGELTLHQCALAWATRVKFHLK

SEQ ID NO: 1021242 - protein, 31 aa, Homo sapiens
DSSFYICSATSRRAGSSTDTQYFGPGTRLTV

SEQ ID NO: 1021243 - protein, 37 aa, Homo sapiens
ILKTAASTSAVLGRTIRGGPERSTDTQYFGPGTRLTV

SEQ ID NO: 1021244 - protein, 31 aa, Homo sapiens
GDSALYLCASSQARTGSTDTQYFGPGTRLTV

SEQ ID NO: 1021245 - protein, 34 aa, Homo sapiens
HPEDSSFYICSAQLDTQYCSTDTQYFGPGTRLTV

SEQ ID NO: 1021246 - protein, 120 aa, Homo sapiens
MNSFTKSLRVLHCSIQQCLLLYLPLLLYLLVLDKHRLYPQGGTDPGCFSAWMALVKIWQPPSIPPEDTVEDYMVDAGAVCADSDGEAWVQYLAPSISERLQKPSNQNQNSGRLRLTILNE

SEQ ID NO: 1021247 - protein, 46 aa, Homo sapiens
CAILDFQYRLSRAGLQLPGPRDSAPQMKRRVWGGERCREPWKRSTE

SEQ ID NO: 1021248 - protein, 245 aa, Homo sapiens
RPAGGDVGALKSGSHSRPTPLMANRYTMDLTAIYESLLSLSPDVPVPSDHGGTESSPGWGSLGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYTPGPLHLRLSLPLHPQPLAKTLAGPRATLLCFSRASASPGLPSGRRTSPPPPGLAGPSLSSSSFSPS

SEQ ID NO: 1021249 - protein, 142 aa, Homo sapiens
RPAGGDVGALKSGSHSRPTPLMANRYTMDLTAIYESLLSLSPDVPVPSDHGGTESSPGWGSLGPWSLSPSDSSPSGVTSRLPGRSTSLVEGRSCGWVPPPPGFAPLAPQPGPLSCHALRSFSATLGYPSYLNPHFGAFTREL

SEQ ID NO: 1021250 - protein, 32 aa, Homo sapiens
ELRDSAVYFCASSPPSGAGGEQFFGPGTRLTV

SEQ ID NO: 1021251 - protein, 328 aa, Homo sapiens
IFNGTDGSENVTGLDLSDFPALADRDRREGCNPTPLINPLAGRAPYVGMVTKPANEQSQDFSIHNEDFPALPGSSYKDPTSSNDDSKSNLNTSGKTTSSTDGPKFPGDKSSTTQNNNQQKKKIQMLPDGRVTHNPQAMVTDQFGKKGLLTFKRAAETDPGMVPLALGSDLTTLGLNLNSPENLYPKFPSPWASSPSPPQHKHFHVPSENLTNIHIREKLAAIKLGRYGEDLLFYLYHMNGGDVLQLLAAVELFNRDWRYHKEERVWITRAPGMEPTMKTNTYERGTYNFFHCLHWRKVAKEFHLEYDKLEERPHLPSTFNYNPAQQAF

SEQ ID NO: 1021252 - protein, 110 aa, Homo sapiens
ATGSSEERADRSRTCPIQAPPAVGRSAGRMARNPARCRGTRKRKRPTGEGWAWKDGGADATGIQPTLSTIEQSRALSAVVESIPGLDRDQVSNVGWQPIRQTSLETRYEL

SEQ ID NO: 1021253 - protein, 261 aa, Homo sapiens
CEHCGWALRISRFLPGFHSFAPCTVAPSLRAQPAKQRAPVAGVMQRARPTLWAAALTLLVLLRGPPVARAGASSGGLGPVVRCEPCDARALGPVRASARRVARSWCASRAAAACLDVRTERGPAVRHLHRALWLRPSLPAVARRGATAAGAAGRPRALRQRYVPVSRLRAYLLASAASSREMLGEIGGKTAAPAVVESPVLSPTHRGVCIPSFHPPPFQRIFIIKKGVVRQQRYKVDYESQSDTQNFSSESKRGDRIWSLP

SEQ ID NO: 1021254 - protein, 212 aa, Homo sapiens
MYSVRCQERNNAGYAGIRDQANHHYTRIFGSALLMSGVTAASSYATDRNRNNSGIYSQPTASSELSQALGQQLGNVYGADDLEESEHGSDSPNSPWLSFQHHHGEGPQFHKAVQIFGLLTPRSHEHENFLKNALTIKNAGIAVVLLVGISQQTQAGMPVIDISNLDHNIVSAVQQVAAVEKQLQQYQTQLQQYQNCVAKHGCTERFHLGPGS

SEQ ID NO: 1021255 - protein, 46 aa, Homo sapiens
VTDSRSWPGSVVLLGQHRLGSCSRLPQSSSSHLSAVLLSSAVSLSS

SEQ ID NO: 1021256 - protein, 81 aa, Homo sapiens
SRTSNKLLVIDTRLEEQFTQYDIEQISGLSSAYAVRMYELLICWRSTGKTPIIELDEFRKRIGVLDTEYTRSMTNNLLEIL

SEQ ID NO: 1021257 - protein, 73 aa, Homo sapiens
VVGRGDVSYGGNVLFLSSIKKALGECIFRTTLNLCFLVTVITLGLSKPPTSPPKRHAKCHTKGHPMSHTKSRV

SEQ ID NO: 1021258 - protein, 177 aa, Homo sapiens
MAMGLIFLSVNNPLYLALALPMHAVLYLISANDPKIFSSIHMWLKTNGRCRNFLFGRASSFSPLATKKLEKVRLLTRIVKYFRVRENKGEIFMGAAFKYADALKNEKSTALFIPYSSHVTKNVVKLVNGDYIATIRMQGAAHESADVQDITSWHDQLNGFMRNIASPTWRCGRLWYE

SEQ ID NO: 1021259 - protein, 382 aa, Homo sapiens
RRTDRSGEAVLRRHRSPTPRRTGSPERRMSMPDRTRAGGAPRRAAVPTEPKSAHRRRSIFKGGFCYHSKPVVGIQFTRPPEVEKYLLDNDCQLFVAEKTGLNFEARIRQNEINEPQVRIVSETPKLTLNHAYYRPQGQLRFNGTGKGSRSPSRPPISLEGQCKQASEAEPPSMQLPQKVQAQVIQETIVPKEPPPEFEFIADPPSISAFDLDVVKLTAQVCGQELGARFLTQLMQKEHAHIYQFDFLRPQLQPLHSTSRSLVEQYTKHLEFHPKVLLFNTLIGKEADKSPGASLGSGVLTEWNWAKFQERDRKKERRGERMKDAGGLVLRLDVALILCELEETVDFQPNEQGNFPPPNTPELLGARILIQERYENVGESEDR

SEQ ID NO: 1021260 - protein, 47 aa, Homo sapiens
AGKGAWLGFGAGGKEGAPGNTVPKRTEAAKGFELLYQPEVVRLYLSL

SEQ ID NO: 1021261 - protein, 214 aa, Homo sapiens
ATNGFGSLAVNYTLVVLDDIAQGMDEPGGPDSSSVVVNDGPRQPAAVALTCASHMPSNDDGACGDRTGPWVAPVRLNVRGQLVHPLCPDITWMKDDQCLDPPRVPLSPVKKKWTLSLKNSAVPGGQLANTPAACRTALGAINATYKVDVIQRTRSKPVLTGTHPVYTTVDFGVDQSFQCKVRSDVKPVIQWLKRVEYWCRGPPQLHHRCGRPEV

SEQ ID NO: 1021262 - protein, 78 aa, Homo sapiens
SSSAVVLSARVKDLIRAITTEVTDNISVGAMPLYNDLSISNVSPIALEQDCPPVLQNSLTSTGMVISTLIACQLDSYL

SEQ ID NO: 1021263 - protein, 45 aa, Homo sapiens
GTSLSFVDHVIHCGLTLRQIVYIRHFTCEFIRVRMAFQEARGIIL

SEQ ID NO: 1021264 - protein, 103 aa, Homo sapiens
MSTALVMQEIERFLALLAKILEILCVRGKWGTGKTYNWKTIAKAAKLKDGGVAMNTYAYISLFGVNSLGDFKMQIVQATVPRSSIGDPNPANRWIAINDQQFI

SEQ ID NO: 1021265 - protein, 232 aa, Homo sapiens
AAVLRLGTGMLGSLTEGVGQVEVSVTSRGTEEDQPGRLGTLSCTGAMLVCACCQDPDDDENAVLLNVSDVPGAMCCVPVLCGVCMPDVWALGFLCYACKLFRVTTDAVCPVLREHGTCTSSPGLGDHKILIDRYDWTVVTCMTFLEYDAEYSTWNRDYQLSEEEARIEALCDEERYLALHYWTCFEEEAKERGKNTKRLMCSTSQSDGSYNAVESLTVATITTRQSRTEEED

SEQ ID NO: 1021266 - protein, 221 aa, Homo sapiens
AAVLRLGTGMLGSLTEGVGQVEVSVTSRGTEEDQPGRLGTLSCTGASGGRAKPERKSGAKEEAGQAVPGGWGAARVGKLLGISGLMPENAVPGHRQSGASGLREQGQHLIPWMGDHKILIDRYDWTVVTCMTFLEYDAEYSTWNRDYQLSEEEARIEALCDEERYLALHYWTCFEEEAKERGKNTKRLMCSTSQSDGSYNAVESLTVATITTRQSRTEEED

SEQ ID NO: 1021267 - protein, 43 aa, Homo sapiens
RAGIALFMGVSDSSAEQSVSTHIHALCCQGRPPSASATVMVRA

SEQ ID NO: 1021268 - protein, 134 aa, Homo sapiens
THASGTFSYITPHAIIALRRINDHVKYQLMSIPYLNILELSSIFADLVCSPPFPTSNGSLPILVSFFFCFLIEDYTAVSYVSFTLKQNRNIILFFVILTFEIQASYLVEGPAFWTCLIVSSLSDSIQDKFWGIG

SEQ ID NO: 1021269 - protein, 50 aa, Homo sapiens
GPAGMSYAVMHSQPILVTIKVSLSLMKVLKLWVLRVEKIMYSLARKTYPR

SEQ ID NO: 1021270 - protein, 257 aa, Homo sapiens
SFGASRAFFDGNWTLDRQREETPAPLAAAYLTRVPCHCLDPGGPTGSLAVPQDLTEDEQTVEDSIIEDEDDEADVEEDEPTDLVEDKEEEEVSGEPEASPSADTTILFVKGEDFPANNIVKFLRGFTNKGTEDSIDESLDASFRYPHDYQFYIQNFKALPLNTVEPPQRQATFENSVNPAEAMGGPPFVWTSTELQRSDGNVSKMQPSSNSTSIEDRMAIWINNLKYKALVASCSGKLLAFITPKIYTPTTLPGRRP

SEQ ID NO: 1021271 - protein, 73 aa, Homo sapiens
SSTGLYGFFTPQGLGYYGLLLCLLHTVVTDTVTTNDWNLPHTPLDHITDTSYYDKYLTYSLTGTCTDLDGHYD

SEQ ID NO: 1021272 - protein, 69 aa, Homo sapiens
MSLAGGQRRELGVDKSWVMSQSRGMYHQGLPPPRIRRSWQRHLKRTSTQGLPETSNEDSGARNVNIGKA

SEQ ID NO: 1021273 - protein, 140 aa, Homo sapiens
MGIREKHPQELASSWRSSVSCCWKRSSTHIRSLEFPCRSYNLRTSVVVIEAHMESCTKKGWIRCNTDQIKERVDSVAITDASFTGYFVLCCTLEFHDRLKNIVPTPDLEEQPVPPCMAVAKTDWGLPLYRTCCGLGSTSK

SEQ ID NO: 1021274 - protein, 212 aa, Homo sapiens
MDRDPLGGLADMFGQMPRSGIGTGPGVIQDRFSPTMGRHRSNQVINGHGGHIMPPTQSQFGEMGGKFMKSQGLSQLYHNQSQGPLIPACKDSSKDSATSSVSKTRTAVMQQQISREGLLSSVPNDIQNSECHKTSGPKHTLLMSVLGAQATQRSSEHPASGDRAPSSWRLKKLSPPRLSRHKPARDQAKQPPTGQRQELLTTNWTRLVTGHI

SEQ ID NO: 1021275 - protein, 72 aa, Homo sapiens
VQHETWIGTHLEDLLICLDKCHVAELVLVQELSRIDFHPPWDVIVEIKSWMAMGDTSCLPHNRSLERWEASL

SEQ ID NO: 1021276 - protein, 95 aa, Homo sapiens
RARADAGSLSERRILVPPSFVPLSAAAACARHEEECLVFSPYRASFIQRAYLVKPGVPRFPLQVLGFEIDAVNSVQFSNHTGYAPTWKGQCAEFK

SEQ ID NO: 1021277 - protein, 142 aa, Homo sapiens
RARADAGSLSERRILVPPSFVPLSAAAACARHEEECLVFSPYRASFIQRAYLVKPGVPRFPLQVLGFEIDAVNSVQFSNHTGYAPLGRANVLNSDELQELYQGLRLDHLNEFYFLLTRYSKDQAFLALVGDLGPELEPQNPK

SEQ ID NO: 1021278 - protein, 260 aa, Homo sapiens
RARADAGSLSERRILVPPSFVPLSAAAACARHEEECLVFSPSRASFIQRAYLVKPGVPRFPLQVLGFEIDAVNSVQFSNHTETRSVSVAQAGVNVAQPAHCSLDLLWLNESFLPPPPDVAGDYMLCTMHCPPPCPWVCYLVVCHCVACFLPGDVATNAMTPCAWDTGVFHTMLAMFVFPDSPSVLERVWKCLIPPRCLQEPTWLQASPTSMAAARTSSPFPHGPGPRILEGRTTRCVHFYHTVSWAWQSLQLVASIPSGT

SEQ ID NO: 1021279 - protein, 58 aa, Homo sapiens
PGCSEDSRSARTTQIRIVVPIPTHVLVARQFLDPVILDWNELGRAVRGSSDSSSSSER

SEQ ID NO: 1021280 - protein, 71 aa, Homo sapiens
VPMASVEVQDGRRCCSILHCVVKEYLRLVSIYKGKRFIWLMVLQAAQRHGASICFWGGHSHPVGASCPLHR

SEQ ID NO: 1021281 - protein, 120 aa, Homo sapiens
ACPAPQPARSQFSLSPACPLPCLLALSLALSSRIEGTLTTACGWEGRQRRRRLRGNEAAVVVVGRCLGEDEQQEQTIAEDLVVTKYKMGGDIANRVLRSLVEASSSGVSVLSLCDEKVMP

SEQ ID NO: 1021282 - protein, 79 aa, Homo sapiens
EHALRLSPRARSSRSRLPARSLACSRFRSPSPRGSRGEDLVVTKYKMGGDIANRVLRSLVEASSSGVSVLSLCDEKVMP

SEQ ID NO: 1021283 - protein, 54 aa, Homo sapiens
SAGQPADGAAQQAEPEAKHDDVVGFSIGFSITDHLLNFFIRQAGVGLDGDLLLF

SEQ ID NO: 1021284 - protein, 44 aa, Homo sapiens
MFTNRSLPLTAISAVRRCATERGVGTLLVGDRRAPRSIRRHIAR

SEQ ID NO: 1021285 - protein, 69 aa, Homo sapiens
MRAFKSHPCSAYTDHEDTRNRATLLLSRDIPTGGLDCRLPSPPYPLHDIQRLLTPFSPLMWHALKRGTP

SEQ ID NO: 1021286 - protein, 85 aa, Homo sapiens
SLQIRKATINDEKRHKIATTRRQSDDKRTSKIRENIYPLTFHRESHRHIYIVVQEEDRKSKLSAYVTRLRSSKYAQRSPCEGPSN

SEQ ID NO: 1021287 - protein, 113 aa, Homo sapiens
MTHITEGIQEDSLKVVDILLEQYPALITGRSSILLKNFENLFLISSCPKDWINRDRSQISVNPNRRLTSQQWLKVLVRSKFTEGSSRLRKSEGLRDRKKIPCRNPFFTLEENA

SEQ ID NO: 1021288 - protein, 256 aa, Homo sapiens
RESLGAWGCLAASRHGLCQQTALDTQAQGLEPRDESAQGRCEPWLGCPLTCLLKPQKRALRPGLPCLLAQLRLSVRRVLLAAGLRPGPGAGGSAGDSSVLECRAVLAGLRSPRGAMRPEQEELVMVGTNHVEYRFAKANGRSSLRRVRCASHVGTTLMRAMLDAHPEVRCGEGDPPSSPRVLAMRPGPGPSLAVTKLRLDEAAVTDDVLDSSVQVFILEVIAKAREPASVLVIKDRSTSQNSVYLVRLDPDLQTSA

SEQ ID NO: 1021289 - protein, 468 aa, Homo sapiens
MPIDFCSEELKTEEGVSEAPASCVISPSSVSPDDHQHNGELSRHSPQEGVQIGPEEAMERLQETEKIIAELNETWEEKLRKTEALRMEREALLAEMGVAATGRMGELWASFFSKERLPSLVNPDTEGTLLDDHEFVVCLTTDQNELGRYYQESGPELSYGLFHMPRAVTGFISGVADRLIWFAGRIRAQATNWSEGRVHSLEALDRKGSCSSDIVYLGTAIGATGGPTELTAHGAGGTTRSCCNEGQGNPSGCLPGRNHITKARGGQGDKGAWVNPVRNLDGRVRRAQISPKGPSALLEDTKGTESRVQTYVGAPSTGLTIVGWRAHPERGQFRKPVQRWPCGDHIGDEHHRGVQGDIPWERKNLQSVHTGDTGYNNGGKTNKCTDTSFTLELGVRPNDACDEKPGVTLPGNTFVGTKAGGECEHAPVPPKPAQPIVVTHDTHSEPAKRGDPQQVAITPDVVRGTTHL

SEQ ID NO: 1021290 - protein, 199 aa, Homo sapiens
LLKAMKITFNVYYFSSCSPANLSSAYDWNLVSATDASGKPLVAMNKGIERKLRVAFGDKNLSISGGCNRQFGGFHYQYGVLKVQPLASTLMACDKSLMDLDAQVGRLFKGDLRAVISGDNVAPMLQLTTADGSVLKLQGEATPQTRYGSEGEVKFLEVAAKTVKCSHPLIPGYQCLQLRERRYVDAELRLATQDTGCAF

SEQ ID NO: 1021291 - protein, 43 aa, Homo sapiens
TLEFPCQSPPTEDNKEKKSAKDASLLWCQMKTAGYPNVNIHNF

SEQ ID NO: 1021292 - protein, 105 aa, Homo sapiens
ALAARDLVCPPRLPSHKSRHTTEIRGYSPEGPIRPRSLPPFTDPRTNPRLPLPQPPSLRADTPSVYTRTRLHLVEIPRPESTLPRPTPSMLGSVIACGLRMIRGE

SEQ ID NO: 1021293 - protein, 114 aa, Homo sapiens
WLNPPDFDYAFNLAYGKKTHRCPTLVRSVASTDRSSDRAKAPRRRVTGVITPPWPQSPPPPPTPPATATPLLATRCAPVCLAVRACQRTGYSRAATRQNPACHRSLRRRPETPV

SEQ ID NO: 1021294 - protein, 120 aa, Homo sapiens
MYLVRTLALLADLRSRPDPCVKALTKVAAHRLQPGAKCMIDQAHQERTANPTDLSTSRDLLEDLSISRPSGKPWTENMDLLARYNWLLKTLVRKFICHVVGYHLPASLTDWLLGRDARGS

SEQ ID NO: 1021295 - protein, 96 aa, Homo sapiens
LGGPRARRSNMHFTSSSMVDFFFSEFIFSKHREAMDPIAELLSQLSGVRRSAGGQLNSSGPSASQLQQLQMELQLERQHCPGSTEQLETDATQPGY

SEQ ID NO: 1021296 - protein, 102 aa, Homo sapiens
MAEYELITRIRAVFVIGIYSLPLLEIVLSGHPCSMIINRHKESSVTPGLNKGPFLSDYRTWWTLLSGCNTINHEFWMDIRSCYVDDDEKEHYRWLQQDEDSF

SEQ ID NO: 1021297 - protein, 107 aa, Homo sapiens
YGRSSAAINNDIRPIDVSPSITHKRNEWPREFPRMSHPAHRIPCIPAVTRFLQPLAIIQYCVHVSRAQAVYTDAIAAPFCRQALCQREECRLRRIVCALRLRVIICW

SEQ ID NO: 1021298 - protein, 193 aa, Homo sapiens
TSSCRFLFGYATTVILRVYTYYVSTVLFAIVGIRMLREGLKMSPDEGQEELEEVQAELKKKDEEFQRTKLLNGPGDVETGTSITVPQKKWLHFISPIFVQALTLTFLAEWRDRSQLTTIVLAAKEDPYGVAVGGTVGHCLCTGLAVIGGRMIAQKISVRTVTIIGGIVHLALAFSALLISPDSGFNRLLVIYM

SEQ ID NO: 1021299 - protein, 55 aa, Homo sapiens
MWYGFLLVTPEAFYCADQRASYSNPSSEQQRRRRRKRWRLVAIGEDIRILNGKGE

SEQ ID NO: 1021300 - protein, 273 aa, Homo sapiens
MSCVKSGRGKRRCYGCRARPGGGENMVRRFLCDPPDSARVRAAASEGFLWFTSRGSLGDVGSCQVAPASVALVLMLLRSQRLGQQPFLEDQVMMMGSARVAELLLLHGAEPNCADPCHLTRPCALTAAREGFLDTLVVLHLGLGRGWTCGDALGPLCPVDPGMKELGHRDVARYLVRRERAGGTKRQYPYARIDAAEGPSDIPELNGRTKRGSENTSGKLRSSVTDGSYRAHNVAPRAKESHPRFRRCTLEDELEGIHKQPMVPWPFSERYDY

SEQ ID NO: 1021301 - protein, 502 aa, Homo sapiens
MSVIDATTCPSTLDRECMRVFTSVDDTPSFPGGIRMQAPFKQHVLYATGRLVKLEVRPSGKSCGISSQLRSRVSHHKAPVAPAVNGQSTAFSSIAKGEYHQPQVRRFITARYSIPKAGIGVGGPVPQQGQHDSPSVNAPQATVCLQDTGEGMEAGFVLSSLGPIPQLQHASGSSPGPGAGQINCSSHHRPGPHYSEHVTDLGEVRGFPSLSQPAPGTSAVASHRHVNGPRLQGPVRSAGPRIAPQGRHQRSCNRAEGSAHAPPALRSDTRWKPAQGAGAQRKGGREKAELKEELDGSVREGAVTDLETRGKALFSPNKKRPAIEKEGLREIFLVRLAKLERSRIDTATIQLRGDGRGGEQLSRDLKDRRRPKGGEDARPPQPLSSRCHAPCKPSRFLLVVAAVLWGAAPTRGAHSSELGPQMPALDFARSFQALCGGYLDAKEGLQGFPCGGSPQTMPCRPICPKHPPAPVNGSVFMALLRRFDCNFDLKVLNAQKAGYGAD

SEQ ID NO: 1021302 - protein, 115 aa, Homo sapiens
MHPASLPASCWLWPLCCGERPRPGGLIRANLGPQMPALDFARSFQALCGGYLDAKEGLQGFPCGGSPQTMPCRPICPKHPPAPVNGSVFMALLRRFDCNFDLKVLNAQKAGYGAD

SEQ ID NO: 1021303 - protein, 40 aa, Homo sapiens
LPVHQHLLSSAGENEVWVECLGRGERMREAARWATLPSIF

SEQ ID NO: 1021304 - protein, 348 aa, Homo sapiens
VDRCLTEKKKKNNPRPRKSRAWCLPHDVKRCLSHSALLWPLWALCVDPVETLWFQATGVGLSSPLRGYPRVAPLFCARLCAPGAPCVCALCRGAEKAVRLSLLSEPQRPPERSFVREGVEAEVSSFVCNRTFGRIIRRKSGSRVFLSLQTTEPRGGARAQGGTTGEEGGETVGSRGARDNNNPGRDNTRGKRAKKTEPFLSETKRETPWCVGAHCVRLFRAYVGGENLYQLAERRRRIYPRGGACHIHIEISSLAVLCVQEAAPFYKYKISEGGSEKRKPQRFYKQQGGVSPRRGVRNTSMWRRKNTPKKEARPSSVRKSPTIYTKTAKRGVLLFPPPKGAPKRGAPK

SEQ ID NO: 1021305 - protein, 175 aa, Homo sapiens
EHHGSDSMPLAQVVNTHMCIHSEIHHTQTQQVYWIHDKPSSWTMQTPHAPVQSAETLSRLKASTASPLLSCATSALSDLTQRPVHTESPAIGYTETEKGTAHDNFAVITPRRRKCSLNPTATEIPSKETGPAAPHGPVQTSRHNCALACAFGPGQPMRALRQQMGGAVYSWSKND

SEQ ID NO: 1021306 - protein, 30 aa, Homo sapiens
MRSAGDQRKNLDIVKSLQLGLAYLSIDVPT

SEQ ID NO: 1021307 - protein, 78 aa, Homo sapiens
PRETTLHKLRMNTFTGVNAYRFQLKASGQPGVFWPKTSAKKGNWVLRLGLSNPDRPARQNNWFLPASREIPEHSALTR

SEQ ID NO: 1021308 - protein, 184 aa, Homo sapiens
AGQPAGHVWALSGPATLCPGVEAAQTVSDEEEAGTREGYEEDEEGIGCAARGGATPLSYPSPGPEPPGPELDMPTVMSPCCHIMNCRLDLWPPCRSSCVDGYDACTSWCLHAPYMGPLSCAPCGLPTQSLASPPARDALQLRSQETHTTPQHLRNATEGSKVTEPSAPCQGLWLAIGDLQATFH

SEQ ID NO: 1021309 - protein, 213 aa, Homo sapiens
AAAAESLKQGRRTHNSRRGGRYSLNGLRCTQRKHIAAHRHRKRRKRIKSRSEKKAINHHRYNPGRLPASIRYSARPRSSQRPYPHARPRRSPKRFPRHEARGSSYTRHVGGLCPHPRHTPPTAPNPQPPAPNATPALNSKSAQASNKPKRKENTPLPNANALHVIRNQQPTTRPPREKWPKNRQGTARRRVHPLNLTSAPPPRRSNISPPTRP

SEQ ID NO: 1021310 - protein, 136 aa, Homo sapiens
LKHNHKLQISNKINNSNKNNHNPKPKTPEMYSNPPTRRPNTTNTQIPYDRLNFRTDDSRHTNTRRHIMGETSQPITNTSPHSSKYHKNPITPITKNPPEAPNTTNTQIPKQPTRNPKTTNTKIPHHRRTSEPPHPG

SEQ ID NO: 1021311 - protein, 121 aa, Homo sapiens
KNLPLDISQGSVSYILESSEAFIWEPGVAHTVGIRRQDGTLSGPWTATRISDYHLRIPTLDFVPDTSWDREPPHLLFGPVARECHRVLISKVTPKGSESVSVQGLNYDDRVYLYDNATAPD

SEQ ID NO: 1021312 - protein, 106 aa, Homo sapiens
PGVIMQAEPAPGLLPALCQPLSHPLVPHGPWSLPSARISLSGLVGRGWSRTGWRSGAPWMAGQEGPGRTRSLRTRWHPAPDGLGPTAPPPAFLTAEEIDVACAETG

SEQ ID NO: 1021313 - protein, 188 aa, Homo sapiens
QSECGCLMTRRCTTTCNCPVDSEAAPAANDSANASTDLCDPLTTIDEPQNLQPAKNYVNRHVYGGKVAVCFSADQTRNEEHTIRIEAAVSSGGRSYNWDDKIAIQVSTRKLPSVMATLLQIQNKFEGKGHGAQNEKWFVLENQPDKVFLSVECKWGLLLLDLYRSQPGDCYQVITLVMEQMLKNTFIC

SEQ ID NO: 1021314 - protein, 246 aa, Homo sapiens
EVAFCPGRGSQIAEGPGLQFASCYIHCEEKSLGLGPPSFDENWVLSATGGTEECSWGAFPMELTQPCWKTINPDHSENPCSHNFGDPEDPRRGGLKMAQTLGAIISFPAPSEPVNPDPDANVSSPQGQLPEAVHHSHQPVMEGTKCQLCRHPETPCGIHQLAAQGELDQLKEHLRKGDQPRQQAKTSAVHPPHLGSAFGEIESVRFLLEWGADPQILAKSERAPVAGSTRRYTDIVGLLLERDVDI

SEQ ID NO: 1021315 - protein, 114 aa, Homo sapiens
EVAFCPGRGSQIAEGPGLQFASCYIHCEEKSLGLGPPSFDENWVLSATGGTEECSWGAFPMELTQPCWKTINPDHSENPCSHNFGDPEDPRRGGLKMASDTGGPQNFSLHPLSL

SEQ ID NO: 1021316 - protein, 80 aa, Homo sapiens
MLVGYTGTPPKLHVSRASVGGLLAKSLIGNASQKTYIQRRYHRITSVLSSFFGDHKVRVSNSVEKFPGNSVQKFPVAQAF

SEQ ID NO: 1021317 - protein, 174 aa, Homo sapiens
MGNHFAPEESGTLLANLAYRLLAVGFLICFRRGLLVIVNPFNAPKLSAKRLRNALVTGSALFCLFGAGQLWAFSLDDVSAKAKELAGQKYEAPRSNLPNEFREMKFADYQKIRFRNEKAEWADQNTPFKLSFYHQGMHFDTPVKINEVTADSVHEIKYDPTRFDLHSLCTHSSV

SEQ ID NO: 1021318 - protein, 60 aa, Homo sapiens
WPVRGNYEFYGALMSPVQLYGILWGSNGLCGMRSIGSYGVSTGFQGEVTELCWAATGHSG

SEQ ID NO: 1021319 - protein, 94 aa, Homo sapiens
MGELDHRQLEHEMRSEYPEDCTRCLSRHVLAQLLTAQSSAQIVDYRDHRVEERTGESGEAHDQYIQARASCQRIGKKRQRIVTVRQALTHDSRT

SEQ ID NO: 1021320 - protein, 101 aa, Homo sapiens
MLTWLVPASTSGVGAESAMAAFIIIAAIAGVGHRVAISVEVQVDDLVGLATECIGSQLRTRLECSHGIFEQRIFAGPARGIGGGEVHAVHLQSVGCAFTGY

SEQ ID NO: 1021321 - protein, 70 aa, Homo sapiens
RAGTQQAWAQIKMSGDSWRTLGLSTQETGCAARAQSFSEKLGCLLRNTRKNHKELLRASLEEAPSFPWTL

SEQ ID NO: 1021322 - protein, 78 aa, Homo sapiens
DGLYLDHIGFEHDLLYLDPDQADIWRLDGLEFPNSANFRPARQQIGIGGFARYSYVHILCKADVVATLVGVYGLNMTL

SEQ ID NO: 1021323 - protein, 179 aa, Homo sapiens
CWTERRMTPLNLYLDNANPAQVREALEDYSLAIKQLAAANIFPGDMLLKNFGVTRHGRVVFYDYDEICFLTEANFRHIPAPRTPEDEMASEPWYSIGPLDVFPEEFPPFLFADAGQRRLLDELHGELYNADYWKGLQDAIRAGKVIDVFPYKRKEQLLRQASTASKADLLSPAPSASAV

SEQ ID NO: 1021324 - protein, 247 aa, Homo sapiens
SSVGGGFAGLEFARRRSRSRGLGPGGPPDVDGGGGGAPDSVGAHPRPSAESHPRKSRLDEVMAAAALTSLSTSPLLLGGPSVQPSAQSLAVEPWNGGPGASPRQLQQQTATVETGDGTWPVTILSVQPVTTTLHPTEAAHISCNGEPNLRKRKSPGHSVMSKMSVEGAAGKGAEQGVGDARDTIRLVHLVGVQARALIRVMVQEDFYYTELDVRCGHADRRACQDLTPVSPKATMRLLPQLEVAEWW

SEQ ID NO: 1021325 - protein, 180 aa, Homo sapiens
SSVGGGFAGLEFARRRSRSRGLGPGGPPDVDGGGGGAPDSVGAHPRPSAESHPRKSRLDEVMAAAALTSLSTSPLLLGGPSVQPSSPEPGQVMSKMSVEGAAGKGAEQGVGDARDTIRLVHLVGVQARALIRVMVQEDFYYTELDVRCGHADRRACQDLTPVSPKATMRLLPQLEVAEWW

SEQ ID NO: 1021326 - protein, 449 aa, Homo sapiens
RGWRRRQRVRLRVAHGVGAEPRPGAGAAATGDHGERVGCQLAARRAATAACAGPRGAACHLRPRRRASLLPACWECSLGAWHQYESKFGTGPPGLQPPAPQWCLPEDGACGLPAQPWAHSRSATWKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTWGTRRLVGSGILVANNSRASRLAWPWVDELVYHRRPWMKDGHVCMSSKLRDQLQRIELNMAVGTRLTVGPWRGLHRNYTTNKCQGLKLAGGLWQFEASNNGMPGPTQLSPFGLPKAGNAVTNGPILLFKGSVDSNWISGCHRWREKLANPCPVEQLAHMGVLSLRSTDKETKFSSGGLHGTSSIGLESLPWPNRASNVTFWNSMIHSG

SEQ ID NO: 1021327 - protein, 417 aa, Homo sapiens
MGNVLAASSPPAGPPPPPAPALVGLPATSALAAGLHCCLPAGSAAWAPGTSTSRSSELDPRGCNLPAPQWCLPEDGACGLPAQPWAHSRSATWKCKELFPIQMEGVKLTVNKGLSNHFQVNHTVALSTIGESNYHFGVTYVGTKQLSPTEAFPVLVGDMDNSGSLNAQVIHQLGPGLRSKMAIQTQQSKFVNWQVDGEYRGSDFTAAVTWGTRRLVGSGILVANNSRASRLAWPWVDELVYHRRPWMKDGHVCMSSKLRDQLQRIELNMAVGTRLTVGPWRGLHRNYTTNKCQGLKLAGGLWQFEASNNGMPGPTQLSPFGLPKAGNAVTNGPILLFKGSVDSNWISGCHRWREKLANPCPVEQLAHMGVLSLRSTDKETKFSSGGLHGTSSIGLESLPWPNRASNVTFWNSMIHSG

SEQ ID NO: 1021328 - protein, 123 aa, Homo sapiens
GYRSWPSSLNALFFWAPKKSPFYSTLAQARLREQSFNAAESERKEESLPLYPELGSRALEYPRQEVRAMVYNRTLLWDWLELGSLILDVKRFRFNRGIEAITLGSYLSEGEPIFQKQFGRGLF

SEQ ID NO: 1021329 - protein, 64 aa, Homo sapiens
PESQVVEDVMWRWLHWRGLSRILNEMRDQYEKMAEKNRKDAEEWFFTKTEELNREWPPTGERGA

SEQ ID NO: 1021330 - protein, 231 aa, Homo sapiens
ECEIFREEFLFSSLQEGRDKDTFSKMAMVSEFLKQAWFIENEEQEYVQNCEVIQRWSRISGEPLSYLQSILGMSLPCTKAIMVKGVDEATIIDILTKRNNAQRQQIKAAYLQETGKPLDETTLRNASQVSGKVATSKPAFFAEKLHQAMKGAGTRHKASIRNMVPRSEIDMNDIKAFYQKMHGISLCQAILDETKGIMRKPRWLFGGENKQPLEGLKLGSEEPKINNPIPR

SEQ ID NO: 1021331 - protein, 134 aa, Homo sapiens
ECEIFREEFLFSSLQEGRDKDTFSKMAMVSEFLKQAWFIENEEQEYVQNCEVIQRWSRISGEPLSYLQSILGMSLPCTKAIMVKGVDEATIIDILTKRNNAQRQQIKAAYLQETGKPLDETLKKALTGHLEEVF

SEQ ID NO: 1021332 - protein, 187 aa, Homo sapiens
MGRDPGVEPEPDALEPAPEPLNLQPGGCPGDACHALWADACPARRCSHELRRSSVPGLGHCDALLIDWQQADGLPAGHGSPGLQPRPDLPQAPRPIPFASWAGRCSPTSQVVINCAIVRGVKYNQATPNFHQWRDARQVWGLNFGGKEDAAQFAAGVASALEGVGRQVDPSTPDFHRGGPNGAPERC

SEQ ID NO: 1021333 - protein, 160 aa, Homo sapiens
MGRDPGVEPEPDALEPAPEPLNLQPGGCPGNNQPVGKPPPRPITTVSAPALLGSLPAGHGSPGLQPRPDLPQAPRPIPFASWAGRCSPTSQVVINCAIVRGVKYNQATPNFHQWRDARQVWGLNFGPPAAAGPFAAGPLPSGPPGAPPPPPPWSVRPALP

SEQ ID NO: 1021334 - protein, 392 aa, Homo sapiens
MHTTITTLTLTSLIPPILTTLVNPNKKNSYPHYVKSIVASTFIISLFPTTILHVPRPRSYYLELDTEPQPKQPSFSLSFKLDYFSIIFIPCKQLFEYMVHHRILTVIYKTQTQTLISYFKYLLIFLITILILDIPITNLFHLYIGLGRAYGHPYPNYGIIQYDDNAQRQMPNTADHIKQSYTSRIGDIGFILAFSMIDPTLPTHEDPEHNSHFYKLIQRLSPLLGLLLQQQAYQANKVIDKLTHHQDIEETHHSHQPYFHVRHYQTQERRDLPHADTARSTNNRPYCDTRNKHKSMTLVRKADPWHRTDTHGERVLDTIEEDAPDSTRSKDGKTTQAHKDQNGDGEPEQLTSTTTKASQHSTLNTAQDTPDSKRAQQGNDAQQRARNRKSAQ

SEQ ID NO: 1021335 - protein, 109 aa, Homo sapiens
LLERLPQAVTEYWQALAHGSWHTRQERWAESYAAAFAEQAFMARQLDEISIAGMTLVQQLVDAPDTEARQRAGGSWASVRVSQLMWPGLPAVAIPGAQHIYRDGDPEGA

SEQ ID NO: 1021336 - protein, 314 aa, Homo sapiens
MPCWPAPSICLPASSLLLCAECCLLLAMAAGVHVPHACCCPGCLLWALPGVSMPGVKLTTQAYCKMVLHGAKYPHCAVTRAPGGLRSRMPRNGSNLPPWERPQAAPTKPHTISRDCIPPLPRTPWPISPHAGGGSHPDRFMVQTDHSYVMLVIIKLLSNNTGCQSKPGSQARGLQNRQRLQARNETIKDENSTETMDRKRLRATRTSTREQMGGAEDPTQHKEQNAKRQKRTSTPWKAASQTTEPHTPRYNGKPKNRRNRGGIALWTADAWTAPDYLLSRTYNEKNWKVEGQTKREARNRERSEETVQEAEADQ

SEQ ID NO: 1021337 - protein, 82 aa, Homo sapiens
ACPCANDIHPDCMAICRLGHHVVQPVMGLYAESEGWVRALGCTAQVVVVHFLNGLEIDNSLQLRLMLVHIIGKGALDCLDYK

SEQ ID NO: 1021338 - protein, 120 aa, Homo sapiens
VKAHLLGIARAVGAEVQRITATGVVHVDMATIQKQSLTLFCVAESGVAAFFGHVIGFGFNNSRRKPEIAHTMTNDFSEYFTRKQLGIAVEEAIGQRAGGEQWGKVGHGGQGLIRLNVTES

SEQ ID NO: 1021339 - protein, 102 aa, Homo sapiens
RVVKIAASVPNTLPSNMVNTTYTKTPAGPPRAETTATEILLPLLIMIIILFTIIIIIIVLLRLGLLLTTTIRRSNTYPQKRSRLRRGRQTTYYYEPTTPSSN

SEQ ID NO: 1021340 - protein, 113 aa, Homo sapiens
MAARARSGPHKSHPLSPTILPLRSNVYIHIYPKKPPLPTGLTLKQYYTTRKPRNTLNTSWDTERKLSKIPRNAQVIPKASEVEVKKKKKNLRGGLAFNLFHSELHHNLSVAAP

SEQ ID NO: 1021341 - protein, 113 aa, Homo sapiens
MYRVVIYPRLAIQLKKATLEQPVRNSLNPEKQAAIFKLTTPERHERGIITFGKRQTSYKAIPRPTTVNKNYQKTSRCTYPKSPRPSRTKAHNSTNSNIQSPPPGKDRREHPLG

SEQ ID NO: 1021342 - protein, 217 aa, Homo sapiens
GVLLWRWLSQNQRTFWVVGTWYEAEGSPVKLTRHTSPPSPKLLTQNATPTLLINPPPNSNPTFRPGDSIPRPRSATSNTPPPRSTTLLARRERTPVYNFLKPTHPDSHRHSVSHGASTRIDKRNKIIPSFRVVHIPAIGNALTTAREIRPRRVRHSLNTHSSQNPKNPPPPRETGLGRAAQVGSEPSDPSDFFILIPRAVEIIGVRYRFGPEIPKNP

SEQ ID NO: 1021343 - protein, 63 aa, Homo sapiens
GVLLWRWLSQNQRTFWVVGTWYEFHKKHGIAHKRATLAPYPDPFIYKLANARSPELNRAATLS

SEQ ID NO: 1021344 - protein, 150 aa, Homo sapiens
GVLLWRWLSQNQRTFWVVGTWYESRSTPARVFRLLGYYYEASSSFGISGSPYSLGSRLELDNSRLVDMHLVIGFVDDEVFDVEIIVVVIIVIIVVFIIVIIVVLIIVCKDTLAPFKRAGDSLNGRARFRDGTSPSSSYPAIITYVLRDPT

SEQ ID NO: 1021345 - protein, 139 aa, Homo sapiens
MLESYLGNGVIITGKATTQTSGLQSPKDYELNKIAETLPSEKHTNTSIYNSYGTLKVLRTSRSLLAMTTRELQIHIPGAGETTHPRNPPRIAPQTTNYGLTQTRPSKTRRQTGAQPPPNQPSERTRLRTPAARYLIPRR

SEQ ID NO: 1021346 - protein, 202 aa, Homo sapiens
MSDNEALASEVIGTPKKPFNSGKQTRAITRLRRRERESLTEELVRRSRRRQGISRRLRMGVRLAVLAVLKFRRRGAIRLVARATIFPLVRAWRDRRFLTITGLLLLFSGFLLCPLFRLLQILRLIFLIVIVIRFGLVSGRGRGGLLAGISGVRSYPLLRRPLLRTRLLRILFATVMRRAIVSRVWVVWSNVFARKKRRDVVI

SEQ ID NO: 1021347 - protein, 140 aa, Homo sapiens
LHSYHSNIVLPQYPSIPDGDRSEAPSSPLTWTPPIPPVTPPWHPDSPLSPSLAPRRGGEASAIKRPHPRGPRHPHPDRYRTCDPPGPNPHPLPIGACSPAGVPLGGDYHPPIPLSSQSPVSLELLQDAPSPRNQTRLQCP

SEQ ID NO: 1021348 - protein, 183 aa, Homo sapiens
AKQRWDDRHWSQKKLDEMTDRDWRIFREDYSITHPRWQDPQSHPILERLFSAPTHLEVIDKCGYKEPTPIQRQAIPIGLQNRDIIGVAETGSGKTAAFLIPLLVWITTLPKIDRIEESDQGPYAIILAPTREWAQQIEEETIIVWETARYPHCGCHWWHLQRRPGFRLRMGCEIVIATPGLFD

SEQ ID NO: 1021349 - protein, 242 aa, Homo sapiens
NQSCRRHRTWYVVYTGDRTCDGKNATLDFLGWKEVRPPLLQQIEHFIHIITGVAVFLGCVLSSSCALILEYTWLEAVIFLIGIIVAKVPEGGLATVTVCLTLTAKRMGKGKLLSEELRSCGDLGVHMHHLLCDKTWNSDSEPGMTSGPTWWFDKSTSTEDDTTENQSGVSLDKTSSYLACYCPEVQVFVAGQCFRLIRMNLPILKRAVAGDASESGLLRVHRAVLGSVKDDEEKIRKSSRYA

SEQ ID NO: 1021350 - protein, 185 aa, Homo sapiens
MVKLAEPGLAAAPGPLGPGQLTLRLRACWAQLRRPHGYGMGLYDLSPCLCLFTPGACDVCCCGCLLNLHVGADGSQLTCNGMDDLGDGCLNRSCGLVGMEEVTCALVQTFLIPECHDLLRKLLPCSSITLQPTWSSLTSGNLQPVPQRLGNTLAAGGVGMAAVQLCRTSGECDRVRNGLGQSKPE

SEQ ID NO: 1021351 - protein, 114 aa, Homo sapiens
MVKLAEPGLAAAPGPLGPGQLTLRLRGLAGLNFADLMAMAGAVRPVSLPLPVHSWCMEGAGVVIALGEGVTRTGKARQTGVSGVEPGPGLCARNKVSVPSVPDLPGFLHGPLTF

SEQ ID NO: 1021352 - protein, 124 aa, Homo sapiens
RGFDQQGLNPTTLNAIEQAPSNLTMNPSNYGTPQTHKSNSVGRNYEEQADYGTTKRANPSYSTRSSPGPSRKTTPSPERQNSKAPKLTLDSQTHDSLIAECTVAEKCIVQDHMSDQYPCSCELS

SEQ ID NO: 1021353 - protein, 185 aa, Homo sapiens
VIQATSSADVDGVTCEDIDECALPTGGHICSYRCINIPGSFQCSCPSSGYRLAPNGRNCQDIDECVTGIHNCSINETCFNIHGGFRCLAFQCPENYRRSAPTRCERLPCHENRECSKLPLRITYYHLSFPTNIQTPRGGFSKWAPSNAVSPGTGLALGITRRELKEGFFTNPEGEAPTGGGWALT

SEQ ID NO: 1021354 - protein, 241 aa, Homo sapiens
YLKKGYLTLSDSGDKVAVEWDKDHGVLESHLAEKGRGMELSDLIAFNGKLYSEDDRTGVVYQIEGSKAVPWVILYRRGKGPVEKRLSQADVAATDERKQSSSTVGGLGKEWTTTTGDVVNENPEWVKVVGYKACVDHENWVPNYNALLAAVGIQPPGYLIHESACWSDTLQRWFFLTAEQQERYREKDDERKGATLAAERSPDFGDIAVDTLGAGSQSGSSSFNVHPQTDDQIHVAYNPRR

SEQ ID NO: 1021355 - protein, 101 aa, Homo sapiens
FGGGLLVQTRDYQENAPTENSGGALAKVEDSNPSEDFHYKTGLKESKQPPGLMKSEPESRLEKGVDVKFSIEDLKAQPKQTTCWDGVRNYLAALSGTSLSS

SEQ ID NO: 1021356 - protein, 177 aa, Homo sapiens
ERRRSVGRQRWRQRRQEPRDRQKYTGGRRRKESAVLSRKHTLLHLAPPPPLCAACPGWAPEACSDCYVTARLREDRGQGTKRLSRGKPLRTKFRGHFCSASLLSSRPSPISAALERPEVLFSSSRAQPPRFPATMVTMEELREMDCNVLQNGMMNRDENGGGAGGSGSHGTLGLPSG

SEQ ID NO: 1021357 - protein, 204 aa, Homo sapiens [sequence omitted]

SEQ ID NO: 1021358 - protein, 459 aa, Homo sapiens
MAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 1021359 - protein, 87 aa, Homo sapiens
NEPATTRYRRDRPPAPAGNLSAVGNIGDGTLDQLSLNVIVPLDKFGISGARFTFRNDWNKTSVTDPTTGEERPISRVRASQANVGFQ

SEQ ID NO: 1021360 - protein, 100 aa, Homo sapiens
MLRSIFCVCLVSLTCFISSAKANFQPRATFSSSLQSIKPASIDDVIDRAHELLGTPYKWGGTSAEQGFDCSSFLVYLFKTQANIQLPRTTAAMHRSSLPW

SEQ ID NO: 1021361 - protein, 84 aa, Homo sapiens
DGRGEILAFVGHQVGDGLGLAVAKVRTDQVGIVDPAVIDVLVGLHLGLQLLHHVAFLQQVVGQLDAGDFTEGLGQHLGFVLVVI

SEQ ID NO: 1021362 - protein, 119 aa, Homo sapiens
MFLRSFKAPQPANDMAMASTTLLCRDEVIVYSWIIERAGRIQYTRSTRFSVYSTTFRFTSEVERERKSNFTALLKSLFNDALTVTGTSTDASHESCQPSLVAHLTKTRRSVTSLSDTTH

SEQ ID NO: 1021363 - protein, 202 aa, Homo sapiens
MALFGALFLALLAGAHAEFPGCKIRVTSKALELVKQEGLRFLEQELETITIPDLRGKEGHFYYNISEGEGSQSCNLNIFRARFPATAGADASISPDASLGLLFLRQLLYWFFYDGGYINASAEGVSIRTGRGALPRDPAGRMKVSNVSCQASVSRMHAGFGGTFKKVYDFLSTFITSGRVLLNQQICPVLYHAGRFLAQLPP

SEQ ID NO: 1021364 - protein, 153 aa, Homo sapiens
MALFGALFLALLAGAHAEFPGCKIRVTSKALELVKQEGLRFLEQELETITIPDLRGKEGHVKSMRSVYDSINSGMRFLLECVYGVLLTVVRSSVDELVGIYSLMKDPVAYTSNDMDFRGRFFLTERNWSLPNRAVEPQLQEEERMVYVAFSEF

SEQ ID NO: 1021365 - protein, 276 aa, Homo sapiens
MGRKRLITDSYPVVNEEGGAVWAQKGELAPELGEEPQPRDKEEADLELLRQFDLGWQYGPCTGITRLLAAGVGAKQMWLEVDLPLEVWHGAEDSTRRPHAFRGGQSSGISIPYEARTERPPGLSSLCLTQPRTISDEKLRAHCSCFSSARAAEEPLAGRGCTVSTRPFNSVRSNQWLQESPEELRVLRACVSGWIGPVVTAGLRPWCIAFPIACCLSSLDPMILGTVRARSAVGGVVPRGGRMRVPPAGRASWHPGWACAHTPRGSPLWFFPADFG

SEQ ID NO: 1021366 - protein, 89 aa, Homo sapiens
MGRKRLITDSYPVVNEEGGALWGLGVTSGMGGAVRAGEDLDDLLDNLNDAQYMRTELVQQAHTAVDRADCYLDKLYDMAYKDSTWNHAN

SEQ ID NO: 1021367 - protein, 202 aa, Homo sapiens
LRLVRPVLIGRGSSPSHDSSHYMCRRLCLRSPGHGSVASTPIVPPCPVSAAHHACALLLPTIRFFMPEACLPASPMLAAMDVLPLFCLVCLSSAHLSILQSLVPAAGSSLYLVCHHVPSTKCYHAIVNSCAEPLCVLVMLGHVDPASQLVVLVMARRLWETPPVPLPPWLPMRSLCGMPWMGWASSGCGEPLAGDGFSDWMT

SEQ ID NO: 1021368 - protein, 196 aa, Homo sapiens
MAAIRKKLVICWVMVPVGMTCLLIVFSNGSVSVMVYVPTVFENYIADIDVWTVKQVELALWDTAVAVKSYDSDMLCSLSYPGLLSVRVLHVLLHLISPEQPGENIPEKWTPEVKHFCPNVPIILVCVNTEGPECKTEQHHVRELANDECSDALFGLSEGLGHGNLDHVPLATLSAQPNDKAGVREVYEMATRAVLQ

SEQ ID NO: 1021369 - protein, 93 aa, Homo sapiens
FKRRDLAFGLAMSTNNMSDPRRPNKVLRYKPPPSECNPALDDPTPDYMNLLGMIFSMCGLMLKLKWCAWVAVYCSFISFANSRSSRGHEANDE

SEQ ID NO: 1021370 - protein, 93 aa, Homo sapiens; identical to SEQ ID NO: 1021369

SEQ ID NO: 1021371 - protein, 93 aa, Homo sapiens; identical to SEQ ID NO: 1021369

SEQ ID NO: 1021372 - protein, 164 aa, Homo sapiens
MNKRFNNNVPVIITTLTRFEIMVSVPYGLEALGSSLSRRIVDLNSAGNYETLLGDSMSSGCRLRAWRLDCVVTALTGGRYSAQPAPGLGQRVANSTRLIAECPGRWRVGSRRGRTPRWRPFRWRMRGLRRHWPGGFRGRWSGLRGIGCCLGVQQAQRRRMGASD

SEQ ID NO: 1021373 - protein, 72 aa, Homo sapiens
LEDPTGGLVLFFFFTALATLTVAILLIMEGLSAFLHALRLHWVELQNKFYSGTGYKFPPFSLEHIREGKFEE

SEQ ID NO: 1021374 - protein, 286 aa, Homo sapiens
QGCGGRNGVSFTPPSSSWSSSPTASVPSGFSSRTGGGPPQDTTRLPSSRGLAMATHGQTCARPMCIPPPYADLGKAARDIFNKGFGFGLVKLDVKTKSCSGVGILNAPDQLKQDTGKVTGTLETKNKWCEYGLSSTEKWNTENTPGTENAIEDQNSQGLKPTFETTPPPNTGKKSGKNKSSYKRECINPGRDVDLESAGPATQGSAPGYEGWLAGYQMTFDSAKSKLTRNNFAVGYRTGDFQLHTNVNDGTEFGGSIYQKVCEDLDTSVNLAWTSGTNCTRFGHCS

SEQ ID NO: 1021375 - protein, 300 aa, Homo sapiens
QGCGGRNGVSFTPPSSSWSSSPTASVPSGFSSRTGGGPPQDTTRLPSSRGLAMATHGQTCARPMCIPPPYADLGKAARDIFNKGFGFGLVKLDVKTKSCSGVGILNAPDQLKQDYWYSNWDPGDQKRSGVSMDRLAQKSGISDDTLGNSRSVAIEDQICQGGKHDNLEYYSFTRKTQEPKIGIIHVVRCHRGMCTKPLCLLRVRGLDYAWTDASPWVQQYYGYEGWLAGYQMTFDSAKSKLTRNNFAVGYRTGDFQLHTNVNDGTEFGGSIYQKVCEDLDTSVNLAWTSGTNCTRFGHCS

SEQ ID NO: 1021376 - protein, 273 aa, Homo sapiens
QGCGGRNGVSFTPPSSSWSSSPTASVPSGFSSRTGGGPPQDTTRLPSSRGLAMATHGQTCARPMCIPPPYADLGKAARDIFNKGFGFGLVKLDVKTKSCSGVGILNAPDQLKQDYWYSNWDPGDQKRSGVSMDRLAQKSGISDDTLGNSRSVAIEDQICQGGKHDNLEYYSFTRKTQEPKIGIIHVVRCHRGMCTKPLCLLRVRGLDYAWTDASPWVQQYYGYEGWLAGYQMTFDSAKSKLTRNNFAVGSCEKTFNRKDHLKTTSRPTTPQAP

SEQ ID NO: 1021377 - protein, 154 aa, Homo sapiens
MCPGYQVDLDSEHVQKVAEVCVSASLQCGMELPERLCSCTWWSAANLPEEQLGALLAVHAQHCSSRPSVCPHTRLKPDTFRDQAPGALHTPMNLVGDLAKLVYGSQRPLLDSCEPKQQGAWLAEGMLNYTVDGVDVAISTSALATSLNSRVLMQ

SEQ ID NO: 1021378 - protein, 112 aa, Homo sapiens
SLEVPPSYTSGEAVVVRRRARVGRRYRLVISSRGRRRPGRCRPPAPASRISATRPCRRSKWRPTRVRLDTFTGKHLLQQLALHQIFRFVDSLHGRTFLFVLAAHYSFSLRVS

SEQ ID NO: 1021379 - protein, 30 aa, Homo sapiens
MPVTFSKSALLLALMLGLGQAQAAEPDIRT

SEQ ID NO: 1021380 - protein, 144 aa, Homo sapiens
MSMLLGIVDEDRCSCGLVCFIAQAHRSVTTCKDSVRDEFSTEVVGQCRSKLVHGSTVVAMESLPYRRTSLVMALSSSRIARMDAGLLAKGVRPTFVSGEFGPRADSAEGIRGGLAERMQRTQTWTAGRLSFQGTVKESQTERMS

SEQ ID NO: 1021381 - protein, 51 aa, Homo sapiens
MGEPTGPAEAEHDGTRAVENHDHGADNTMNRQTLSDRRGSLEKTPPKPWQV

SEQ ID NO: 1021382 - protein, 99 aa, Homo sapiens
DPPLIGAVRVRCTDVTQLDQFAPLDSVMHQAAPLQRDALPRRTASSTRLESLLHKPLRSLPISTPAASHLRQPGLSVVDDGAVDHLLRRLWQAPTIEMR

SEQ ID NO: 1021383 - protein, 112 aa, Homo sapiens
MAVTDKTNDQQDRKKKDRQQAAKQNSQKQKRHEHNIRHRKRHRTNHTAPLTQRHPKRATNCASHPAKNTQLDERETRTQQHQMAATSHDRNNGNRRQSHTDNEDNTTRHNTT

SEQ ID NO: 1021384 - protein, 116 aa, Homo sapiens
SSSARSRETVHDKLTADHRDQPQNKIELQTPSSKSGSAVSARVVNVLVSAETVIQDSPPCSRANVDAKSRTPRTGSTAISALNQAFGALRVSLPSVWFLTARTSGCNLIKPSSAAV

SEQ ID NO: 1021385 - protein, 392 aa, Homo sapiens
AGGLPRGAARPSASGAWLASRSRGPPVPRCRARRGSPLCGPGAGLVSAGSALCSAGWLPRCERPVVSFCAPRWSAGDGGVRPCCRRAPRLPPFRSTWSVERARRALPRPRWSSRASARAGERCGAPPSSPASVAPARVRSLAAAVVVVAARGVDALVYAGAGDGAVLAGVARRLSVCRGDMSRGGGGGGGWRGSGVGGGGGGGVGGGGGGGGGVAAPIGAELLYSSKVRVPEREAFAPFVRRSRDACAQCDACARAVVSVSVITSALHRAADWAKSVFSSAALGDPRRTARLVNVAAQLAKYSGKSITISSEGSEAMQEGAYRFIRNPNVSAEAIRKAGAMQTVKLAQEFPELLAIEDTTSLSYRHQVAEELGKLGSIQDKSRGWWVHSVLL

SEQ ID NO: 1021386 - protein, 116 aa, Homo sapiens
CTHSKYVPLMSLKHTPRQVGSGKIHLQKFPWFGQTRLFECVIGKHGLFGPLLRAKFASSIMSCHLKGEHCSAVPCSYLCQDLFFHTVQLTNNVSSDGNPFGIKVVVTNCSVNVKAC

SEQ ID NO: 1021387 - protein, 114 aa, Homo sapiens
RCLNGLLPQVAWDWNQEGVVALRCIDLQVADVFLGGHQGIHQLTGARWRKAPVGGERHYAELGRGVLEGFRQVVIVIGGRVEVVQGLGHQQVGIGVETPRGTPLALGNCSVAFH

SEQ ID NO: 1021388 - protein, 146 aa, Homo sapiens
RHPGPGAQWGPVVVLTSPCCWIGALQSYRAHWGPLGVAFIGNRLFQFWKDQLLLDSKINIRSATDLVRPGRMLVGYTTDTGNPVHIPDEDLMRHGFILGQSGVGKTVLGKLLMFQQIQRGGGLTFIDGKMNADDLQTIYQYCCWAG

SEQ ID NO: 1021389 - protein, 208 aa, Homo sapiens
RLELSTPLASYRVLGLKVTHCEGMIKSSLMYIELLHPCGPQLTEVFPKNLERLLQELLHGVALSHLDCPPVAQMPSQELKVISISSLLIFSLLGFPLLPQFFPEADSPPPHGLDQARSLCQRLGPSPVFLFFVVISSLSNLLLIIGRLLFLLASLFFLLQGEGQAGDPSSLRPFLRSFSRSFSSSICSSLDCSFLRSCFSRSFTRASR

SEQ ID NO: 1021390 - protein, 129 aa, Homo sapiens
RFFVNSGEVSRNEFDGFAKPLLLHARAYAWAPRIFRTQRSLFEQDISRQRGIPFSIRELNTSGELAPAAERDEYVPVLYSQTQSLLGSPLGFDLLASPAPCSAGACTTKRPLVGVTAHAIVSEYRRYRL

SEQ ID NO: 1021391 - protein, 249 aa, Homo sapiens
LGSEAGFESAEGSLVWRCGSWGLTGAAAYPLRSTPSMRPPWFWSPVIMLVTPLLGLTVPVWLAKIAEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDGPVRLNVEG

SEQ ID NO: 1021392 - protein, 317 aa, Homo sapiens
LGSEAGFESAEGSLVWRCGSWGLTGAAAYPLRSTPSMRPPWFWSPVIMLVTPLLGLTVPVWLAKIAEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDGPVRLNVEGDAPGGQDPPKITVDRYGVEESTEPEWIQVKSELPWIRLQSPLEEGNPSSNTIRGAAGHATGALEGSVM

SEQ ID NO: 1021393 - protein, 283 aa, Homo sapiens
MTARYEAGFESSPGVSRVRDSSSLVAASLAGVVDVLWPPPEGVWALTETPEVAGMGWAGPGCARSSRRYGTDVHNVLPALGLVGLWAKCWHLCGCCCRECCVADVSATWPGLEWRPAGRGLPVDALSHGCIPGRGMPLGQAAGGLSACVCLPVSVGDQIICPSCFSGLQTFVHHVFVNAPVTCTHQLSTDGEGTDATLLELRRYRKMATNFLAHEKIWFDKFKYDDAERRFYEQMNGPVAGASRQENGASVILRDIARAEEDSNPWELGPASGARGPVSLSVR

SEQ ID NO: 1021394 - protein, 299 aa, Homo sapiens
QSVPAAPSSRPGLGLAVVYSLRPNRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLGEELAWPPGHGPTDPARISHAPSWSPQPRSQPHQQRMTRMMTLTCMAVTMRRRTRRRHSCGRSGYGSTRRRRPRSLHWWPKSSILLDVKPWDDETDMAQLEACVRSIQLDGLVWGASKLVPVGYGIRKQIQFVVEDKVGTNQMEEEITKFEENVQSVD

SEQ ID NO: 1021395 - protein, 307 aa, Homo sapiens
MTARYEAGFESSPGVSRVRDSSSLVAASLAGVRKMATNFLAHEKIWFDKFKYDDAERRFYEQMNGPVAGASRQENGASVILRDIARARENIQKSLAGSSGPGASSGTSGDHGELVVRIASLEVENQSLRGVVQELQQAISKLEARLNVLGEELAWPPGHGPTDPARISHAPSWSPQPRSQPHQQRMTRMMTLTCMAVTMRRRTRRRHSCGRSGYGSTRRRRPRSLHWWPKSSILLDVKPWDDETDMAQLEACVRSIQLDGLVWGASKLVPVGYGIRKQIQFVVEDKVGTNYMEEEITKFEENVQSVD

SEQ ID NO: 1021396 - protein, 196 aa, Homo sapiens
DGCYPSTIWQHAHRVIGEHGGIFHAALAQADTSAVLEIDSGDNQHLANLIRYSAMLGKSGFLKRPQVAFDAFEPFFKERLRVENRPVVIMRRHFGGEQLKNFGDLERAQLELEAVFHEPLDLVGSLTLLLGREVQDRRLRLPGHLPATIPRGEILQQLQAMGMAFLRVKLHGKARTIGQCGGKIDAVMPATCTDRR

SEQ ID NO: 1021397 - protein, 106 aa, Homo sapiens
GGTAILRSRVIPEPLPPKPEVAAHIPGLSIKRNGAKPDNIWSGFRQGPDGNCVTVSAIKAAMYRFGQSPTDIFRSVRKEPGGYHVVMRDDFQLRLTDSELAQAAQG

SEQ ID NO: 1021398 - protein, 265 aa, Homo sapiens
MARDSSRLKFVTDGKLNEEMEFPSVDEDARLGSIKGTEDMSVVGPYTYYDPKLFCSGSPSGGMMMNDSSDEESIKDDSAVATACTSSQQNDTMIQYRQGGCLEYCRGTDGIATDCHPGHAEMKRVPGSGVFLGYCRPESWVQTLSFDEREQHHELLTSMTVEMRLPMSPFKMKVIPSIHPGRLAMEATYINHNFSQQCLRMGKERYNFPNPNRFVEDDMDKNEIASVAYRYRRWKLEDDIDLIVRCEHNVVLTGANGEVSFINIK

SEQ ID NO: 1021399 - protein, 82 aa, Homo sapiens
GSRELSVNYAPRAGQKPNLDSNAGNSKNIGNVGITYQKVYLAMIGNLLHRLLFNIKPDQCQEGDQAAVLQQIHRAYRFALRF

SEQ ID NO: 1021400 - protein, 48 aa, Homo sapiens
LHRHPVHRRDHTIIGAGAASGGVMDASNLLKPLLSSGDILLHWLEQVG

SEQ ID NO: 1021401 - protein, 37 aa, Homo sapiens
INDIKPHQTREHPHVSTPYPPFSSYPSTPTSLPGFPL

SEQ ID NO: 1021402 - protein, 318 aa, Homo sapiens
PGLATAPRRPGRSSCGPADPSDGPPSACGSRRAGLGCNQCGFVWDAHIPEAIPGSANRSAAGARGGEISWPCDPTWAGTGMGRQCECWRAWLGRWCCALRGSCSYGCQQDRTGPALVPAFALCRGLWRMRRNMEARAAWRVHRNLRLHHWTIEAPQAQPGMETWQASASESTTELWKKQRVPKATAPKPPKMRDDGHPEDTFMNTVQERRQEVQGKVGGELQHVPPIPGGGLEAERRGRDQSWSPLCKATTDTPKSPRHDLEIPPRRKMKWEQRGPWALEGREIGGQAAKRDGEGSSTGPVERPKQKRPEDRPVSHLK

SEQ ID NO: 1021403 - protein, 48 aa, Homo sapiens
DYMHRTYEGILETAEAEACELIVMGSHGRKGVQALILGSVAQKVLTHA

SEQ ID NO: 1021404 - protein, 241 aa, Homo sapiens
MAEAGPQAPPPPGTPSRHEKSLGLLTTKFVSLLQEAKDRLCLTSMLAADTLAVLPEAADLLTLPMFLDTVSGLIENTQSKNSIQWKGAGRLCCNYPGTHLLDKLIELKAEIEELQQREQELDQHKVWVQQSIRNVTEDVQNSCFGLRSLMKDICRCFAGDTLLAIRAPSGTSLEVPIPEGLNGQKKYQIHLKKCEVVPFEVLPGEPRSAWLLTPCGDACATTEDLLTKPSAVLHLHSGQLA

SEQ ID NO: 1021405 - protein, 390 aa, Homo sapiens
MAEAGPQAPPPPGTPSRHEKSLGLLTTKFVSLLQEAKDRLCLTSMLAADTLAVLPEAADLLTLPMFLDTVSGLIENTQSKNSIQWKGAGRLCCNYPGTHLLDKLIELKAEIEELQQREQELDQHKVWVQQSIRNVTEDVQNSCFGLRSLMKDICRCFAGDTLLAIRAPSGTSLEVPIPEGLNGQKKYQIHLKKCEVVPFEVLPGEPRSAWLLTPCGARALVCPHICNMRSRAHLAVYYTYTPSCPRALPSRPSSQCKLYTFQIEVLKLNSHLAVPWAVQKSTAMAGPAAEITVEWRPWALKQGHVVSSVHSHWDPTTLDTRPLQSSALAGQQHAASRQQQAAAAATSKQQAVRPDPTLLPPLSPSRQTLQVYSELPIELSEIFDPTRECM

SEQ ID NO: 1021406 - protein, 90 aa, Homo sapiens
HRFRETGREATKAEEVLAVHVIELGEVVAAGDLVSELVVNAAEVEVLAGSAADKTAVLVVEGDLFVVSGIAVFGFIQAAAGKHQVLEFFG

SEQ ID NO: 1021407 - protein, 154 aa, Homo sapiens
YSDRRYSDRQCGRLAGHAVLEVVQGRDLACTGEHALHVVQLLGVATIGDDHLPRHGRLDAGFETIDGQFHGFAGGDLLDQWVAHHRQDDGYGCHDRLAARQIHRAQARPQEDGEGGVGNERQHDPPGKVLGGVFAGFRDVRLEHDEDDALGESC

SEQ ID NO: 1021408 - protein, 221 aa, Homo sapiens
FHHADNRRCLEVQVRVFFVSEGQHLLQRFNGVGARGDDVIEHGQLVALLVQLRRGVARVAVEAHALAVGRLADDQDKCGRLAGHAVLEVVQGRDLACTGEHALHVVQLLGVATIGDDHLPRHGRLDAGFETIDGQFHGFAGGDLLDQWVAHHRQDDGYGCHDRLAARQIHRAQARPQEDGEGGVGNERQHDPPGKVLGGVFAGFRDVRLEHDEDDALGESC

SEQ ID NO: 1021409 - protein, 40 aa, Homo sapiens
QARPYHYCTVATGLKDTGGARPGVLHLEEPDGSRSHLLYT

SEQ ID NO: 1021410 - protein, 334 aa, Homo sapiens
WLLNNFNGLIVGVTREVCWPQGFFRGHPQSWLVQGGRAEWASSFSSRKGLGRLPSEAPGMSPSDHQWQPQLLKGRFCPPRGAYPEFQQKDRGGQDVANFAIDSRLYPDAQSAALGVIFSSVGRFYCHRTFLFSHWGDWSANVRGWALACNRPLGPGEISVQAGESRGNREQSPKGDWFWQGTESPGKKVSGVSPRAGVWVQSGAGATEAGDRGYGRAGGSVNLASQGGGVSSLAPSRWVKDVWHRCDVIRGSIAMSWSKDPCFGRAGGEPGTGSHRQDQHSRGPWGHVKKRGQEPPNDAEEAPRYGKRGDTKNTKQGREKKNAQKERNHDDNTT

SEQ ID NO: 1021411 - protein, 136 aa, Homo sapiens
MLLVSWLSSQYSRFSVQSRSDGINAVGTDGVHSSGCLMLLRSEQGQSAARVQRANTGVLEQGLEQTLQNPLRGVELPGTRVLHVFLIMQVGDLFNLKVNGIRRGPGSVWPGKEDGVPVVAQYTVEVPGVLVVGTEF

SEQ ID NO: 1021412 - protein, 136 aa, Homo sapiens; identical to SEQ ID NO: 1021411

SEQ ID NO: 1021413 - protein, 41 aa, Homo sapiens
MPKVQPAKVVTIQLQVQQPQQKNPDCTTTTIIAATAPAATL

SEQ ID NO: 1021414 - protein, 188 aa, Homo sapiens
MDAVNMDLENKCEEDGLRSLSNGFWMPLCLKLHKQIIVECDSELHFWKICRNCKCGQEKDVLRNKDKKLFETKNTLIAKKKDGMKNVKKTNPVAAKKISNKTYEDPPDKQELARKMKLKEKQKVAGSEGAQYRKKQLAKQLPAHDQDPSKCHELSPREVKEEQFVKKYKSSGEEEMSNFPVRWMPKAP

SEQ ID NO: 1021415 - protein, 121 aa, Homo sapiens
MVRGWVLGAGPLRRTGRRKFDGAGRVAVERRRGSSCRFPVFAAEPEAAEPGLCGSLDRTDGCVDPYGLLLTCDLENKCEEDGLRSLSNGFWMPLCLKLHKQIIVEVILNLQLSWQQTIIVR

SEQ ID NO: 1021416 - protein, 71 aa, Homo sapiens
MLEASLSQLEQLVSDLVQQNQELLGSNESLKAELARAKDENDSLQLNLMEQEEKHGATAARIQALGLRWCG

SEQ ID NO: 1021417 - protein, 193 aa, Homo sapiens
GQSIAPPRGEARLVSSSHHTPEDTHPHRCTSTRDPSETRLVGSREPTTRPEGKPPQARRNAHRGPNIRFRKSNGLTNTALPPSPLGRPSPDSSSLRVRLPETRERIAPLNLPASGPGNSRRHQFYKQHPPYRAPSIHTSTSNTSYFNFSPAFLATGFRTPTTPRPLSARPASDKILYNHTDERDLREDWTSPS

SEQ ID NO: 1021418 - protein, 138 aa, Homo sapiens
PCRRGGAGAGRATPAGAVRGREPAPPWWRRPLAVQRQTHRVGSGLQPGREGGDRVCGAGTRGLGGARNTQCGAAPGVAGASARLTRSPRGVRRRPMGQSPFQPDRGDDNDAVAQSVDTPDWTAWIEACSRPDMWFIQR

SEQ ID NO: 1021419 - protein, 189 aa, Homo sapiens
MGQSPFQPDRGGGRRNAGGQAVETPGLEGPRRTRAPSPEVYEIRHLWTTAQGGFSTSVGVLMGRGFRPIQRGLNEIETVTFRQTPSTELTLNVDGPVAKPEVGAWVRVLLGEFYPLPYPLLFHLLGAAIWFHPGALRVEIVLMEDGAEMTGVEGFEGFSCAKESDTFGLTAFRRVELRGTGTRGAQAGL

SEQ ID NO: 1021420 - protein, 220 aa, Homo sapiens
VACTATYHAVCHSRTGTKNMQESDLHTAIMRSKLELESNGIDLGSSSSMAFHVGNTMTSCPAVMVLPSLPGWSHGPHQQLLKPIHADPVAPDTTFDELWKCTQQHYGLTAATVITDAAGIPISKIVVGAWVHVGSSKTTNLASLIGMRFFPRTLIRQPTMDRMAKATSGTVRVFGIIGRGMPFVAAGLAVFDLVSIGKCAYEATNGRSLARADISEKVIS

SEQ ID NO: 1021421 - protein, 147 aa, Homo sapiens
CPECGKTFTVRSNLTIHQVIHTGEKPYKCPEAPECGKVFSHKSSLVNHWRIHTGEKPYKCNERGKVFKHRSYLMRHQQTHTGEQPYECSECGGKAFFESAALIHHYVIPTGEKPYECLECGKAFSHRSYLKRHQQIQTGEKPITSEF

SEQ ID NO: 1021422 - protein, 116 aa, Homo sapiens
CPECGKTFTVRSNLTIHQVIHTGEKPYKCPECGKVFKHRSYLMRHQQTHTGEQPYECSECGGKAFFESAALIHHYVIPTGEKPYECLECGKAFSHRSYLKRHQQIQTGEKPITSEF

SEQ ID NO: 1021423 - protein, 90 aa, Homo sapiens
TRYRSRETGRTHVVEHVVTNLMKYTMPAIDDLTQVQTRDRIDQAELGRDRTLGHVRGQIDIEDIAAHTDGDVLVSRTDVVVTGEDHSALL

SEQ ID NO: 1021424 - protein, 257 aa, Homo sapiens
PRRAPPRLRPGSRLPERSGLARCPGPECVPWMAPGLAQAAAGESDSRKVAEETPDGAPRSAPALRRCRRSRLFTACRTLTRWPPLGTGTFGRVHLVEGEGQPSIFFGPQGDEHSRAVIRLKQEPTRSHNEKSVLKEVSHPFLIRLFWTVGMKKGLPLTYASLELRAGRGRLFQLPCATGGRFSRHQRGLFYSAEDPSCATRGYRALQRGLSTGDLDRRRHSCGVGLRVRLGLGSAKLLPACPLDPGSTPILGARGRI

SEQ ID NO: 1021425 - protein, 226 aa, Homo sapiens
AFSSQLLLKQEGRREDSINRNLIGDYIGMEEHPEAPGSFVGNDGEKIDFADTATKYDRRFKVCKARTAPYPKVLVLLLGREKRQTGSQRRVLVKRRLNRNNRDQNGSCLSSFIARQDDMIILHEQEYDSLLESVFKTEFLSLLAKRYEEKTQKQLPLKFSNTLELKLKKENWGPWSAGGSRQVQFHQGLGDLAVLKPSNKVLQVSIGPGMAKNYRPYRKNTTQNTG

SEQ ID NO: 1021426 - protein, 35 aa, Homo sapiens
KSSSVHGHEQQHNDRQVITSGITNGAVTRPPNSVR

SEQ ID NO: 1021427 - protein, 48 aa, Homo sapiens
MQQGPGKPVGRTYTHSPQARIFGAMDTEACSATGEVLGSVPSSGLSQA

SEQ ID NO: 1021428 - protein, 260 aa, Homo sapiens
GQDMQVEACLIGRGEASVPRDSLLKLSIACRHIILAGPRRPPGGQKRSAEHHAAARRAAQALLVSACHPCCPVSLLSPACLRTVALLPSSTPGPCPALGGAGPPGLRFGPVGRRATRAPEAGGRLAIGGGAVEQAAAGMAQPGPVLNCGGTRIHTTGGLAHSYFGTLGRLLASETEVARLLQITFDSQVTLLVIANPGSTRGARVSQAPGAALPDREAHELCAQHFVGTGPVFAPGCTGGKSPLPWAHNKRWRGRFKGVT

SEQ ID NO: 1021429 - protein, 134 aa, Homo sapiens
QDCLRHLTMEGAKKRYGEITESIQERLDFELLTISNSGYPGYFLIVQDFIAEARKMDVSVGPGRGSAAGSAVAYCLGITNIDPIKYDLLFERFLNPDRVSMPDIDIDFDDEGRGRVMEYVINKYGQKQVSQHSL

SEQ ID NO: 1021430 - protein, 47 aa, Homo sapiens
RAGRAGPWNLVETWTPVKGGNLAESVLTDSLQDYPFDGLAAAWQEPA

SEQ ID NO: 1021431 - protein, 112 aa, Homo sapiens
AAGGRQAIPPAVRPMRGRPSPDGLWLLLSGGGICGGLGGGADPGRKRQLRRRRRWRLGRRRIKGPPPGDAVTAAAGPGAEWAPALSPSRRTRFPQLSIFSCRPRSPRRPQAP

SEQ ID NO: 1021432 - protein, 77 aa, Homo sapiens
MDIARDGYVYRDKAWVNAGKIAEEVAKSITWNAQIYEAWTYGFASKIHSICATMTCFDAEILLIASGFQNQDLSELS

SEQ ID NO: 1021433 - protein, 304 aa, Homo sapiens
LNVWCSYVIIGGDYAKVQRRCVIMCQGTKTVRQNLEPLFEQYINNLRRQLDSICGGNWGLPVTHERTSSCLDLCVQDLKNKYEDEINKRTAAENEFVTLKKDVDACLHEQVELQSQGQTLSQNEINIPEEPCMTAELSQIADPSSQDTTLCVLSSGQATVNLDLDSIIAEVKARSSEEIAQRSRAEAELLWYQTKYEELQVTAADYGDDLGNSKQEIAEINRMIHEAGSEIDIVKKQCANLLAGMLDAEQRGEMALKDAKNKLEGLEDALQKAKQDLSRLLKEYHGADECQAGLDVEIALRNVR

SEQ ID NO: 1021434 - protein, 322 aa, Homo sapiens
VGLRNTLARSRALDIQFASFIDKVRFLELYNKVLDTKWTLLQEQGTKTVRQNLEPLFEQYINNLRRQLDSICGGNWGLPVTHERTSSCLDLCVQDLKNKYEDEINKRTAAENEFVTLKKDVDACLHEQVELQSQGQTLSQNEINIPEEPCMTAELSQIADPSSQDTTLCVLSSGQATVNLDLDSIIAEVKARSSEEIAQRSRAEAELLWYQTKYEELQVTAADYGDDLGNSKQEIAEINRMIHEAGSEIDIVKKQCANLLAGMLDAEQRGEMALKDAKNKLEGLEDALQKAKQDLSRLLKEYHGADECQAGLDVEIALRNVR

SEQ ID NO: 1021435 - protein, 223 aa, Homo sapiens
SRGPPHHSQYANQPRPGTGVRAAAVNLFGQRQLGAAFAILADLEQQLGAALFQPGVVGTQRSDLRQHRIQRFTGFKGLLALVQEQKPVHILTAAYPTRLGAELDFFIGVDAQICQHEFRPVLVQIAEEHQAQAITQLHYRQAVERVVYVGAPLGKAARLGKLRGQRFKPIGLVTLGLIDPGLEGAEQFTLLQQREQGGKRQRALILHPSQLTQGPRRRMGLRD

SEQ ID NO: 1021436 - protein, 83 aa, Homo sapiens
QEIKNFVILCLKAPCNSLRPRRIQSRVSHVVSPESTSAALPVNEIDTVITLRVSAPSRRAGMMIVLTSDTIVSATFLPTSLSL

SEQ ID NO: 1021437 - protein, 103 aa, Homo sapiens
SYAPSHIGGTTEMMHSSTGNQKFVNLCSSEAPDHTAFRGQYGYYLALAHVVSPESTSAALPVNEIDTVITLRVSAPSRRAGMMIVLTSDTIVSATFLPTSLSL

SEQ ID NO: 1021438 - protein, 624 aa, Homo sapiens
MAMAPARTMALLPASPRAFIPACLLVASVHSRASSGTHVPGPPALLHPCVLALLCEPDFLNMLYLPCGAWLLFLDTNCLCVINWSYLPGCPPPVLPWAVTAFSPAAPPRTATFLYVDAACPTCVGWTAICLPASSSTASTSRTIVCKFCAHVDGLHQLPHEGMCTAPTCQLRTQGFGGSGIPKAWAGIDLKVQPQEPLVLKDVENTDWRLLRGDTDVRVERKDPNQVELWGLKEGTYLFQLTVTTLMTTTEDTANVTVTVLSTEGRTVRLPASASQTTVGSADQRASFTTTGTYDPTDADTAYELSVLVRRAGISGQTYEATFILAGERNEMAIRSPALRDDAEVTHPLANGTMPVDGSCVTLVQGTNTKFPSDYDTLGCLTFCRDIYSEHGVTDYLSKTCPPIVSIRLDGLLLVTIHYHRKWFELEASKRDPMFPQCDSKGHLLLDHCQELLGTLPMKKPYQWPGLLKNSFLANHVGPRVKPMGGRYGAPDETTFVGHNTQGPPNPWSQARYFHSKWPLFLGPVMAGRKISPPCPKQGFRVWNKAFLDRRISGRDRAIVGGGGDTNPSSVYMSVLSSEALSQEKFLRCATDNNTTTPPASSIVLIHRKRGRPSQSSHRRPSVK

SEQ ID NO: 1021439 - protein, 79 aa, Homo sapiens
EVRVVTVSETDCLGPCEPSGRVLGEAHGCQRVFPDTRAPTRFVDDEELAYVIQRYREVHDMLHTLLGMPTNILGECPQP

SEQ ID NO: 1021440 - protein, 79 aa, Homo sapiens; identical to SEQ ID NO: 1021439

SEQ ID NO: 1021441 - protein, 94 aa, Homo sapiens
LTLTSIRLGSLPGLCCRKVPGTALITSAKLFLMIYFLSTPPLLTLFNILMTFFFVAPPLNLLNKTYFCSFTISNGIHGSTFFVATGFHGLHVII

SEQ ID NO: 1021442 - protein, 56 aa, Homo sapiens
MSTHSNSLMTPTSPDPERRAPASRSPCWTCIPGAGRRNWPVLAVNQLSPVGHVVAH

SEQ ID NO: 1021443 - protein, 33 aa, Homo sapiens
HHRKRHEEEQHVHGSALHGHRRMRNGLCRCRGC

SEQ ID NO: 1021444 - protein, 86 aa, Homo sapiens
AHLHPGEISSLVAHTKPVWWSLHSNANEIWCHHSDQGTSLGRSIPCPPALCSMRKIHLRSLLLSTNQPKEHLTNFKSDLLSLAAED

SEQ ID NO: 1021445 - protein, 45 aa, Homo sapiens
PLEQGHNKSGLPDKLSSKRVCVEALSVQSKCYDIIKLLPSVHTNL

SEQ ID NO: 1021446 - protein, 94 aa, Homo sapiens
LPHGSPGRSPFLAVVAALFRVMVQVAVGEVGLGGRGRQVNILSRASAPKSSWCPSTFSHTCWISCFSSSVSMAAAKGLRWAGWLPRVLCVVTTA

SEQ ID NO: 1021447 - protein, 328 aa, Homo sapiens
MTRRGATCISEADAARRRAGRMGGQIACRRAPRGQAGGRQRGKEAGGGGVHAVVAVAGPWECRCLTGCRCPGLGEELEGSAQGDRVTAAGSISFMATVTKELKKQIQFADVRCQEFYQSPRPNTGAQIFDTRRSHRSSIDSYSSVCILHRYGSDDEVSPREKQQTNSKGSSNFCVKNIKQAEFGRREIEIAEQDMSARDFTQETCSGGRSPMAGAKIVGCTHIKAQTAVLIETLCALGAQCRWSACNIYSTQNEVAAALAEGWSCKCSLGRASQKMTSGGVLTRCVNMDGWQANMILDDGGELSPTGVYKKVSKRVLRRSEGIVEEEP

SEQ ID NO: 1021448 - protein, 35 aa, Homo sapiens
PETVDAIEEYPEAWGSGVEVLVSVLVGLAMEVGLV

SEQ ID NO: 1021449 - protein, 104 aa, Homo sapiens
TGHALVACGDQNQCLTRGYSDWGLEAHRLLTTGRTLRRPSLGSIVRTPVPGGKPRAVSRRTIAWPSPTAWSHSSGQRGLERQPAAGGPGHCVLQSKTPLPSDEY

SEQ ID NO: 1021450 - protein, 81 aa, Homo sapiens
CPRCFLLLDSEDPLHGFLRHLELSYDPDEPPSLKLLDIDTRLGTQLAGGIARPPERLAGSAAQCEAADLLAEELTQVRRQS

SEQ ID NO: 1021451 - protein, 88 aa, Homo sapiens
GSPVCRKPHGPSHAARFAERGFVDDAYQLTTKGLRVLEADPQGLRDVLCTARIEDLLQERGSEVSHIVNHAMQVALEGDAELAAQLIS

SEQ ID NO: 1021452 - protein, 103 aa, Homo sapiens
TCVLVQSPAGLVAPEKALHLFSPRKPSSLRLMSKRKLFLKPFRENIPPIIGKRKQPPGKCFLPSLLLEPTSGIDEPHFSTAEGVCEYSRLNPFYFTPQGSEVP

SEQ ID NO: 1021453 - protein, 100 aa, Homo sapiens
MSSSDLSSSLTSRSHQTADWVPRASLWQGKWLVMPRVPTVPPRPPDVKMCLAREPRPTGRSLWRGPHLTVCSTTQARSTLGPEGAALEANPPHTPLPFPS

SEQ ID NO: 1021454 - protein, 109 aa, Homo sapiens
AVNAEVGIWEAHHNIHYHETTAERAAKVNKFAFFYGWWLQRSQNYGLDEYGENSFSLLPAHYTKFQYTLMLQSSLRDSSREIAKGSLLGSGYLPAFNEPVFFVHSILWL

SEQ ID NO: 1021455 - protein, 69 aa, Homo sapiens
NVKRSWRHVVLLGCEEHAIKLDNTETITAQHMPRRTYTRLNLTLPVRSSESLKQHLAESRQAGLKPNSI

SEQ ID NO: 1021456 - protein, 253 aa, Homo sapiens
GASWRLAGPRSLPPNKPGLQDAQVFILKTLCPAVKEPNVQLTPLVIDSVKTVWLSQGRNQGSTLPLSYSFVSVQDLKTHQRLPCCSHLSWSSSAYQAWAQEAGPNGNPLPREQLLLLGTLTDLSADLEQECRNGSLYVRDNTGVLSCAAHRPGPYLVGPSYILFPALAVTSLHATVDISSCGTVATCEACGDAPAAKCFLLTIQSWTQFTLIPDTLPQRVLPACSGSDTSSEVCSETWLRVYYDLSALGDQLN

SEQ ID NO: 1021457 - protein, 34 aa, Homo sapiens
MSLIQHLINGELVNDSGRSADVYNPSTGQVIHQV

SEQ ID NO: 1021458 - protein, 249 aa, Homo sapiens
GWRVSPSLAASAAELGQVRGFHPGRRCHCAVGTLSALSAENGASHVWRVQPDNTLERTPVRIGAFGENTVPILEGLAATDWVVAAGVHVLHEGQLVRPVDRSNRVVNLAAKEYVPMGFNLSEWALRNRQIVLFPMILLAVVGTLSYTKLGQSEDPPFTFKAMVIKTNWPGATAQEVSRQVTERIEKKLMETGEYERIVSFSRPGESQVTFIARDSMRSAQIPELWYQVRKKISDIRHTLRRISRVRVLR

SEQ ID NO: 1021459 - protein, 230 aa, Homo sapiens
DVRLPSASSPWTADDSRAPKGSLRQFLEHHLPVWPGNGHLCVLTMLAVDAQWYERCRPVPVVLHVVSTVGGQWMYFIYEGYQGMVDWRLNTSAEGLTGRVSPASCNVCAGTIIWHVRGSQGTIRTREGRLKAACNLLQQLASPTCDVIGGDWETSPGDNLFRKGRGVGCWRSWTVNGQIAQGGTVQKYAYLQRGGTMVCSIDNDFLLELTMNHRHGLQPAQDHRGRDANH

SEQ ID NO: 1021460 - protein, 283 aa, Homo sapiens
GCSRRHFSERDVRTPLHCGPPARRSSRLLLRSLMHCQCDGVSLPVCADCCAAVRCVVWLWVCACVDAAWSLYWLCCALVVAMAVLCSLLLCACLPCSYVVSILQGGLDYDTASYILTSDLGLAGLRINFPYLYIVGLPLIAQLSCLQGSVFEIHLNGPSPDMTEGCDLMAPTCIQRTRSMMWTREMGPIGTVPGHNVQQGLEEVTRDKTIMQALKKKNAGGALWTADCTLLDDINAVVDWKIPKSEAYITWKLRNRIRAGLGTLASQWRPKCFHIVRPTHDRT

SEQ ID NO: 1021461 - protein, 103 aa, Homo sapiens
WADLEDPRVGPCPIRIPLQTFLPSGRSALQPKLVPSADFLSVHSIPSSGPLIQLLNKTATQLSSGDRPPAELSSAHSDSNPEHPASCAAAQATDNPADPGRRR

SEQ ID NO: 1021462 - protein, 47 aa, Homo sapiens
IEKEKWYSLAIWGIISKAVVGMVCGVSNFSKSIHTGKTGSLEPLASD

SEQ ID NO: 1021463 - protein, 186 aa, Homo sapiens
MTPLYRWEHRGARGRGRGPHSTDGSTEVPKAGGEDPTLQNGSSEVPKVGGDDHILQDGSTEVSGGREVMTPLYRWVHRGPSGKSDDRHSTDGSTEVPEAGGEDPTLQMEALRSPKVGVDDRILQMGALRTFEVGEVTDPTLPEWFAMEDPLKRKSDDPHFTDGNTGGALEGDEETHKVLEHCDDPS

SEQ ID NO: 1021464 - protein, 165 aa, Homo sapiens
MCTCASIPASNRACVHHSSIRQQCTSIPASNRASVYHSGIWQQCTSIPESNRACVHHSSIRQQCTSIPASNRASVYHSGIWQQCTSIPESNRACVHHSSIRQQCTSIPASNRACVHHSSIRQQCTSIPASKRASGNIPVSSGTCAPGRSSVVSFQARSKAKGIKR

SEQ ID NO: 1021465 - protein, 183 aa, Homo sapiens
ETIQYTYADMEQHGLVHGKARSSQTISTTTIRLVRHNEFVMGGIIDASVRIFLDVVSANRSQFLFLARGQYGGCLAVRQAIAALRDDITRDLAADLTLMPKLQHLDAEGLHVMADLIVKSVFATLPDIIDPPAHALPAHLTPQAKITQQLRFIFIGLKHWQGLGSTEEVNQPAVWNRWAVDSG

SEQ ID NO: 1021466 - protein, 56 aa, Homo sapiens
RIVCETSSSKLRCRYAGGHIILDVDINKDSRGETTLAGIRDQHQARKDPSTVRERR

SEQ ID NO: 1021467 - protein, 60 aa, Homo sapiens
MSNVFVFDPAAFKAAFPQFSKFTDEQLTQFFEEVENTVLDNTESSCIGLKDRKKFFYLLV

SEQ ID NO: 1021468 - protein, 45 aa, Homo sapiens
MGMRKAGGFHHRPARLIGLPHVVSDHIDKLVISAHSSRSAVRGEE

SEQ ID NO: 1021469 - protein, 421 aa, Homo sapiens
PPGGIGLRGPRDLLDSPCSLVPQDLPDPLDTQESSLKALLTFSAQVSARQVPQGPLECQGSMGPTGYKGEQGEVGKDGEKGDPEPHLGPPDSRAAWGCRAPGDYEDCQGHSGPPGDRGPIWDSEGRLGSQERLGKRVTDGERGPEGFRGPKGDLGRPGPKGTPGVAGQAGEPGMPGKDGQNGVPGLDGQKGEAGRNGAPGEKGPNGLPGLPGRAGSKGEKGERGRAGELGEAWLPLVELRRPVDDAGMPGDAACECWPPGLIGVPSWPQWPSLEPPGVLRLPGGQKGSMGDARPSECPQGLRGDVGERGPGGACEDPKGDQGIAGSEGLPGDEGELGPSGLVGAKGESGMIEGSWAPRGTQGPNGQQRMYRGVPGPPRVLWGLPGPSRVFLGITVKPGVPVKEASRAAQSVKLCGGDDQGT

SEQ ID NO: 1021470 - protein, 166 aa, Homo sapiens
TPPESTGEFGEDANGFEHVLALLSLVHVLVVDPAVAVAANLVAGGDHGADHIRMPLGGHGHGEDGQRDVEFFEQLEDAPHTGTAAVLVQRLHAHVALALQRLRRDHFREEGFGLFVTVQNVALAAFFVVEYERQRNACLARPVGVRRVTAVTDQVAWVVSALVLVP

SEQ ID NO: 1021471 - protein, 42 aa, Homo sapiens
PARGQQSVLGKLAQAGARQLRFLAQLFDARILFHPELRTTHR

SEQ ID NO: 1021472 - protein, 102 aa, Homo sapiens
MQVPLTPLWELGLGRVVENADALAIAIVLNNQWSLVPNRGISYFLPVSMKLGGDRVSCQFLTATSHQWLHSVSLTQQHGTRVPAIRQCFYSSNPKMLELEGT

SEQ ID NO: 1021473 - protein, 348 aa, Homo sapiens
GGFQKRCRTDRAALAVGALVCCLVLLHLSAMISASRAAAARLVGAAASRGPTAARHQDSWNGLSHEAFRLVSRRDYASEAIKGAVWVLIWVLPTPAWQFMEGKQAKVLENADRCQNHPFSVWPLQQMVSDLCGMPGKRQAVTNPNNTFYATKRLIGRRYDDPDRTGKTLKMFPLKLSVCSNGDAWVEAHGKLYAPSQIGALVLMKMNETADNYLGHTVTLDAVDITRPSYVNDSQRRPLKMLADIWDCMCFRVTNEPQLVVLAVVLEKFRRPVLVVMIYSGGTSAFPSGIRQGAFGGNPPRGTLGGGPNPLLAVRVSAQQRCGTLVQEQGKIRPTKKANDTPKRTWKR

SEQ ID NO: 1021474 - protein, 321 aa, Homo sapiens
LAALLCCPALVALTCYVCDSGQPVDWFVVYNAASILEVSVWDVLAADEVAAVQVSWTMMLLDGWRVTCRALINMPWSGGLCGLNAMHACCTWSNTSQLAFLLYNDQPASTQQGSGLFHAWAHEWVSCSLTTMGASGWSTVYLTSLHLASSAAYSWPHSACTYGQTLLCVSFPFAQFSKMGKQLTYTYPWVYNYQLEGIFAQEFPDLGECGQGPPRKPRTLVTAASDSHPKAGLFSRSFAKFSKLEMAVLRLVGSSLGTNCRSVMHKCRHPASSWSDTGQGLVVTDSFPGPAAKLHSPVPSEGVFQRPDFCVLSTGRDGWAR

SEQ ID NO: 1021475 - protein, 245 aa, Homo sapiens
MRRPDGHAPVHQQRCCPMVAVPSTIHCDHLIDAQVGGEKDLRLGQVTSNHVNDLLSIPCATCMDANILAVCASVKTWICESVQPEFFLEEHMRTPVCSFVIWHMSSPTRHHMGGRHLEGILHLELGGADCCGCHGWDPLGAEVPQGDWREADGLSLRLVLTQRCDPEGGMASSREKFRRILWNHGPGVDSISCAATLSWGPELCSPWPPLTGPGFYPGPQGMSRPGVPPLSAWEEKHCSSLVCRC

SEQ ID NO: 1021476 - protein, 207 aa, Homo sapiens
GSHQQGHPASRRPMTEGVHFKECLQSEPASQDHQPEELRVPRQHCRSGRRSDSLRPTALWDINHDDPRERSRGVSPRNMDTSAVLAEDSLTGPMEENQFRLVYSQSPALELDKFLEDVRNGIYPLTAFGLPRPQQTLAGGGDHHLSCPPRVNDSDDLNQLEVETLQGVVLECDVLTIAVVCERGESEQPCLDTSCCDSLVGRNLKRL

SEQ ID NO: 1021477 - protein, 126 aa, Homo sapiens
MCDVTQCERRRRSETSSDETTQANEDQQDGGTTCLVCRSTHSVLLPPRHVGPQKLALDWRGAELAAALSLDQKAPPPSPRVTQSEPQEATRGSKQDPRLGREAWLRRDPTSGNRGGHSGSGPFWTG

SEQ ID NO: 1021478 - protein, 124 aa, Homo sapiens
NQQRTPSFLVQRDEVKRVGYIVVSSDRGLAGGLNNNLFRKMLGEMRQWQDKGADIDVVTVGQKASTFFRRVKVNMVGTVTHMGDVPHLEQLIGVIKVMLDAFTEGKVDRVYLVYNRFINTMTQK

SEQ ID NO: 1021479 - protein, 42 aa, Homo sapiens
RFCDTQARSTLQIRRRENHPRRVLNTDSRVETTAAGIGINTK

SEQ ID NO: 1021480 - protein, 122 aa, Homo sapiens
MSEEQFWLGDWGGGSGKRLAGKAALAGRAGGEPVVAADTGWAAGVRAWKAEPGTWRAEASRLGVHPQGEQLPSREGGRRLDASKNRGRDGRPIQNSSPNEHSGKQRTAHAGKNGNMCFIRRP

SEQ ID NO: 1021481 - protein, 240 aa, Homo sapiens
MGWAVRHHGLWQLCVCRLWISCDAWVTLCGAGNQQYWNVHPECGWACSPESREVVCRQDLDQPCKRTEGGMEGLFKTPPPTNTLESSDGTRGKEWKHVFHKEALAGTTKKERILNGLIFTKFGEVCKNCTLNVKDSYSTGGEYKGVRLCAISRIAQCTKGQVSKDLIDGNGMSLTGKPHKGRLKTFGGGLSYNLKKQQNGGTEEGAQAQVTAPTRAQTPKKTNNEKQRCEVETEAAKQES

SEQ ID NO: 1021482 - protein, 86 aa, Homo sapiens
ICVIRGSPPHLHGRQQEMDLLVEGVLDRGNHAMIFGGRGTGKTSLARVFANVADNRGYLVFYMACEPGQDFTSLIAPFLDAARGNL

SEQ ID NO: 1021483 - protein, 203 aa, Homo sapiens
GAWLRVGPGSSEVEWLVPPVAAWPRGGCWLPCARLRQGFACLHLSVLRAHDSGLMPPDGPPSALAMPGSAGFCWALCPRSSPCAGTWVRGPRDCFWSLAKWSCCMLCGCAGCWGPRRCLPRAGPLGGCLPASPPSGFAPGALLVKFFPLLLLYPAQLPGSKSIHLLDHLASERHRGPQGTKLHQICASGPAPGEDPVTRKAFM

SEQ ID NO: 1021484 - protein, 215 aa, Homo sapiens
RSTNNLRGVRAGLRLHRSLTMSDASEAEGGPPEPRASLCMEAPCARLRQGFACLHLSVLRAHDSGLMPPDGPPSALAMPGSAGFCWALCPRSSPCAGTWVRGPRDCFWSLAKWSCCMLCGCAGCWGPRRCLPRAGPLGGCLPASPPSGFAPGALLVKFFPLLLLYPAQLPGSKSIHLLDHLASERHRGPQGTKLHQICASGPAPGEDPVTRKAFM

SEQ ID NO: 1021485 - protein, 204 aa, Homo sapiens
VYIRRVRGFAARGRSARVPSSGAMDTSDLFASCRKGDVGRVRYLLEQRDVEVNVRDKWDSTPLYYACLCGHEELDSTFVANGARCEANTFDGERCLYGALSDPIRRALRELQAGHGFLAGRRRFTMTDFRCSRLRRSRGIPTSDGWSFVQYSGIVHVRDALAAVLWCTIVAYLCQACWTAKWQGQECRWFSGDPLIKPRGPLEA

SEQ ID NO: 1021486 - protein, 121 aa, Homo sapiens
AGTGRQRQLWQTVLNRQHITDGGRDQQWDHRTDLFMQPRQETHHLGIEPQRQGAFGQNQEAGGHQQARQNPQQPLTNRTQRLRAGQDRQALGQEKFEQGVRHGPSSACHRLPLKISGRKHR

SEQ ID NO: 1021487 - protein, 142 aa, Homo sapiens
KGADESGVGFYDHISYPLNMYCFYARACYVGPRLTDFPTPRIMMTSSLPLLDRVLSGKEKGVSIHRIQVLFPTDTCSPLEGDYDIGRVMRVTRLKASGRGKPRYLVESTSGVILEGDVNVLWATYERTVLFDYYPRSLAGED

SEQ ID NO: 1021488 - protein, 56 aa, Homo sapiens
RLLPDYEGCVRKDTSHRSGSLYPGSDRHTQGPRRARVGHWSIGATTQKSQCGFERC

SEQ ID NO: 1021489 - protein, 258 aa, Homo sapiens
MTEMSHEVQLKLTNDYTVDGLRKDGDVNDEVRASSDEYRLARVVAVNGMIEDVTRRSSSSDETTRGVCAVIDCVRDGYRVEESRFRVLDRRATSLFVDLLLTSKCRERVNAKERGPTIRVRVNSVRVGSTRCPWSEVALDRKVIISKKGVPHTAEYLRRRERNQARLVGCATVCKVTDSRRDEILLSEDRCFPSSGECESKEKERHSVVDVVTLNAEICRPKPTKRGQGSYKRRSGQRATHENEAEGGMRTRSTRRKY

SEQ ID NO: 1021490 - protein, 199 aa, Homo sapiens
LRPCHAQTGAAIPGMVELDPKVMMQGILRVQVQATPDSPSALQPTAQGRDQRAAAHTAIDRHQRHYFRAQLRGNDGLLVDTFVRNTAEKVHSCIDAVGIMGNVFTKQRQNFFAEAHSLLLKTQLKDVKVSKCGHLPQIYSIGALVGGHSVTKARECHYKAVFMPDFHDGRTIVNLMAYQPCVFHSLAAVKHEPKTPNRR

SEQ ID NO: 1021491 - protein, 88 aa, Homo sapiens
FSSLQGIVKSGLMLAFGAQPVFDRRLICAETLALVGLSSPSSTPFQWEMRMSSIGPSSDWVKLILGFTGSCRIAACCRSDERGNVGKS

SEQ ID NO: 1021492 - protein, 197 aa, Homo sapiens
MRFRAPLLYEQYIVADLTQEELSARTPTHQPPKPGSPGRPACPLSNLLAPCPTEDAGSYMQLSCSNMQEEEECLLGWNDGRGWMDMWLMEEPEVMATDSGGLGVPDSRARGLILRRGRSPAACTKRFLDGKDGDFDYMHSMTTNPDFDNLDIVARDEEERYFDEEEPEDAPSPELDGGLMACTLPTACPIPIPNKAS

SEQ ID NO: 1021493 - protein, 101 aa, Homo sapiens
HARTKRRVNFSPKRYRRLNRRFGLTKGGCHVKVSVYRYNPDQDAAPFMQEFQVDTGGKDLMVLDVLALIKSRTRVSPIVALAVKVCAFRRHDITPKRLAVP

SEQ ID NO: 1021494 - protein, 338 aa, Homo sapiens
MMMMALSKTFGQKPVKFQLEDDGEFYMIGSEVGNYLRMFRGSLYKRYPSLWRRLATVEERKKIVASSHDSRIHDLLDHQSDPCYQRLGKVEELLDGQTNTRSNTDEMVHTATGAQHQDSTHQGTRKRQRKEQDSMEIPNAQDAEEESTQQKKHCRGHKRTSNKSADQTKETTAKWTTRKTQTESNTTNRPERRRVEHNAPRRKMKRPMTKTDKQKRHQREAVRNPTNTDQATKRKNTEEQNRNAEQTKRTDPPSKTTDTETKRKKTNQTQHGKERTKRPKQPETRTNKEADAKAKRQDKTKRRQEAQTARTTITTHSTKNQTRKRNRTTRQKPNRQQD

SEQ ID NO: 1021495 - protein, 183 aa, Homo sapiens
MMMMALSKTFGQKPVKFQLEDDGEFYMIGSEVGNYLRMFRGSLYKRYPSLWRRLATVEERKKIVASSHGKKTKPNTKDHGYTTLATQCRPCQKASERGRDTGWQRCRSTRLVSISTEHTHYLREQKDRRNRQEYTTPDRTDHNTINAETCSTTSTGNSMGQRPETESPHLLSDHDPVITRKAL

SEQ ID NO: 1021496 - protein, 122 aa, Homo sapiens
TSMGRSTCTELLRLIADVLKVLSLHRPAHAPEVAVFQVDRAGLVFIALGDGLPVRFVISIPWHGESLSDGGQVYRVWRAAVRAIRTGRCGRFPATRPVSRPVPRGGNLHGRTNSGKAQAGRQ

SEQ ID NO: 1021497 - protein, 140 aa, Homo sapiens
VCELRVDCVVTGVPLSRPVAGERGCVELRLACGTKVVRGVGCPPQWLMASCASIDIDGRHCSTCWDILNAWTVPRWAVPRVSDEHHCAYHVPTDGDSQVELLCPKTRSAQVIVPQLTRLVFGPCHPLTCRSRSSVFSEMI

SEQ ID NO: 1021498 - protein, 212 aa, Homo sapiens
IATSSMPGVREERGYESLGVKFPDPTPRCQAARRSDGGELSVEMQQLTAGPCVPGLALMDALLMMLCLWVVGHLMNACVLPDMHADCLLWPARVGQCKMAWIDFLGCVVQMLLDLLCMPVLMEEVSEEQDSELQTPPALSSVTIPEFILSVSHCGHVAWGDMCVSPMHLCTLVHSQTPTCWCPTCTASSSDLGSAIDKIIESTIGPDLIQNC

SEQ ID NO: 1021499 - protein, 241 aa, Homo sapiens
SDSVGRSPYKFFSSQPGTRKGVVIGNPTGTNVQLTNVRLRNVIAHGYDYIGIEGLETVIGFSFGHRVVFENVNVHHCYVNWWLKELFEYSTGTNCYGYEGFVGMLMVGGNNTFVASNFEENFNNLQMAGGYNHAHGKFIGCSFNHAADGGLGFIGNGVVNGHTFVGCTFWYSPITLSGCAGISITQSQIVYGKVIIAGGGLNNIDDNYTPQGLVKESTGNTFTTFRRNRVSYNTVLLNRRI

SEQ ID NO: 1021500 - protein, 70 aa, Homo sapiens
SRGSRAYGRGSPQNSAIVHPLAIDTLGHQVIRRFFLQADPGFAGVRLGDRAGAGRTVNRQSQGRELTTVV

SEQ ID NO: 1021501 - protein, 64 aa, Homo sapiens
MGCVFRQTGIAFQYSNGVVVHVVSGHVSLAEDLLEVLVGHGREVIAIFRRNTQYHRVGGQRFAV

SEQ ID NO: 1021502 - protein, 162 aa, Homo sapiens
RVFRCGGAPVDQHRYHFRLGAAVSGGDCGTQYRLRQDALGELKEALVGVVGLDLAGIIGLLGAQAIELGQGCTTLEFLQVIENRLLDQPVRRAVNGGRGGLQAFAGRVVEFDPKGGRCHFFILMGATTEWHLLAARLALPILRCNRVQPFCWLNVRRLIGKK

SEQ ID NO: 1021503 - protein, 117 aa, Homo sapiens
RGYRPYDNSFIHPSIHPYHPSIHLFIHPSSIHSRSIGGVSTSIYPGIHPPTHYPSNYPSIPEALADRAHPSIHPSIHPSIIHSFQKHGLSEHIHLSMHPSTHPLPIQLSIHSRSMCR

SEQ ID NO: 1021504 - protein, 256 aa, Homo sapiens
KFYINISYKRSEIFKPAARVAAMASPQLCRALVSAQWVAEALRAPRAGQPLQLLDASWYLPEAWGCDAADASSEELPHPGAPAFFDIDQVQRPAPLPYDHMLPRGLSISAGVLQGRPWCCVVRAAHPPSVDLTSAKLTQGLIHPDPQRLVDVTAPSDTTADVTDLMCRLRQLAAARTSRQQHPAKSQTAPDEYPRIARPRHHQDLRGHQGEPGIPELPGGGITEHRQGPGTRPEPTEDDQANPGPENPQKSEQRLK

SEQ ID NO: 1021505 - protein, 173 aa, Homo sapiens
KFYINISYKRSEIFKPAARVAAMASPQLCRALVSAQWVAEALRAPRAGQPLQLLDASWYLPEAWGCDAADASSEELPHPGAPAFFDIDQVQRPAPLPYDHMLPRGLSIFWGRGVTGRGLGHGRWVSAKPGTNAIYNVSCVSGVVCVAFDVFEESVARRGASLALALLGVDSHA

SEQ ID NO: 1021506 - protein, 285 aa, Homo sapiens
PSHTEAGLVTMEEIGILVEKAQDEIPALSVSRPQNRACPSWALSLRTWRTCTAATRSCSNELEFLEVQEEYIKDEQKNLEKGNFSMPQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVSCMAHLAVGRPCWQRRWHITQQLHSSGSWGSEFVQKYLGEGPDGRDLFAWQGKWPASSYRRIDACNKRLMS

SEQ ID NO: 1021507 - protein, 230 aa, Homo sapiens
MRSQHCPCPGPRTGLSFLGPEPEDLEDLYSRYKEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVSCMAHLAVGRPCWQRRWHITQQCISSGSWGSEFVQKYLGEGPDGRDLFAWQGKWPASSYRRIDACNKRLMS

SEQ ID NO: 1021508 - protein, 104 aa, Homo sapiens
CCGAPEDPGSSPTRSITLFMIETVQISNQAAVTPLRHQKKCFPYGYIVKFHNRIYNIITVVLSGLGLAIALRHILLGDHDPIQCPLNFYTCFIDLFLFTLLLGL

SEQ ID NO: 1021509 - protein, 96 aa, Homo sapiens
RHEADLVCLVPISYSYGGLCIPTFSCYYLYQSTPPKCHNFCDAYSPDELSTFQGLFLWQSHTVEASLLESVTEPYTQERLAQIISNLVMSWLPDMF

SEQ ID NO: 1021510 - protein, 145 aa, Homo sapiens
PLLGVGKEHRLRGEELRGPLSVEMRSAVLSEPVLLPEAVHGLRALRCSPILMPCCTLCNPVTTTLDAGAVVDVAKRCLRSPPEACGHVTTVWLANALMPGDMTCPGQCMDDVQARRGCPETLAKSFTGDPALVQLRSVPQGRQIH

SEQ ID NO: 1021511 - protein, 279 aa, Homo sapiens
MRSKTKLNPPPHVTGGQGKKQKRNKPSRETTTVLAPRHFISALMDFGFPLCSLWLGLEFDVGVTPLPVGGALGHLSPLVENVTEGDVEKRPLSPARGLSVGQQVVVVSPRKSPVRGGREVVGVLATRGSSLSRCASREGVLSVVAPGERGTSWDVGHSKRLAPWEAGDSGRLTPACLRVTPHGAGPPPPTAGGRMVLLPALREHLVVGKPLLRSTPVGGQNSCDPGPHSDTLGPWSTRERFPKPSGGAPLGRTGVVLRPAYQETATAGLGPQEDGKVPG

SEQ ID NO: 1021512 - protein, 184 aa, Homo sapiens
PFHSISYDMLRLSCTLCTECDCAIGEGSGNLLPDFDVLDLSQSHDNRSIPPDRSLGNTRIGIKLVSTFLPLGISNLRSIEPLDHNQGCSTHLRVNNRKAIRTQSHWLHGRRYACDVDRPACREKVDATIERGLLLLTGVEGKGFTRVDRSGSVAAFFFLGIGKLDEIHQAASLCGAGGQHYQGR

SEQ ID NO: 1021513 - protein, 65 aa, Homo sapiens
YHTDDLHNGQDERAKGQGACVVPERPAKGREERELPGMAVFLAQGPVVGGFFSRQRDLAQRQHEV

SEQ ID NO: 1021514 - protein, 136 aa, Homo sapiens
QDRHIEMRRVDDGGDGTLEIMTSIPSVWCTTVPTFIAHRERVIVGHVITAWILLTTMVYFSTQCMGRRNYTTFYAFLIHTALLLLIGMVGCILKLYYIASPKTSEQGRPQAHPSRGFVHALKTTPESAVFFYLSFV

SEQ ID NO: 1021515 - protein, 96 aa, Homo sapiens
LLLAFSFLAGCASKPAYYISPAPVHIPKTATYWLDTFDVDVVGKNPRFLPDDKVREQLGVDLVNRLITAKRYATSKESADYLWDVKVVYARHFQQI

SEQ ID NO: 1021516 - protein, 251 aa, Homo sapiens
TGIQPGTSLLTLMGFRLEGIFPAALLPHVADHDSFPGPTDAASSYGLHLCDLDRCGLKVCPGSPRLLWTLLTYTDMTVWTSVNQVIAPLTEELDDSRDLYSMAMYSTVHGAWAPCLMYHLYRIYSILEIDPLFSQVLIDAAAISSQMQQWGTSFYVCLRYQFSYDKVSSVTYTCFHVFIRTGHLDWAQFVFAITFWPIYNGLPQLFVRLGAHPQRRPCMQAIAWVWDLLASVQALREPALRAATLCCFVRQ

SEQ ID NO: 1021517 - protein, 38 aa, Homo sapiens
MPTSGVEDNYRGLSPSLVECDRHILSCLAHHEAYDIAA

SEQ ID NO: 1021518 - protein, 94 aa, Homo sapiens
ETQVPRRSVTGIKPAEPSLRALFEPRLIEQVYWVNECAFDTSQLSIWASRELKESGVQVHYQTRVVAISKGRLAPLEVVVDLAQGVKPREDPVV

SEQ ID NO: 1021519 - protein, 242 aa, Homo sapiens
LGVIRPRNPDFPFSPVMMGSIIIKKHPEHPNWGEREVRVLGVIQSQEIEVKLSLLSENFPPVPCNCSVGIQTEGQNSTESRDPSHLEEAQWGHCNQRVLEVGLMGFPYPQSHSCVVKYFFGGSVDLLGLAIQNRKSDPCEALEGQKSAALYQSSPLSSSGARKEVKHLSAEYLNMGSFLQDDHRGSRDFELPTLQNPGAIAMGDLRTYEGWLYFTGHLSMGSDCIMGKGFERNYFSATTQGT

SEQ ID NO: 1021520 - protein, 107 aa, Homo sapiens
LWPPYLEIMKRRPVFNQLVEQIESELAGGVFEAGEVWVSGARSWLRNLGQAEKITVLGSRAITRRRDPASLAVLRLHHHAGSAHPDPPPKRPGILCMKSHLSLYSRA

SEQ ID NO: 1021521 - protein, 135 aa, Homo sapiens
PVLATFYRAHPKVTFNIVIASASATLDALCSGEADLGLAFYLQERADVEVTAHCQLWHRVLVSAEHPFGQRESIELSELQGQPLAIPDSAYGVRQALEVAAKKRGVTLEPGVHHQLPGSAEKPGPATGSGADFAP

SEQ ID NO: 1021522 - protein, 257 aa, Homo sapiens
MRSSWPWHEQLGTFTTLVGGPEYVHCLLPPLESLATVEETVVRDKAVESLRAISHEHSPSELESALCAASDTRLWRADDVVHLPLPRAAASSPSANPRVSSAVKAELRQYFRNLCSDDTPMVRGGRSSKLGEFAKVLELDNVKSEIIPNFLPTLGSDGAGLGCGCCRLEGVRENICQLLPQEDLAALVMPPLRQAAETSLAASVHVAEVRTQKVGRIQRLSCSTLKSTPERPPRKVKPGREGNHAHRSRPELRNRVP

SEQ ID NO: 1021523 - protein, 108 aa, Homo sapiens
TLRGSPTPPESMGLPAAWASSIILIKGQARLRRLTGSSTKGTDSRSSTIADDTSSDKAFNMARARGISSGSMMPGCWATLPNKPSSLLPKSFKSSKSAVTPHRSLIVI

SEQ ID NO: 1021524 - protein, 136 aa, Homo sapiens
MLRSRRKRIFMKKLCLLGLVATLASHPVWAETKPAALNDKDAFVSDLLKQMTLDEKIGQLRLISIGPEMPRELIRKEIAAGRIGGTFNSITRPENRPMQDAAMRSRLKIPMFFAYDVIHGHRTISRSAGLAQVRRP

SEQ ID NO: 1021525 - protein, 201 aa, Homo sapiens
RRRLAKRRRAGLSAAEQSLEPERGRRRRAGSGRAEMPYKLKKEKEPPKVAKCTAKPSSSGKDGGGENTEEAQPQPQPQAPAPSPVSATDHPTSVPAIARRHPHAAQQNQVLREGPRLSRRSRQDKSVHPRISSIRQRIRELQKLPDPERYRQPEETEKEHDIVQGQLTPGADVTSIDMNDGQKHNTVNLKIQKESEDGQGN

SEQ ID NO: 1021526 - protein, 232 aa, Homo sapiens
RRRLAKRRRAGLSAAEQSLEPERGRRRRAGSGRAEMPYKLKKEKEPPKVAKCTAKPSSSGKDGGGENTEEAQPQPQPQAPAPSPVSATDHPTSVPAIARRPPRSSAKSSTQGGPQIVKKELFIQKLRQCCVLFDFVSDPLSDLKFKEVKRAGSTWTVDVVYVALPVAVYMFMLLGAYLIQGPSFDPEEDEPTLEAAWPHLQLVYEFFLRFLESPDFQPNIAKKYIDQKVLAL

SEQ ID NO: 1021527 - protein, 217 aa, Homo sapiens
LGLRGKEWAKQCDYPDVITAMASVAVQLSDSLSSVLACSDKIGGMTLLPDFDQLNPEQLRAIAAQLMQRVETLDQKVESMDKQIHHYKTVNDKLTPEIAQLKRFKFAKRSEQLNPYQTSLLDDVIDADIAAIEAELETLQPAPAPTVARQKPKRTALPPEFPRTPIHHEPDNTHCQCGCALKRIGEDVSEKLDYTPGVYTVEQHIRGKWVCEDCENL

SEQ ID NO: 1021528 - protein, 185 aa, Homo sapiens
MLADQWPQAVLHPQHRIPSGRVAEVTDAEEMRTVVKGRKCVGGRLQHQGAPVEQGGRHLELFGEQTDFHVGDHQADVTAVNGGDFAFGQVGVGHALELVFQRRREQGAEVVAVGLGFHLLFEPLVTGVAQALQVGGFQHAQGVGAALFYAPAELLLHHETVEQHDIRGQFANKVVETAVFSSMVR

SEQ ID NO: 1021529 - protein, 44 aa, Homo sapiens
MDKVVIITGGSRGIGAQTALLAARQGYRICINYQSDEDAARTEM

SEQ ID NO: 1021530 - protein, 311 aa, Homo sapiens
DNEAVLIAGEGEGEAGSSCEVLGQERGSSSGICVHTGGLLGLSGAGQPQFLVRRTCSWVDTTLPSCTSMTLVRIGGLEEVTSLDDCYPEENWEEEEVGVLYLQQAAVGGNFLLQPLLHIQQDFVHLVLVLHLAAELGQLLLHAANQALDLGQLHAVASSVSSRFASRDAMLSWDCSSISRFCMVRRSSEISLLPLFTSSLLVATSRFISSVLVKNHSSASLRFFSAIFSYWSRISFRMRLRSTPGAASISTLTSPPTWPLRAFISSSWFFFQVGQLLLQALNLHLQVSSGQGQFVQHPAQAIDVGFHTHAL

SEQ ID NO: 1021531 - protein, 243 aa, Homo sapiens
MTLVRIWGLEEVTSLDDCYPEENWEEEKVGVLYLQQAAVGGNFLLQPLLHIQQDFVHLVLVLHLAAELGQLLLHAANQALDLGQLHAVASSVSSRFASRDAMLSWDCSSISRFCMVRRSSEISLLPLFTSSLLVATSRFISSVLVKNHSSASLRFFSAIFSYWSRISFRMRLRSTPGAASISTLTSPPTWPLRAFISSSWFFFRYGQLLLQALNLHLQVSSGQGQFVQHPAQAIDVGFHTHAL

SEQ ID NO: 1021532 - protein, 115 aa, Homo sapiens
EDPVDKQPLALLSICFISACSISSSKEIKQAEKLLQSFDCQNIERDQADHSSMTSYHEQVLASSKQKAQSYVESYQHGDQIFDLPLPEVIETQLQSYTAACQSLGGVLPNPQQSP

SEQ ID NO: 1021533 - protein, 295 aa, Homo sapiens
DHMPVAVEGMTEAVRRLSVKRGCSVVVVCEDCLWLDVTEQHGANYLLSDLVCDQCIQMWCGDICQQGTSGPWVEASSSGSVRYLSLSVTKSVIAIDYGKKQGKSSMKEKEMEEMVLLIPTSISVNNCVCHFSPLKSDQDYILKEGDLVKIDLGVHVDGFIAYVAHPYMWMIVAQGTQVTGRKADVIKAATPLLLKLPYCLVKPGNQNKQVTEAWNKVAHSFNCTPIEGMLSHPLKQHVIDGEKTLIPDPTDPQKKDPEKAEFEDHEVYAVDVLVQLQRGQGQGCRTETTIYMRPV

SEQ ID NO: 1021534 - protein, 228 aa, Homo sapiens
MKHVDFYAFSYYYDLAAGVGLIDAEKGGSLVVGDFEIAAKYVSSDPGDHSRKSSTLLMLGRSTVRQACYFQRVLAFPGATVLKLTRKIDNVETMLGSWGPLFHYIDSLDRQKSPAFIVAEPSLIPDSSVCVSGINPPVLGRDFIPEEPQDKPVLALICTLASGTCKKRLGASPWHSELLTSHNFGPEGAVWDLEPCSNVTLVCLGLQSWAWDPANRSNRQHHLQGCSC

SEQ ID NO: 1021535 - protein, 55 aa, Homo sapiens
QGVRVSSINYIHVNDATITNIHFQNTLSPVNNMSPFLPATGTYHSTFCLYKLDIL

SEQ ID NO: 1021536 - protein, 138 aa, Homo sapiens
YGRVLKGGVDQLFAGLAEGSVFNPQGCLGGQAFADAGRAVGLIVMAAVGEPTGDLFQELLSAPEKRVRYRVQALAGNPDAPTWFGEHPQVRQCKSPFVCRHCALQMLGVPVTAFMWTCAAFSSNASDKIGVEISTGRP

SEQ ID NO: 1021537 - protein, 250 aa, Homo sapiens
VRRRCSVSSRSRGGYGGHVFGEVVKAPCRAGTEDEEEEEEGRRETPEDRQVRLQLARKQRTAAASFEDKQHNIFWKFLRLEKYPVLQVYNSAIGNNAASISVIILLMNFTELWEEVGCAKVWNEWCRNNRELTHLYLPQSDLSVCYLSSRKSKSLGFFSAQLQFAYARTKIKQLLTVAGKGFGSVSKEEHADNYSHTVDPVTDYKTSESTGSFLLLFLRALKEQQNFKDLGAVSIARTTEYSTATSCSKF

SEQ ID NO: 1021538 - protein, 59 aa, Homo sapiens
LFYQLRTQENNMRMLMNVRIPHELFNTYVRDGSIAELIPRVMAAIKPEAAYFTEQAGTR

SEQ ID NO: 1021539 - protein, 42 aa, Homo sapiens
SWGGGVQPDDEYLTAQRSTGGKPVPRAVPVVAGDINDDAVLY

SEQ ID NO: 1021540 - protein, 150 aa, Homo sapiens
PFHSTRVDSTPSHCITFHFIPLGLIPFRSIPFHSCSFHSVPFHFIPFHSITLHSVPFHSVPFHSIPFHSCGLTSIPFHSIPFLSIPFHSIYHPSTHSPIHPTFQPFIHPSNYFHLVIFHPFTHLLIHSSIHLPIHLSSIYPPIHPSILPP

SEQ ID NO: 1021541 - protein, 139 aa, Homo sapiens
GAGRTKGAGRGDEEEGKKGKKPGIVSPFKRVFLKGEKSRDFEAHEKVLFMRVHTVVLSLPERVEPDRLLSDYIEKEVKYLGQLTSIPGYLNPFSRTEILHFIDNAKRAHHLSGHLTQEHDAVLRLFVYNVKLAWRDRED

SEQ ID NO: 1021542 - protein, 106 aa, Homo sapiens
MCLEFSSQLCHRPWYVCWSAYLNRRVIRKQDEQSSSMWSHLDTTSMNKNCGIRIVPIHMTLPDTQRKNARGLCSGAIRGHLLIEPYESVHEYFGIHCQLVATDFAP

SEQ ID NO: 1021543 - protein, 109 aa, Homo sapiens
MDEVGLAVSFLGHFENQKVMYWLLAVVNGLPMLALPKLRAHQLGVCAKMCLDALQVLLVPATVAKCGRVLPVVSTVICELPAAWQDIDAVCHRAAGSLTGWRDSPALCC

SEQ ID NO: 1021544 - protein, 112 aa, Homo sapiens
LVVSYFSFHLLVLCIVSSTAVIFSSSLFLLVVMFVLHGSCVGFPLWCLFLFGLPIILSHGGALFPDKFPLGFNFPLIFSRDIFYSKRPGYFIMDSPVLDSSHSCGRPNWSTQ

SEQ ID NO: 1021545 - protein, 78 aa, Homo sapiens
MLIAFSRIEPADGVWAAGIDEHQFFLRGRMRSGFRKHWFGQLGTLEALDLVIAKGGGIPDDQLAPRRRCSQVDIGAEL

SEQ ID NO: 1021546 - protein, 117 aa, Homo sapiens
MQLLRSGRTLRTARLAQTLAPAASAFARSGDRCQGMQLRDLLLRLQENALCSPHIISSRISENGSEVSTSAELSESILDGEQNALVTRRSSRPETAALGHLLRLRFGEGKDTPAGVA

SEQ ID NO: 1021547 - protein, 73 aa, Homo sapiens
EMTGFLFLRNSRNDLQKVSSEAVTIHPVQLYDREEGESNPSSYARIQPVAGACVPPKKAGTGADGVSPPVWRT

SEQ ID NO: 1021548 - protein, 159 aa, Homo sapiens
MTGFLFLRNSRNDLQKVSSEAVTIHPVQLYDREEGESNPSSYANFSPWRERACLQRKRGPGRTASLPRCGERDRCEGGADRHTACSSPASPPQHRAKSFKRDLGHCLFLREERPALCPGGSRGLSNHTAGGKGSICQTLPITLFWSPHPPEVHPVSPMT

SEQ ID NO: 1021549 - protein, 180 aa, Homo sapiens
TVYGQATGAEQKQQDKPTSLNVGKTLTNRRTGRAVGKWCNQPDYNPGQPSSHGVEIWGDAWKDLGECGGFQGNRLTLNFSTLSGRGPISQPTPGVARADQVVTGVLRCKAAGDPISAKSGETIHLDNLKACDYQRGDEPRWWVCALEHTAFVSFQREEGEEQAVTTEVIATVQTFVLRIL

SEQ ID NO: 1021550 - protein, 104 aa, Homo sapiens
MTLGSIRAALEDSSKPDTTLNATAEDTDEQLGTSLSGSGSTLEYVSNAFRIATGNNQQYKELGTNLRIVETKQIFFNLTPHHEVQRRHVFYYFHSLIRHDQVNQ

SEQ ID NO: 1021551 - protein, 429 aa, Homo sapiens
FWAVTVMVIILTLQPVPGLQVPSEWPQAIGFSGRCVGILFWSSGMLVHRCADIDQDLQTQKLMGSWHDHTKDTHKPKPTAWTALHPGNRCRQQPHPSRHTIATARSARQHTPWQHPGASTSSSHSKAPIKQHGASEHQNHTRAPSTSTTTGETHTGTYPGRKTLDRHTPMGLTRNGDPCDKATKANEQAKAYHTLTPSLGKPTETFNRGLVAAQNNRDSTTITLTDARTQRLRGDPNPSTSDPAGRGAQIEQDQNRTPDKDTSTIAKKTQPRDAAHITTIAGTRHQPDTKITPDKTPGPPTTQQGGDSRTKPRQGAGTHHSVPNATRTTGKETRNRARRHDAEERATQHARGEPGSTDRDAQEEDSRGDPQSNQATAPSNKSRRHTRTRQQPTQDAQRLPTSRSQHETHTPGATTGRTDKKTKTKPRRQ

SEQ ID NO: 1021552 - protein, 180 aa, Homo sapiens
FWAVTVMVIILTLQPVPGLQVPSEWPQAIGFSGRCVGILFWSSGMLVHRCADIDQDLQTQKLMGSWHDHPQPGSSDQESEEQQQFRNIFKQIAGDDMVICADFFFLVLNTTVFLHKDLKTHAFTLESCRSMIALMDTDGSGKLNLQEFHHLWNKIKAWQKIFKHYDTDQSGTINSYEMRN

SEQ ID NO: 1021553 - protein, 68 aa, Homo sapiens
MSDGSHTAYIHLLVITRTLHHAPSMLILDHMKRLAPTFPFHQRGVKSTSLKYASFPFTIYLRLTSPQC

SEQ ID NO: 1021554 - protein, 61 aa, Homo sapiens
SRHMAAGLALHSPCTRARCVHPTVSAAWPLSCMHAQAGGILSQSHLPGHAKLWPLGRSVFP

SEQ ID NO: 1021555 - protein, 378 aa, Homo sapiens
EKAAADTVLAPPKKLQLMAQDAFRDVGIRYRSDVTSISSTTFGCHLTDDYRPGVDPALSDPVLARRLRENRSLAMSRLDEVISKYAMLQDKSEEGERKKRRARLQGTSSHSADTPEASLDSGEGPSGMASQGLPFWPPELRQMTKTMRRVMRTEEEEEEEEEEEATDSEEEEDLEPDAGGSRRMMKRQDERGRSSEQVKMETQSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKQMTEEGMD

SEQ ID NO: 1021556 - protein, 517 aa, Homo sapiens
EKAAADTVLAPPKKLQLMAQDAFRDVGIRYRSDVTSISSTTFGCHLTDDYRPGVDPALSDPVLARRLRENRSLAMSRLDEVISKYAMLQDKSEEGERKKRRARLQGTSSHSADTPEASLDSGEGPSGMASQGLPFWPPELRQMTKTMRRVMRTEEEEEEEEEEEATDSEEEEDLEPDAGGSRRMMKRQDERGRSSEQVKMETQSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTPAKESRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 1021557 - protein, 81 aa, Homo sapiens
NGVNGMEWNGKEWNGTEWNGMECNGINALQCEWNVMECNGMESSGWNGMEWNGINPECNGMEWNGMERNGTTLNGMECNGE

SEQ ID NO: 1021558 - protein, 59 aa, Homo sapiens
MCYRQTPVFFGGGYIVRDLDKNFGGFKKPTLDLGLLGGVGVSNNLFFQKDLSPQGLGFG

SEQ ID NO: 1021559 - protein, 46 aa, Homo sapiens
MTPLIGMDRRHCCRLSEPKTGVSLLRPRKRLSDPRTLLATRRIRMP

SEQ ID NO: 1021560 - protein, 56 aa, Homo sapiens
VQVGELAGIEHRGLDTRRALVVVVVEDAHGNLEQERQGEQVDEREHGHGDVGEGGY

SEQ ID NO: 1021561 - protein, 276 aa, Homo sapiens
RNPVKAHPPANKVILLFDEKPPFAITLRGELKEQALKKVDFSVATELVTEPGSVVFALNDTLTNNGDYPKEYQALYHSNFSTPFLEQGARFVAPVKQVSPFNDKAKGELADWQTYRAPTKDYDETVYNVVPYADAKGDTLTVLHNKAGSLGVSVGFNTQTLPVFSLWKNTDTQGQGYVTGLEPGTSFSYNRRYQRPLNLVPTIGAKEHKQLRISYSLLADKAAVEKALKQVSEIQGGRETEVRQTPLVDLTKEVTLAGAFTRGPAFFIDAGIALQL

SEQ ID NO: 1021562 - protein, 136 aa, Homo sapiens
TNTRRRDEVRSAMGLVLVHQERIFMHPPDQPVAHRNGLTGTKRHQALAATHGNAVLDKRGIAIGADAISVLNRLIRLTGHAGLQVLAQLDIAHHTVLEKIVVQDLGVVVSHHPVQIAMSPAQVMAQNQLAGSVGRP

SEQ ID NO: 1021563 - protein, 211 aa, Homo sapiens
LYRHADDGVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPCVTIEVPMSETMWCDVMMLTPNALALSRQRIELVVLCEQENVHLTLFMLIGPIVMCHRCCASALHAVTNGQLCSF

SEQ ID NO: 1021564 - protein, 208 aa, Homo sapiens
LYRHADDGVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPCVTIEVPMSETVVEESEPEPAFSKMNGSMDKKSSTVSEDVEATVPMLQRTKSRIEQGIVDRSETGVLDKKEG

SEQ ID NO: 1021565 - protein, 270 aa, Homo sapiens
AEAAGGKVAEYLASIFGTEKDKVNCSFYFKIGACRHGDRCSRLHNKPTFSQTILDSNTSIVNPQNSAQTADGSHCAVSDVEMQDTLMMSSYDARFCTEMEEKYGEVEEMNVCDNLGDHLVGNVYVKFRREEDAEKAVIDLNNRWFNGQPIHAELTPVTDFREACCRQYEMGECTRGGFLQLHAFEAHFQMSCGGSCMAAVARSIDQDPRSRERRSRSKRPWSWRWRWRWWRWPADGSVTGGGRKIVKDLGDSEPCHFYLMSAKSGELIEP

SEQ ID NO: 1021566 - protein, 191 aa, Homo sapiens
LTHPDTATYNKFLEEVLTEMEEKYGEVEEMNVCDNLGDHLVGNVYVKFRREEDAEKAVIDLNNRWFNGQPIHAELTPVTDFREACCRQYEMGECTRGGFLQLHAFEAHFQMSCGGSCMAAVARSIDQDPRSRERRSRSKRPWSWRWRWRWWRWPADGSVTGGGRKIVKDLGDSEPCHFYLMSAKSGELIEP

SEQ ID NO: 1021567 - protein, 292 aa, Homo sapiens
AEAAGGKVAEYLASIFGTEKDKVNCSFYFKIGACRHGDRCSRLHNKPTFSQTDLGFKYIYRESPITVHRRLTAHTTIALLNIYRNPQNSSQSADGLGRVRESDVDDARTMMSEWGEEVTEMEEKYGEVEEMNVCDNLGDHLVGNVYVKFRREEDAEKAVIDLNNRWFNGQPIHAELTPVTDFREACCRQYEMGECTRGGFLQLHAFEAHFQMSCGGSCMAAVARSIDQDPRSRERRSRSKRPWSWRWRWRWWRWPADGSVTGGGRKIVKDLGDSEPCHFYLMSAKSGELIEP

SEQ ID NO: 1021568 - protein, 60 aa, Homo sapiens
MKHNPRSADFEFIDATLLKYGEDHSVLNMAELDGYFTALVSSPAKVDVAECSRQSGVGKT

SEQ ID NO: 1021569 - protein, 103 aa, Homo sapiens
LSTNVTAHSQVRNKPVKLRVLIRLSLDLASLSWGEWAHRFPRRGIRSLMVIRSSASIRPTNYGRQTVWITDSGGVIKSGSDQLEAFLCVNLVLTHSVVQGTEL

SEQ ID NO: 1021570 - protein, 249 aa, Homo sapiens
SSCGHEAVDSTLGFGFAAFIQCRVVGVGVLLAQQVSDVACDVVLFQLLGTSAPHVIRQVLHAVLPVVEAWAIGDVERHRALRAEVRIGRRVSHHIPQADALGIQQWVVVAGEGEALHHLAATGMPGDHDFFQCREQFAVAQVLDDLVQSAIRADLPWAGGRFAGHPVVTLPTHYLVAQVVAFHVGLIEKLRRDHQCTAAHPGMLGGVDPALQVGSCIAQAAMHDDQCARDLGQRLAPVLAQAQAEGVRS

SEQ ID NO: 1021571 - protein, 337 aa, Homo sapiens
MAAPWWRAALCECRRWRGFSTSAVLGRRTPPLGPMPNSDIDLSNLELAGEVPGASDRYRRRSRAGGAVPLHWCAVTYREYFGGEGQDPKEKIDIGLPPPKVSRTQQLLERKQAIQELRANVEEERAARLRTASVPLDAVRAEWERTCGPYHKQRLAEYYGLYRDLFHGATFVPRVPLHVAYAVGEDDLMPVYCGNEVTPTEAAQAPEVTYEAEEGSLWTLLLTSLDGHLLEPDAEYLHWLLTNIPGNRVAEGQVTCPTFHLPAEVGITVASASETAIDFETKPTCKWQGPRLITETELTGVVFIGSRHSLKDVGAPTNQAEGEPRREGTARFFVKCR

SEQ ID NO: 1021572 - protein, 116 aa, Homo sapiens
SGSFSTNVMLAEQALRYIQLLYEIESEIRDLEPDVRRRIRQEKAVPVMNMLHTWMIAQRELVHEGVDIAKALDYSLKRWTAESRHFMTGGAIATTTSSSKSGHGSSDAGTGSMQGR

SEQ ID NO: 1021573 - protein, 58 aa, Homo sapiens
MDVTRFHPDKGIRLLMVELCKEILPVNIEDELKQSYLDYSMSVIVGRATALMLRDGLK

SEQ ID NO: 1021574 - protein, 98 aa, Homo sapiens
ATDALKKMNGGEVQHSFSKLLYLSQIIATPPVFRMYDVLNMMMLLCSDTRVTQRHALEKIEKWSPGIAERYCEIWKKKSSLCSYGEKRWFFTIVVIVR

SEQ ID NO: 1021575 - protein, 160 aa, Homo sapiens
MALRVTRNSKISAENKAKINMAGAKRFPYRPLLAITPNARTDGPSNSVFGDIGKQSQVNNCQAKKAYEEGSKTFSYWHNSLLITKLPETLEKVPMLVASATCLTSSCQQPESCSQNLSLFKKNEHFAVTPILVDTSSPSPNGNIWMCPFRKKTCVRLSLM

SEQ ID NO: 1021576 - protein, 202 aa, Homo sapiens
VTLEDPLSTNVMRSISSWLRVDRVSIWGVIRSALAGMPLAGTSTSPALVAVYSPALISSISAGLCSRKAANIAGSLKACLLPFTDNCSPLSASCTSLVFRVASSSRMFTGRSPFVRSLRRSRLGSVVRTSPAHRLPCLPGAGARSSSRQASECPPSSKKLSVAPYPLHLEQLGPELGQEDLGVAFGRRVLTYLQRVHTTFVL

SEQ ID NO: 1021577 - protein, 195 aa, Homo sapiens
TKGTKPGQFSPVSLVALELIANTKKDPRLLLAYLGLARHTTMRDLDGRGPNMLTGAGAEKVRVLTGCGTPMATGIVNALAGMGLIKKPAAGLPPNQARWAMQHQGTVNIPHALIDGGIGNADGIGRLLKDGATDEVVVCAVMLLINCYAVHDLEMFGIDHQQIWRHWNHMVSSEAEGVRVTAEPINDTAQAKFIS

SEQ ID NO: 1021578 - protein, 278 aa, Homo sapiens
NLRAAVPLQTVPVDLQRYIGRWYVIANIPYFGERGNVGSYAEWALRPDGRIDDAYVYRPGGFDAPFKRMQFVDSVVAGSGGGEWRVRLFWPIYVSQQTLYVDPEYRVTLLGYPDKSLGWVFSRDPDMSDADYRAALNRFEAMGYDTSRLPCDVARQFPEPALGNQASSRRGTTTSRMRITVTRPADGGAGQVPGAGGEPDIEEGAGKGRVVNLGRQLPVGIEARTAVRLVTPHSVSPGFTSTNAGIIASCHRAKVASDGGGIMNPPNLINAVCDSGYS

SEQ ID NO: 1021579 - protein, 91 aa, Homo sapiens
MQWTQEQQPIIHSTADKLLVQAFAGTGKTTTLVGYATQHASVKMLYLCYNKSVELAAQGRFPRRNVVCKTAHGLAYGKDRRGILLESPQQH

SEQ ID NO: 1021580 - protein, 230 aa, Homo sapiens
RVLTPTYDFIESTLTRLGKTVRVLTPDLLLVRDKQVLLYSVAGAIQAFDSLEAFSQAWGSRMQREFQFDSLTWQRNETAANVFEQQAGLILNQQLEDLAALSFQGQDEKELDQRLDMITNPARYFTDIKLPDTERLGTVSQQLPQWLKQAEPADRFAYHRHLQDMAHVLQKNQGRSFNEGIENIHTFSRSALRKQMQADHGGFDPDAVPLDFAVAAGIRRAGSSSTCACA

SEQ ID NO: 1021581 - protein, 119 aa, Homo sapiens
PCAGEMPAGSGDFRGDEGQLVANLYAQLGRGLVTDDDAKAARRQLVELTLQHELVDDRDVALLGRVDAVEQDLLHFAVIGQQPLHLGKRRYRHHLGVLLDLGGQALPVVDGRIALDGRV

SEQ ID NO: 1021582 - protein, 124 aa, Homo sapiens
PLRTHGRLTAIGDLTVNATTLNNYGTLGGAGKVRLNATHLVNDKGLLFSGNDMALRVNDFSNRYGDVYSLGALDIARDDASARSSLIENVSGSLDSGTGMRLLADTLSNRRDQFTTEMKLVSRP

SEQ ID NO: 1021583 - protein, 75 aa, Homo sapiens
GLRLNLHQKTHLHDKPSRCSECGKNFRCNSHLASHQRVHAEGKSCKGQEAGESPGARKRQRAVPVPKCHVCTECE

SEQ ID NO: 1021584 - protein, 110 aa, Homo sapiens
RIISTNVIAKADEPGAYSFFNAFNYIPPIIGFSSVGRKDSLNNIEQTGEFVWNLATRPLAEQMNQSCAGVSPEVNEFELSGLTPVASKIVGVPRVGESPDEDEMQETQII

SEQ ID NO: 1021585 - protein, 132 aa, Homo sapiens
RSEAHDHRRHAGAEQGHDQAEDLAQPGDLVLGETLVDIEHVAMTPITVSDMQIGGNQPEQQQRLPTVVQDKVVDRREHGREAPAAHGWEAQGSEDDIEDGAQERAVFHQQFPQTHALEQHAGECRCCTGVRS

SEQ ID NO: 1021586 - protein, 223 aa, Homo sapiens
MAGNFDSEERSSWYWGRLSRHGVLVAAACKWTSWHWGSYLDAGTLSTSPWDYVLMLSQRTRAVSHYIINMQLALLPCRVPPVARPASALGCCPSRLLNRRSRVLIHLPALLEFYKIHYFGHYNVDRTSFQIQCRVVGVILSAGVRRSMCEPSLTLIGNDEEDLPFNEGDILRIRDKPEEQLVDCGDSEGQRGMIQVLTSRVRLLRSFWSIGVPGVPPQPGGRT

SEQ ID NO: 1021587 - protein, 132 aa, Homo sapiens
MSDLCVPGDTTLCFLAGTWPSLLALPVDTLPWPWTLTRNLWFQPRATLAVEPGCHLLGPKFGGYLAGISRKRPGAGASPRRSHAPMWPPLFVVLPFASCVVFASRGGHFLLPARRPGSLYLALSAAACLRLL

SEQ ID NO: 1021588 - protein, 75 aa, Homo sapiens
QEDAGCYAAHRRYVYSLRCEKNDLLIIPAGVPHWFDIGENPHCVTLRLFNTAQGVVPSLTGDAIAARFPRLGVRS

SEQ ID NO: 1021589 - protein, 187 aa, Homo sapiens
ANNLPGCAVLAELSLVGCYNLSFIPEGKRAQLLLESAKKNLRGMAFFVPDLSFHVSNDCMYLFDAGLFNLKFIPALHAVQYALLGGLAVEVDEDTILAASEDAQLTCDIACCTDYCQWTSSSSCYQYNAVQPVMLHVDACCTDVMPADGAVCCTWANGWHCLLGGCLTSLGRLCPPEDYMSHIIEKW

SEQ ID NO: 1021590 - protein, 106 aa, Homo sapiens
VTLRPKLRWQPALLFIVRVRGPLAVNIPNKAFKILSLLRLVETNTSVFVKLTKNVYPLLKVITPYVVIGKPSLSSIRSLIQKRGRIIYKGENEAEPHEIVLNDNNT

SEQ ID NO: 1021591 - protein, 266 aa, Homo sapiens
AATPLPPESPPRHSLEEEPAGNWLQDALFLSAGAGSAVTMPVTFALHAPPGPGHCVTQCYDTTGPAPILPTRHVTAAGYACGWAPALRHCALYPSETTYGASGNLAKGSLTIWHFWVGPFLHDIHVSLRFLVTAEDRPSAYILYCCLVAISGGPMECMLVGTGPDHGPGDHSGGPMKRVTFHIHTQVLSDTVAGTRPNFHDGGKDMGETSARGLRRGKHEGSMRKGPSMAKNVNGTNSMDRHDRNRPPVNQGTTHTEDEKTGKNKT

SEQ ID NO: 1021592 - protein, 238 aa, Homo sapiens
AATPLPPESPPRHSLEEEPAGNWLQDALFLSAGAGSAVTMPVTFALHAPPGPGHCVTQCYDTTGPAPILPTRHVTAAGYACGWAPALRHCALYPSETTYGASGNLAKGSLTIWHFWVGPFLHDIHVSLRFLVTAEDRPSAYILYCCLVAISGGPMECMLLAQAPPLPVGLRGCPDNVVDLPLHTSVLKATCLACQPTYRIGGFGVPMPGLSVQLGSAQAAFQFFGHACRFAARAGPRF

SEQ ID NO: 1021593 - protein, 109 aa, Homo sapiens
TRRAAPSRRLTEMALDSDLWSRLEEKARAKCERDEAGNPAKESSDADGEAEEEGESEKGAGPRSAGCPVLLEALGQGPGACAALAASAASNVLYCAEIKDIGHLTRCTL

SEQ ID NO: 1021594 - protein, 185 aa, Homo sapiens
TECGYCCMLRDIHGKPLPQGAAVLGPENALLTTVVGDGMIFLSKRRTRPRPLKSLPAQCPARCNSTFRSKPIMANSTKPLRRSVGEMARMNEWRIGCLKGLGLLLSCLLLAAPASAANCRLSLSQPIIGLRACIAQGDQLENRGAIAGKAYGRLNVICVEAAVIALRIPGVPANETGLQVRAGQD

SEQ ID NO: 1021595 - protein, 55 aa, Homo sapiens
MKVISVISTKGGVGKTTTAANLGGLVADAGLRVLLIDLDVQPTLSSYFEAYVAGG

SEQ ID NO: 1021596 - protein, 64 aa, Homo sapiens
EADDRHPHRQHPHAHAGPVAHVNDVGDGPHRAEVGALGNGPEGHRQKESSPENLGCDGLEIDVL

SEQ ID NO: 1021597 - protein, 479 aa, Homo sapiens
MKDCDFPAEDEFPETELPTTTTVAKDADPRASTRELRAKSTAEAASQLDGRHPDRTVDKPGHPYIMTVETAGRADRRRSYEVCKDLFDPIIEDRHGGYKPSDEHKTDLNPDNLQGGDDLDPNYVLSSLGAALGLQHPVGFLAHPPLHCMPAGKRRGHLRKLAGGKPCPCLDWLTCAGLILLLLNDATDWMCVMHAACSSDDHFLFDKPVSPLLLASGHGPADLALTPAVSGTMIKKTFLVWVNEEDHLRVISMQKGGNMKEVFTRFCTGLTQIETLFKSKDYEFMWNPHLGYILTCPSNLGIRAAEQVCISMLANLGKHEKFSEVLKRLRLQKRGTGGVDTAAVGGVFRRLQALTVLGFSELELVQMVLRLRVKLLIGDGTDGVEQGQAMRRTITACPENEAPANTRHQRAAAFHNIIAWAVPTMHPRCYAVWEPSSLAVETSVYTWYSLFHLMGNDTADAEIKTRVMAGQKYRQKNIG

SEQ ID NO: 1021598 - protein, 152 aa, Homo sapiens
EPGPRLAGQPTVVSGLWQPARQAPVKAEEHQRQNINKFELPDNALPSRCLRSPGDGEDTNDLHAEAGGGAGNPTAPSPEQSRLPWVPLDAAQNINVVKYVGKRSKDTSNAGFCEVEFQGPPLHPGKSGLRNLQQAAILEMKLFQKRTHHKHE

SEQ ID NO: 1021599 - protein, 129 aa, Homo sapiens
TPRTNVLLLRRVNLTRYLSDDSQTPTGSYLAINRIIAGISTWDFLPIMGAFEGKRTGITGCVTEPVMRQQLGDLTGALRRQPHQHILEISIRIMPIKVANWIKLISAAARCPLRNDPAKSQFLRPSAHG

SEQ ID NO: 1021600 - protein, 63 aa, Homo sapiens
MRQQLGDLTGALRRQPHQHILEISIRIMPIKVANWIKLISAAARCPLRNDPAKSQFLRPSAHG

SEQ ID NO: 1021601 - protein, 52 aa, Homo sapiens
GQVELQPALEHLPRQLKRKLETLDGGVAQLFVIRCGSGACQRTLQSCQGEFK

SEQ ID NO: 1021602 - protein, 84 aa, Homo sapiens
MPRLRGIPIDDQGRSRSSTAYSAYHFNLDVILTQQVLSQIMSLYCLKYLLLRIKCSGEKFLKDPAPFYLSRLIYFSLLFLYHIL

SEQ ID NO: 1021603 - protein, 293 aa, Homo sapiens
RHEERAARWRSRTYDMAALSCWALHAVGPPHMLCLCCGRQALAGLCREERANSVSSGVTTCLMLGPMAEYPCLELAVQDDCSCTADLTEDKDGTPCYSDYQHAQMSCAWVPRSNTLSSRPETNEAFGHCCPGPCTQDNKRCLIRELISNASDALEKLRHKLVSDGQALPEMEIHLQTNAETGTITIQDTGIGMTQDELVSNLRTIARSGSKAFLDSLQKQAEASSKIIGQKAVGNYSAFMGGCQSGGLFPVGKPSGSLGYRGHFRWYRNCLATREASEVRNGTALINHLHTRL

SEQ ID NO: 1021604 - protein, 127 aa, Homo sapiens
DPYQNRAGHLSAIYASAMGEQALHPIQFHDLDWGKIEPVEFEWYFPHASRFLDAMGRVSDAGGRPHDLVVYRDCADLGRGNGRCSPRRTSRGNGSAPGVTSTSEERLMKRIMMVGAIVVSAACWWKG

SEQ ID NO: 1021605 - protein, 225 aa, Homo sapiens
PAVVAKQRLYVAATATDGSDGWGGASPWDSRVQEDPWSQWSWLLASRGKEQLLMETLERESVRREIVPLFESRECSGVAPVPGNPKLHVRLRLPTCPTLVPHMKIAMTGSQSAPVILPDLIATRQRYQQVQSDSGGPSDAAAAHSSSSHWCGGPPFVGPVGFGPGDLESPGTGQRLEKPCSCGGQLWPPRGPLSCVQPSSPTCYREQDSALSSAAAGPRRMLFGP

SEQ ID NO: 1021606 - protein, 209 aa, Homo sapiens
GSFSTNVPASVHQTGQADDDTRRDGRVLQRHEEIALQHRHQERVARIGGKVKAKPGQDQPQKGRHSQHATDRAVDALLGDLQGVRRTTLGFFYVEHKHRKDQPRHRRDKEGRAPAVERLDHRTDRKERQQQAQRQAKHENSPWLGARRLGGEQRSPISELAAGAEAGFADANAHAYQQEGPETGDHAVERRQTAPGEQDSTHIRGSGYE

SEQ ID NO: 1021607 - protein, 71 aa, Homo sapiens
ALQAFIFMMLTLVYVGQAHDKHCSPEVNEFRFFFPSVNYSLIGAIMENVLGLVALACGLIISLGAIGACIG

SEQ ID NO: 1021608 - protein, 38 aa, Homo sapiens
FWTPPNNQLMMANNQDTNGNINVRDVDICGYDWDVRDV

SEQ ID NO: 1021609 - protein, 268 aa, Homo sapiens
ARRGAAAGLDARPGLGAGSAARKISPRESGPATGRGLRRDGMRWAVTGVTAGKIASNVQKKLTRAQEKVLQKLGKADETKDEQFEQCVQNFNKQLTEGTRLQKDLRTYLASVKAMQEASKKLNECLQEVYEPDWPGRDEANKIAENNDLLWMDYHQKLVDQALLTMDTYLGPSSPDINVTAFAKAVAFKLGWHYDSWPGTTNESFKTAKKKGEAKIAKAEEEVIKARKVFEEDHVRPGSDFAPCVHTGSLRNRSSIRAGKFQGIGPNS

SEQ ID NO: 1021610 - protein, 225 aa, Homo sapiens
MSSLTQCVQNFNKQLTEGTRLQKDLRTYLASVKAMHEASKKLEVTCLQEVYEPELDLAGMRISGLPGSVKAMQEASKKLNECLQEVYEPDWPGRDEANKIAENNDLLWMDYHQKLVDQALLTMDTYLGPSSPDINVTAFAKAVAFKLGWHYDSWPGTTNESFKTAKKKGEAKIAKAEEEVIKARKVFEEDHVRPGSDFAPCVHTGSLRNRSSIRAGKFQGIGPNS

SEQ ID NO: 1021611 - protein, 305 aa, Homo sapiens
RGVERQPVWTRGRGWGLGARRARSPRARAALATGRGLRRDGMRWAVTGVTAGKIASNVQKKLTRAQEKVLQKLGKADETKDEQFEQCVQNFNKQLTEGTRLQKDLRTYLASVKAMHEASKKLEVTCLQEVYEPELDLAGMRISGLPGSVKAMQEASKKLNECLQEVYEPDWPGRDEANKIAENNDLLWMDYHQKLVDQALLTMDTYLGPSSPDINVTAFAKAVAFKLGWHYDSWPGTTNESFKTAKKKGEAKIAKAEEEVIKARKVFEEDHVRPGSDFAPCVHTGSLRNRSSIRAGKFQGIGPNS

SEQ ID NO: 1021612 - protein, 113 aa, Homo sapiens
GGGADSSRARRTRSAPASVWDWLARDFLRPLPIAGDDFRGFFRLSRVAKERLGCLARPLSSLVLLMLACRTLGVPALLPLSTMMCPWKAFLLLLLLWAWCMLAWPWRVPEGPD

SEQ ID NO: 1021613 - protein, 38 aa, Homo sapiens
MVLNLRSTPTHGETNRATPNILSPHYSSEPGDTQGTAA

SEQ ID NO: 1021614 - protein, 54 aa, Homo sapiens
MGGTPYRGRKPETKEPGQAEACPARCAIEKQQLALEVLTVRYGTYRALFRCVRS

SEQ ID NO: 1021615 - protein, 54 aa, Homo sapiens; identical to SEQ ID NO: 1021614

SEQ ID NO: 1021616 - protein, 228 aa, Homo sapiens
RELPNSSAARRPLPEPGVEAAIAAGSPQPRPEPAAPFEGAPGAHGEGDVNSVWPRRRPEKDEPKSGRRRSSSPPTPSRWTASDPDDVVPVWPKKSLVLVHVLWTSIYACRCILGGAYLYKYFALQPDDVYYCGIKYIKDDVILNEPSADAQCSLPDNLKTDIKIFEEEEVNLSVCLSQSLQIVILPTLFMTLTKKLTGYLDLNLDKVLCDPSEHFHCYATQKPTGVTY

SEQ ID NO: 1021617 - protein, 164 aa, Homo sapiens
GRGQTGSDAFMGLFGKTQEQSRPEKLVNEGSLKIRKEVRVVDRQIRGYPRENEEKGESDSVKGVLPEKGQKDVCVVLAKEMIRSRKAVSKLYASKAHMNSSAHGDEEPARGLASGWFTAEEHRSDEGHARVVVKIPEIQGRHEGVVQKKMMKAGIIEEMLEDTF

SEQ ID NO: 1021618 - protein, 120 aa, Homo sapiens
AYGRSAHRQATGKCRCRRWLRISPLITAAYSRIMLSVTTAGADIAADAASGNDDGVSIKTGDQVAQDGASGHVIDVLGQLHIHSANGATALVGHIAVLRGIDEGASLHPEGVVPIALEQR

SEQ ID NO: 1021619 - protein, 138 aa, Homo sapiens
MGELNWQGGAHCHYGPLESRQEEINHMDIRGGRESCLEKVRGQQPAEAEPGGFGAGASVVEGHPPGSNSSHEEILALVELLYVIFVGWSCPSDGASLTRACLGLLALPGPGLATLLQGSSGCLGAALAWLQPADVDPG

SEQ ID NO: 1021620 - protein, 188 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRDTLADNLTLCLRSVAKSRLLLLFEMDSSWLFTRDLNLSVGF

SEQ ID NO: 1021621 - protein, 74 aa, Homo sapiens
MRPSLPCFQQFSVDALDIAPGKYFPELTKATGEDIAQVKAWWAERGVGITGMQALLFDTKGLNIFGSARRKLLA

SEQ ID NO: 1021622 - protein, 44 aa, Homo sapiens
IGITAAQERLPLRLLILQLPVQRCPQIRLLPNFCGGVPGVALLQ

SEQ ID NO: 1021623 - protein, 110 aa, Homo sapiens
NGSAASASRLRWGVSTSTMGGIEASPQFLLVVESKCTGGKFRSMDGCEICSVIERLINAIAGSPADVHSVEVLREVAERGGLSSIGRVVPVVGITGYNPAFAGFLVVTNL

SEQ ID NO: 1021624 - protein, 56 aa, Homo sapiens
MKGLKSLLAAGLTTLSLSLPVSAAQAPVHFADLNWESGSLITEVLRFIVEKGGYWH

SEQ ID NO: 1021625 - protein, 236 aa, Homo sapiens
NTMDLVLKRCLLHLAVIGALLAVGATKVPRNQDWLGVSRQLRTKAWNRQLYPEWTEAQRLDCWRGGQVSLKVSNDGPTLIGANASFSIALNFPGSQKVLPDGQVIWVNNTIINGSQVWGGQPVYPQETDDACIFPDGGPCPSGSWSQKRSCVYVWKTWGNTGKVLGGPVSGLSIGTGRAMLGTHTMERDCLPSHGDPGAMCSVIQLSFTYDRCFSDGPVGLDEEQHSEISLTCPQS

SEQ ID NO: 1021626 - protein, 235 aa, Homo sapiens
DPKQGRTYKLRMRRKSPSASIARQPITFGKAPGANDFQTVDVVQVPGKRRKRRRQAHDALRRLVQQRLAGGLQHLHFVQGAVAVDRHQQSQIAVDLLAAGFVRVVQVADALDLLAPLVLIPGAFVAHGGGSIQAVDPRALGVQLLFVGQFGFQAGNFTGELRAIKRRGRRGRRGFGLGLFPLSGRFLRFGCDGSDSGLGCSLFHLRLGRWRWRDLIDLVVLDRRHFGVLITRPDR

SEQ ID NO: 1021627 - protein, 167 aa, Homo sapiens
WSVLLVGASHQQPLHRFAQIPGIGTGWFEARSTNTWTKRPAAHASCLARLEYRQLILHRAIAQLAHPQTDLNALGKSARGEVIAGRTHHKPHHLTVMNIQPALFDQVGINGCIEEAVVSDVIHMAVGIVVVPTRGDRLEVAVIVAHRRRVRHRQVSTKLIQLSRDPL

SEQ ID NO: 1021628 - protein, 75 aa, Homo sapiens
ELSDDQNEVAHRETLDILNKASGFLRQELSRRIKTRITPRLRFHYDKTNAYGNYMFGLIEKAVQDLPKRESDDEE

SEQ ID NO: 1021629 - protein, 165 aa, Homo sapiens
SCHNLRSVHWWLMARCLLTMYEVFPQLIAHNSASLFCMADSYFRFASGNKSDESTSATVKAFGRRAEGPWLITRDAAHAGYLQRGPIPDAEGLIMDILKSRRRFLGGLAAEGVFGPPHHSVAWRACALAGQNQQAKLKVVFFVVPDGLAVDSVTGYSSDGRGRLL

SEQ ID NO: 1021630 - protein, 199 aa, Homo sapiens
MVLHHYRSGRFDSAEESMIPAYGAYKRVESREILFELGGFLEEANRLDNVPTERQIQCFGGPHFQGRGHHQHRVRDDLETILTWCQPAISHEVEFGSQLFRCVGNVLEPINQIRRGVETTQVQVTRSIAEPPSHLHQRVVHFGSPKKIANTQAFKRKSSSQLVSSNCDDLQPRGAVYIVQRILCSAIDHAHIDLLQQIR

SEQ ID NO: 1021631 - protein, 180 aa, Homo sapiens
NLSSGTPNNLRGARIKQRLANNHSLDLWQARWEQAPCFQHIDPNHQPEQRDHHDGKTEVVVKEPTDQRRQNSCRAAQPQGIVLGQADRAFFRPGFTPPTHRNGYKEQHADDAGLVDKVQPQVGDPQQVCARYRRVNLEANAERIRHHGLGEHAVFIKTNFGAGVARRKDRRQAFLQRWGG

SEQ ID NO: 1021632 - protein, 138 aa, Homo sapiens
PAFLLLISTVTQISLCALNTRVGTKRYMLPNVLDDSLNKNHFQPYIMADIYSFGLIFWEMARRFITGGIVEEYPLPSYIMVPSDPSYEDMREVVCVKRLRPIVSYRWNSDECLLAVLKLMSECWALNPASRLTALRIK

SEQ ID NO: 1021633 - protein, 283 aa, Homo sapiens
RGCRCPASRRPGLERDGRGGEEGGSVRSGAGPDSDPRGASSPPAGHRGTAASPSASMPPPRCTPAPPHTRARAEPRAPLGPSVAQGVSGSLGSLGQVSTLMKATVLMRQPGRVQEIVGALRNGRLETWLQVISDFDMTLSRFAYNGKRCPSSYNILDNSKIISEECRKELTALLHHYYPIEIDPHADRQRRSYLIWWNGGPKPHNLLCQQKIQKCQIAQVVQRVQCKCSGRGYKDLLQHNSNITKFPYDITAGIDDICKNNRRYSVTKINGLQLKKKSTQKRR

SEQ ID NO: 1021634 - protein, 145 aa, Homo sapiens
VAGTAPPRAARRAILISFSALSDQRTTLFLLSATLIFRLPGHDTHRTIRPTQGGLMNDELQHLKNLGKTSAQWLHAVGIHSASDLRRLGAVDAYRAVRTRGFRASQVLLYAIEGALMDVHWNDIPTERKEALNRQLEAISVHQKN

SEQ ID NO: 1021635 - protein, 45 aa, Homo sapiens
MKKFRLPGLLFLAQATTALASETPLANDDKGFWYAQTSVYTEVIG

SEQ ID NO: 1021636 - protein, 138 aa, Homo sapiens
SCAGGRGCRGRAAPGRALQAAKRLGKALSGRSLALSPKLEYSGTISAHCNLRLPGSSDSPASASQVAGITEVHHHTWLIFVFLVETRFHHVGQACLKLLTSSDPPTSASQSAGITGMSHHAWPEEPPRLARVVLIEVL

SEQ ID NO: 1021637 - protein, 96 aa, Homo sapiens
YCAYPARPLLQAPMSFGVVNFVYWYSERTAQHPGPRRQRRYLKGRSLLTQSRLMLGSGASPAIGIVVCQTPIIATVSWGSDVSNFCNSSFIACFLV

SEQ ID NO: 1021638 - protein, 230 aa, Homo sapiens
ARDLVSWEELDRIVTPGSTVQDFLNLADKVEQHLGMVFHRYLEGTRPRLRILLNGQPVKPWDPFMTDHPGKPYNPPVFKHPTLKGIEAECHVLPHKDMLSGEDFEVLGGPEGWTAQQGFNVYRNERLLVAGSWLGLGTGRSWTKDEAHRLARIRLDIPNSADADWKIDIRKSTARPPVYLRDWLTRLAEATRGRARRAFAHRRRATLLGNQQVAEAWKVEAGPLGDPRVD

SEQ ID NO: 1021639 - protein, 37 aa, Homo sapiens
DFTRLADRQIAAFVVADGDFGARNRQADGARELVGIG

SEQ ID NO: 1021640 - protein, 246 aa, Homo sapiens
GEDRGTAMAESSESFTMASSPAQRRRGNDPLTSSPGRSSRRTDALTSSPGRDLPPFEDESEGLLGTEGPLEEEEDGEELIGDGMERDYRAIPELDAYEAEGLALDDEDVEELTASQREAAERAMRQRDLGGWPGPGAACAVGSCMTAMRRTRSALTDKAPPGGSGPRRTARRTEDDDTRASRTLEDLRKCHYLCGELGEAWRAPGWRSNHALIENFLRTQVAQTMGTTVLPQERIQDFAKKNRENL

SEQ ID NO: 1021641 - protein, 109 aa, Homo sapiens
MPITSTLGVVGFQGLPRPPNQTNTRVTAMNFNLFSIIAASAVSATVDLPAAASVEVTGKKSNVTAYTQKYLLQSAKLLCGAGSQDSKLIVEGFKPQATRESALGFDVSS

SEQ ID NO: 1021642 - protein, 521 aa, Homo sapiens
MLATRRLLGWSLPARVSVRFSGDTTAPKKTSFGSLKDEDRIFTNLYGRHDWRLKGSLSRGDWVQDKRRSWLKGPDWILGEIKTSGLRGRGGAGLPHCGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYILWSRRQRSSSPFEVQAGQAPPEAPPFPARLWRGVLGWPQQAVDQSLETDVDVITPQVWPPVDAYLLLRGVLADEREAQSTIDSFNHLCAMYNHPLHLWRRSMSVPLKELDLRSMLGGVTGGWDNLLAVIPGGSSTPLIPKSVCETVLMDFDALVQAQTGLGTAAVIVMDPSTDIVKRIRPLIEFYKHEKLWQCTPCREGVDLENKGDGTYREGGCPDGETRITVGRITKARIRKAIQTRAPGGRSRSACAGAGSGTSAGAKTESHRRPQDEARQMAYSTHLTERKGTPLDRGEHNNKERHPPEKQTHTTTAQTE

SEQ ID NO: 1021643 - protein, 418 aa, Homo sapiens
MNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYILWSRRQRSSSPFEVQAGQAPPEAPPFPARLWRGVLGWPQQAVDQSLETDVDVITPQVWPPVDAYLLLLGVLADEREAQSTIDSFNHLCAMYNHPLHLWRRSMSVPLKELDLRSMLGGVTGGWDNLLAVIPGGSSTPLIPKSVCETVLMDFDALVQAQTGLGTAAVIVMDPSTDIVKRIRPLIEFYKHEKLWQCTPCREGVDLDDKGDGTYREGGCPDGETRITVGRITKARIRKAIQTRAPGGRSRSACAGAGSGTSAGAKTESHRRPQDEARQMAYSTHLTERKGTPLDRGEHNNKERHPPEKQTHTTTAQTE

SEQ ID NO: 1021644 - protein, 218 aa, Homo sapiens
YVKNKTQGNYIFFKGTWTQPFDLASTREENFYVDETAVVKVPMMLQSSTISYLHDAELPCQLVQMNYVGNGTVFFILSDKGKMNTVMGELRRDTSNRGAGGLTSSQVDLSIQEGTICGVYGLEEVLEEMGIGDLVSDQANFSRMTQDAQLKSSGVVHAGLQLNEEGVDTGGCTGVTLTGRSTYHLAFEPGLDDHDLRPLAREQAVRGGYDPSGGEPRP

SEQ ID NO: 1021645 - protein, 141 aa, Homo sapiens
YVKNKTQGNYIFFKGTWTQPFDLASTREENFYVDETAVVKVPMMLQSSTISYLHDAELPCQLVQDELRGQWDCLLHPVRTGGGGPQSSVRGGAARVTGGGEALTSSQVDLSIARGHHLWSLWPRRGAEGVHGGVVNQPAEF

SEQ ID NO: 1021646 - protein, 315 aa, Homo sapiens
RGAWRLLPAARESDSGGGPGGGSGGGGASMSWLFGINKGPKGERRWGRRRLCRPRSPGPSGGGDLRLGMTWPGCPEDKLEQLSDPTCALDAAALSNGWLLLMLDGTLLFMPMDALNLGTECMDARRLQCGCNMSNAQKSMSACLWMQLNELSRSWAQAEERRKNPERGDPGSTRPGPSIHRHSVRPGTRYRRTELYSKAANYLELTGRIYRTRRTDVLCKKQDSPVRRATGVSWEMELRHKNEMLRVEAEARARAKAERENADIIREQIRLKAAEHRQTVEYIRTAGTLGEGFRAFVTDWDKVTATVAGLTLLAV

SEQ ID NO: 1021647 - protein, 301 aa, Homo sapiens
RGAWRLLPAARESDSGGGPGGGSGGGGASMSWLFGINKGPKGEDAGAAAAFAARAARGRVAAGTCGLGPPKDKSNFDPTGLEAAKAAKEMSTLLFMPMDALESGHRMQGCKTLQCGCNMSNAQKSMSACLWMQLNELSRSWAQAEERRKNPERGDPGSTRPGPSIHRHSVRPGTRYRRTELYSKAANYLELTGRIYRTRRTDVLCKKAGQPMRRATGVSWEMELRHKNEMLRVEAEARARAKAERENADIIREQIRLKAAEHRQTVEYIRTAGTLGEGFRAFVTDWDKVTATVAGLTLLAV

SEQ ID NO: 1021648 - protein, 93 aa, Homo sapiens
MVGTTKVSDRRRTSDFLFLINETILGKCFRSGPSCAGSKNFTSSGALGMPPDVPLNHGLSSENQHNENRGPIPLFLSCGIQAMIKRDGRFKCG

SEQ ID NO: 1021649 - protein, 189 aa, Homo sapiens
SCLQHFVATGCFATIAGLAPEQQLRTLGLQSFARCGKGGAGAVFGGQFIGDCSGWAACDGLAFITQLAVDLADRAHGVNAFLVFSGAVIDDLRINLTGYRREILAAGQIGGKYHGAETTKAQGTDTSFTQAHRISEPWPMLVTAISSVFMVDSLSIRPASAVDPAKSRRGEEPIETVCNKSRTGLVIQV

SEQ ID NO: 1021650 - protein, 69 aa, Homo sapiens
GLFQRVEDLGVGVGPQYFFDTHVVVDEEMTRHVQHRQGVGGPDTGFAVDFNWQLRGDLGHGNSTPENSF

SEQ ID NO: 1021651 - protein, 131 aa, Homo sapiens
MALHVPKAPGFAQMLNGRERNTYQRLEQAVYEKHTSLLTELDHTTLYSDMDHIGTVNIELVIYTILQKSFVINNDASYLVLIRSRSTAFLLLKVSRKGLLSTAESKKSEMALNLCSGYLLGSSPGLSCKNF

SEQ ID NO: 1021652 - protein, 190 aa, Homo sapiens
MQPDELRLSWCAVHMSPVLWSLMKNCVLVEDTMVCCELTDGWSAGMPAGLMFTVCPCPMEELLKCVQAAPVLGYCTRWALLAALLARLALACLLGACGHNLCELPGVCRRDYRTQNVVGTRGALYLHRLTFSAFQGQLVRATWRGLKGRLDYLSSLKVTGLVLVSTSQDQKDDVAQTDLLRSNPIWLNEN

SEQ ID NO: 1021653 - protein, 63 aa, Homo sapiens
MIIWMDAWSLAPMMQLAESEHWCAPSRTGFQELAGAQFCMFEHAVCAFDCHHPACDVELAGSW

SEQ ID NO: 1021654 - protein, 303 aa, Homo sapiens
GSWSRSADGQDLRLGPGHSAAVVLGKPTESLPCLSQSANLSPPPPLIRRPLPPSGPGRPNLHHRRAPGARDPKRNMSAVRGPRTRTHGPIARPDNMMRGDRQVPGRHNAASISDGECEDPGGEADGSLAGRDPCKNGKMGRHETPGNPRQTQRNGPEQGGWTTKTATHQHGQAAPEEKPQTAPDKEAADDYDQLTYSNTGKTPLERSKQAKKRQGAGRYRKEAYPTRRPHQIPKDRTPEHGAGKDHADTQRGANENAQRKTASSATKAEPATKHKDKQRQHRQRAAHDNRKEDTKKKKQKEND

SEQ ID NO: 1021655 - protein, 149 aa, Homo sapiens
MLLELDITVDDAWLCSIVVEEFQPSCGRLRRSSTRCIHDKTGPGWDPFDTLFTMENIMQGASCRILISKNTGAPHSSGTRKVGSYCHVCPRETADTCARNSWSGCLPESSLFTAHFVAIFEYTKENSRVRPLSYKSIIAEVLGYFLQFF

SEQ ID NO: 1021656 - protein, 314 aa, Homo sapiens
KHSLGTTLDVSPPLQPSPSERRVPTRQKLGALGVSRRQARGRTGERAGSRSGGGAGSSGAAGSRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNCACKVHRTYVVA

SEQ ID NO: 1021657 - protein, 267 aa, Homo sapiens
MHAVLLAGAPCADGWSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNWYRYINGRNSSDVLVYVTSNDTTVLLPPYDDATVNCACKEHRQLKWLLSLHVGGAEG

SEQ ID NO: 1021658 - protein, 209 aa, Homo sapiens
KHSLGTTLDVSPPLQPSPSERRVPTRQKLGALGVSRRQARGRTGERAGSRSGGGAGSSGAAGSRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVHY

SEQ ID NO: 1021659 - protein, 73 aa, Homo sapiens
EPVRCGLVNVTLLVERQSGGVAVCLEFLRDSLGFSMPCVRPEAGAEVHRVSVLNRELAISEALPGQVFGMWRE

SEQ ID NO: 1021660 - protein, 188 aa, Homo sapiens
MRESYYSVSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADASSMRSRTFLICERHEAELLRRDPLTSLSVGREERRWCWTLDLLRVDKGGDPALMREMQEKRFKDPGGSGQLVKADSEW

SEQ ID NO: 1021661 - protein, 112 aa, Homo sapiens
MRESYYSVSVGPGGKKMVLDLDLFRVDKGGDPALIRETQEKRFKDPGLVDQLVKADSEWRRCRFRADNLNKLKNLCSKTIGEKMKKKEPVGDDESVPENVLSFDDLTADAVS

SEQ ID NO: 1021662 - protein, 217 aa, Homo sapiens
KDPRRHVMNRLVDVLSEPMLAAMACLPASSGPVDMRAAEPADCDAANVLGCIHGWPCELMELLTFVTLRHHWMGDFCLGSCVLGPCACPSSTFPLGAPVLMAWDSSLWMDVHVLCLGTITLLLLAVVNMHDVNDHVDLVTCLVPLCLCSGGAWLKVSPGGPGDSQWSENCWQTSMTDFYHSKRLADLLQEEALIRPQEACSPVKREGLKWPALHLLP

SEQ ID NO: 1021663 - protein, 50 aa, Homo sapiens
MQVRTNQPCKFGLTSHASSGLTSHASSGLTSHASSGLTSHASSDNQPCKF

SEQ ID NO: 1021664 - protein, 43 aa, Homo sapiens
MQVRTNQPCKFGTNQPCKFGTNQPCKFGTNQPCKFGLTSHASS

SEQ ID NO: 1021665 - protein, 339 aa, Homo sapiens; identical to SEQ ID NO: 823478

SEQ ID NO: 1021666 - protein, 326 aa, Homo sapiens
QRAGIMVEWNPPFTPLGGPCALTQSLERAPHVLEVFPHFRVPVPVLRGRPVFISVGYVDDTQFVRFEKTPESEDGAVGAVRWSRRGQSIGTWETLERQDTCNRFSDVNLLDRCAATTIMRRGRVVTSPASGMHGCELGARRSASSAGMNQFAYDGKDYLTLNEDLRFLDRGGQRGSDLRAKTSNDASEAEQPESLPGRHMPWSWLHKYLAEGQGDAASLKAPKTHVTHTISDMRHLRCWPASTLRDNSDRPQAPKANQGNGPGNPPQELTSNGQPGGPTPTIRPRTDGPPAGRRPHTTEDARRRQRQTRGNKDTEATEHHHHHQHG

SEQ ID NO: 1021667 - protein, 142 aa, Homo sapiens
RLERLCNRTRQERTRGEAGHCCVTARRLTTLRCTHARHSPSSRPYFLHFPLLPEPEEPLFPRGAFWGPRSSPPLPPSPEGSEKRPRPERKSGVATGEKLTPIADSRRQKGPPTSSVLQLSGTIEGTMSSLNIVVEESKGCKL

SEQ ID NO: 1021668 - protein, 116 aa, Homo sapiens
RLERLCNRTRQERTRGEAGHCCVTARRLTTLRCTHARHSPSSRPYFLHFPLLPEPEEPLFPRGAFWGPRSSPPLPPSPEGSEKRPRPERKSGVATGEKLTPIAAARRHEMATDTHR

SEQ ID NO: 1021669 - protein, 152 aa, Homo sapiens
MPSKGPLQSVQVFGRKKTATAVAHCKRGNGLIKVNGRPLEMIEPRTLQYKLLDSQFCFSAKERFAGVDIRVRVKGGGHVAQIYAIRQSISKALVAYYQKYVAMTVFHSNGSIKEDRCLIQYDRTLLVADPRRCESKKFGGPGARARYQKSYR

SEQ ID NO: 1021670 - protein, 148 aa, Homo sapiens
MPSKGPLQSVQVFGRKKTATAVAHCKRGNGLIKVNGRPLEMIEPRTLQYKLLDSQFCFSAKERFAGVDIRVRVKGGGHVAQIYAIRQSISKALVAYYQKYVDEASKKEQIKDILIQYDRTLLVADPRRCESKKFGGPGARARYQKSYR

SEQ ID NO: 1021671 - protein, 133 aa, Homo sapiens
MRPVQYSWEIERDLGNAIVLTVQIDLLADDLGLGFHLPMLGQPERVAGLGGYRQGVALGIHLHPSVGLVVAIQAGTHGHQVDVPAGRIGECPVSAEVVAVEFDPPGAMVLPAHCKALHVAAQAALADKEDSFG

SEQ ID NO: 1021672 - protein, 239 aa, Homo sapiens
WEAPAHGPERQGPEQGAFVHDPSRGTVHHTHPLSCTWAKGVCHSASRARWRAGEGGGAQVSETPQRRPESPSEGPACVNTKGRPRTLVGKVSGAHTLIALHPKRTCIRDSIPSLPNSVPEAKKFPRALSHFSLVFPVKLLPAPIVAGPFTRSRRRGEIVPVAEATVIIPQGESLAALRRVPMGGVHNQDALPGGGLQIHMVHTCASLPTTWEFLSCVDDIRGTLGGKANKRASQVLEPE

SEQ ID NO: 1021673 - protein, 77 aa, Homo sapiens
MGSRARARETHVGDILQLMFEGWACVRLSRNMMNSEKGEGVMDTTLGYTPLEGGWERRSQQRNVKRDWIIFPSYSQI

SEQ ID NO: 1021674 - protein, 200 aa, Homo sapiens
MKIYTYEQLTRDLGEAGVWTPLPSTMDNIHLHPEEEKYRKIKLQNKVFQERINCLEGTHEFFEAIGFQKVYASLPRIRSDPEEIIRAEDETTLAQPQSLERHKEQLHGLRSTVLLPMLDRQRRCLPALDPWPRSSNCLGTYFKLTAEEIKREQRLRSEAVELAELCCWTKDMLWIMEEQLGACASKTTRLMMRAASPMAY

SEQ ID NO: 1021675 - protein, 110 aa, Homo sapiens
PQCTLQVVDSQGRLGLGLVQDVWCMCVRCCKGATVHEKCISGFLYGPRVIPEAPASPVALWRLSELDDADEFGYSRLRRGSGFGPQPRSRLVPLPLPGGCCSTPNPREGL

SEQ ID NO: 1021676 - protein, 296 aa, Homo sapiens
MLATDEWSGVTALGVSKLHLAGTKVDLLSSVLSCSKLRAGELSVNLSNLRSYKRPLSRKERLEIGAQRSEIRGRIRTYREEREIHATGYYKVDDPVWNIHNCKDAELPTIYRKVYEQPFHMLSPRERRGTIAIQAPWTSPVSRVLLSEKRQEKFLMENRVQSFYQQELEMVESLLSLANQPVIHSACSDQVNLKKDTSFQGNSSILRSAIQLLRGKRTVSFHEPLMVLDNLYYVPGADHAARMIPGIFSRTAEAIPGEGLPLSALLGCVRLGSARLATVSQQSWARGPGPVASGFQ

SEQ ID NO: 1021677 - protein, 290 aa, Homo sapiens
ILWLEARRLHTGVAATAARIWASRHGHDPSEVSSGCGCWFAGTQGVNRWVNIAGGGWGRANQTQGPGVGGSFLLEGQVGHLLVLTMLVGTLDLIAQGPVLPVPLGAFRGNAHPGPSGAGGLPFRGQGSGPIYGCDEGPVRVGTEASTGRLASPLGLALKRLDCQAQRETLVVALAGNDRPRKHAYILWTSPVELSEALGQIFDSQGGLDCPSAVNVQGEDALGFCGAHGHPDCNLEAQALLEKEPGSSVPLSVDAECVPMGRGLLRYLLLPGGICFSLFVVIVPQAGSGH

SEQ ID NO: 1021678 - protein, 280 aa, Homo sapiens
GSVAGSEEAPHGRCSYRSQDLGIQARHDPSEVSSGCGCWFAGTQGVKMYGDMAAGRMGAPTRPGIAWEIFYEKASGALCVITCGDLTDARVLCTGPGLREVLDQGLGNEHAFVARDSGPIYGCDEGPVRVGTEASTGRLASPLGLALKRLDCQAQRETPGGGSGTEMIDPGSSQNPWTSPSGALRGPCARSLTASGACDCPSAVNVQGEDALGFCGAHGHPDCNLEAQALLEKEPGSSVPLSVDAECVPMGRGLLRYLLLPGGICFSLFVVIVPQAGSGH

SEQ ID NO: 1021679 - protein, 402 aa, Homo sapiens
GEWRAGASAATHTPRSVLVPRVCGSLACRPSCHTDCYPGVAQGLVTPLAGPGRGPRSPQGSWTSVAVSTLPVEEESSSETRMVVTFHDVHALESMCQELAKSKAEVACHRTLYATRRVCRPEPDSSDAPFRNARPRIYSTRLLRNPYLYGCFTLQIHLVFPQHLPKQESPGHSTIHRGIVPSSLALTDYMPVSIPKQNTEFSIIHHVVNYAPITHAILYTLTPPGPFNLTFPHTHTSPNNIPISTPPPHSQPLHTLGTHNQPAKAARMKKPHRHPHQPPHSFPPNRVIHRRSICSHSHPPPTTDVSSLLLRTNSEHVPPVQPAHPPPTHPSQSSLLRSPRPHLPPHASLSTLDYNISYQSHQINLTSYPPPPHSYGSLPLSILRHTQHHNTPPTHHTSFAPY

SEQ ID NO: 1021680 - protein, 368 aa, Homo sapiens
AERGSALGGSSGRGAGRGRRAFPLGGVGRPGAGRGAPARGIRSGGSRAGRSRMAAAAAAGEARRVLVYGGRGALGSRCVQAFRARNWWVASVDVVENEEASASIIVKMTDSFTEQADQVTAEVGKLLGEEKVDAILCVAGGLGRGPMPQSKVSLSRTVTCCWTARRIWAIDQSPAHLATKHSQRKGGPPKPWLAHNGCPGMGLLAMIGVRHGHGVLFTKLCQSLAGKEQRHAARGQPAIRLCSPGYPGIPRGTTELHCLSADFSSWTPLQNSYVENFPMTGSPAKTDPSSGSLIPRGNHRTEGRNFTPAYFYRLHLRAYAGGCQQPSLTCLTVALSTLVVPCNPVAVETKRLLFLTTLLRPQDASTPR

SEQ ID NO: 1021681 - protein, 85 aa, Homo sapiens
RRLGSPNPNPLVGGHLVPFGGETVSFPPILLLVSRVAPQPLLCIASLLVYTYAYWFCVKSFLLLKLGMETESSSDGWRRIGPHSL

SEQ ID NO: 1021682 - protein, 55 aa, Homo sapiens
MCCRPAAPGRDSGQSHIPEPELTVYDPNNIFARILRGELPCHKVYEDADTLAYST

SEQ ID NO: 1021683 - protein, 127 aa, Homo sapiens
YAIRKKSQGIVDNKEYAVNEVVAGIKEIIQCDVGTQLLYKFERPQYAEILLAHPDAPMSQVYGAPHLLRLFVRIGAMLAYTPLDEKSLALLLGYLHDFLKYLAKNSASLFTASDYKVASAEYHRKAL

SEQ ID NO: 1021684 - protein, 234 aa, Homo sapiens
KIRLGTRPGVNRPRLCPRSPRPPRPRAPRHAAPPRPAAAAAALLYGTVGAADGPAGCLVVPLLLLALLCLASCANNAFAFWSGAQQPHHCLLAIQTHKLCLPVACLPPSYLHVMQHACMQHVALAALPLHACLCCLPSATLPAGAAAAPSPPFSFHACRAALSRLARVLTAPPKAPRTPCRHRDDATYGGSLELLAALTRPLSLPSLDPGLPAANSSSLLLHLRATECKDGAAM

SEQ ID NO: 1021685 - protein, 109 aa, Homo sapiens
QDPSVYISRRFSPDPMANDEQDRWRRLLDEEMSEVISPYLVERDGISTELATVREHKRQIEYGIKVRKQQNEIFGEIETLGRTIDRITLQLDELRKKAPSIGEVLSVLG

SEQ ID NO: 1021686 - protein, 305 aa, Homo sapiens
EEEGPTVVLNPHPSLVLQGDPGKARVVSECSGCVMELVKPGAEECSGPRREVENSEHSHAEMSDVSDGDWQCGPCNGLFLWVGEGAGELDAVRWFEGAVLSKEWDVTPNCWSNDVTMLANVMLDVLRMLAGWCAGGGVRDNLVTCSMNALLPGVPCVPTVLHVGPVGLQAAELMGLEAILPVDVTCLDVLVPAPPGVLSATPEDEEMRRSGSCKPADQRTSELESLSAIECRAGESGPPAAGTTAGLRHRLQGWAQGTLVALALAVPWQAWPDARTLLSVGMEAQLASQAALLPYGLSYLVHCLG

SEQ ID NO: 1021687 - protein, 291 aa, Homo sapiens
EEEGPTVVLNPHPSLVLQGDPGKARVVSECSGCVMELVKPGAEECSVTPKWKWRTCEHSHAEMSDVSDGDWQCGPCNGLFLVVEGAVLSKEWDVTPNCWSNDVTMLANVMLDVLRMLAGWCAGGGVRDNLVTCSMNALLPGVPCVPTVLHVGPVGLQAAELMGLEAILPVDVTCLDVLVPAPPGVLSATPEEKKEEEGSCKPADQRTSELESLSAIECRAGESGPPAAGTTAGLRHRLQGWAQGTLVALALAVPWQAWPDARTLLSVGGGSAASQAALLPYGLSYLVHCLG

SEQ ID NO: 1021688 - protein, 232 aa, Homo sapiens
SASDRRDDPSPKRPETNPSWLASPCMWPAGEREGRSVHPVARTGGEGALLSAREVIMKSGWSDCPTPGMPIHARGLGQLLSELLKGASFSLRAVSCSLLLSPTGEHVCLRRDTARSYGFDSSPCLSPAGPALGVWQAEPGPGRKQIFQMMGLPSQRAHVGAKAFLCQSCASLGHIMPFGEGNRPMVVLWEVCDLGMLEGPHLTKGLLVVPKGAPVRALGAFREPKLFLGAPF

SEQ ID NO: 1021689 - protein, 322 aa, Homo sapiens
WAEGAVRRWQLVGGGGVEGLRSSSRWTNPHVPVACDPEPCSCTGKLKTGLGWCLLSPESGHLCVSPPGAEIRMFRCMRDCGGLMDPMFADGSLCYSAVSNMSRMWSGGFGYSPPFLMQSQDCATVPCGPEACPGRLECSEAWKTVIPTFGIAWEMSGGFMDMFGMMNDMIGNMEHMTAGGNCQTFSSSTVISYSNTGDGAPKVYQETSEMRSDQAGSGRHGGLFGMQTVDWRQMSIGHPIRDRAHILPGGPKTIAPGEPGGAAGLIIKLDESEAAAVDDEWRRKGPHRRAIQGPEDSSSRTVPPLMTGEGPGLKLSGTRLRG

SEQ ID NO: 1021690 - protein, 264 aa, Homo sapiens
MTRDEDDDEEEEEEGGSWGRGNPRFHSPQHPPEEFGFGFSFSPGGGIRFHDNFGFDDLVRDFNSIFSDMGAWTLAFPSFLNFQVLSQRPPGERLREGQDTSGLNGLSIQIVTSPGSLGGSWRVMQEGESPQAAPDWGSQRPFHSLDDVWPMDPHPRTREDNDLDAQGSQEVLAGSTAQQIYFKSISVTKITKADGLVEEARTVVGQRGAGQRTTGKRHEGDSTPEGDPGITKNSSLGESVSTWKILGRGYRGRRLVNPKEPKGH

SEQ ID NO: 1021691 - protein, 261 aa, Homo sapiens
MKMMMRKEEEEGGSWGRGNPRFHSPQHPPEEFGFGFSFSPGGGIRFHDNFGFDDLVRDFNSIFSDMGAWTLAFPSFLNFQVLSQRPPGERLREGQDTSGLNGLSIQIVTSPGSLGGSWRVMQEGESPQAAPDWGSQRPFHSLDDVWPMDPHPRTREDNDLDAQGSQEVLAGSTAQQIYFKSISVTKITKADGLVEEARTVVGQRGAGQRTTGKRHEGDSTPYGDPGITKNSSLGESVSTWKILGRGYRGRRLVNPKEPKGH

SEQ ID NO: 1021692 - protein, 96 aa, Homo sapiens
MGHKGAVWGAKLNKDATKDSYSKLQISQPKVWDAVSGDELMTLAHKHIVKTVDFTQDSMIIVKRGDRNKPVTHIMIGTNLKQRLRKLMVINSGYNN

SEQ ID NO: 1021693 - protein, 247 aa, Homo sapiens
RVVTSCRCRCGRCESWLARFSASPHPLLSSLPPFPSLVDCCLLVADSLTPPSPLPNLGATGLPFFSCCPEPALVSGRGPGADPRHCSRREKRQRRPSDSPVRISMSISPTDTMDKGETDRHDINHRQHETQQQQTARSVEIYEHIFTKRPIKQPINESYYSIYTSQDDYRHTDMDKHTYDINSPKEKTYQANAPGNYGTTTLQSEITIPIRWPLLSMTTTSHHTHWNTYTGIDTHPQKNNTITHTKT

SEQ ID NO: 1021694 - protein, 375 aa, Homo sapiens
QAVSARSYGIYKLLSPPPHSVVLRSEFQMGSSPAVLRAVRLYQWSLKSSAQFLGSPQLRQVGQIIRVPARMAATLILEPAGRCCWDEPVRIAVRWPSPGAAWSLLRCCPCADEKGCCFSHVPTLRYLLPTLLAELDLERCCPAAGLCMLLLGLEPHGGLLLGLVSPEETLWCWLCECARVLNCPCAVDAGGCWMATTPDPWGGCLLPDCGTERYFPPGPGGCGAMPVLRVGLVVRRHRIFLLAEPGALSLWIVRTIVRGNLRAGALHVRNRGAYVCWLENGVTGCSIGSALSHSPMNDPPQDPVHHASPSWRTNLSTANPIEIKLWHSRSIPGRLITWPQRTLGALLRKLPNTRAVNPVPIQVPPTLTGHSQSCR

SEQ ID NO: 1021695 - protein, 343 aa, Homo sapiens
LSKDDIENMVKNAEKYAEEDRRKKERVEAVNMAEGNFNDTETKMEEFKDQLPADECNKLKERDFQNEELLASNKTAKQEKILDRQHPLFSQALIEAVRNGIQQRWHLSEKALEAPGTGEQKEDQNGGQNSNNQQNTPKPRRTTYEAYGVKRLPEQIMGELQLFSTCVPQLLLYIHILKFVNTLVTITLVITSNWTADSNSYKASQYSMSLACHSPACTVTQEARIAHSTHHNRFSTIPLLNSDHYPPRGAQPSRTQQRTVRHSTALRHRRPHYGPLTILHTPPVTHRLHTPLPCTSTAPQRRPLPTPPCPRPARQHGNTPPYTHAQTTPAAPRHAPHTSPDRP

SEQ ID NO: 1021696 - protein, 131 aa, Homo sapiens
LSKDDIENMVKNAEKYAEEDRRKKERVEAVNMAEGNFNDTETKMEEFKDQLPADECNKLPFREVCWPAMSRMCCSLMSLPCPGIETLGGVLTKLINRNTIFQQEEQVFSSALMVKRKLDINVCHGEDNGLG

SEQ ID NO: 1021697 - protein, 192 aa, Homo sapiens
MALQRVREAVCTTAKCELSSSVQTDINLPYLTMDSSGPKHLNMKLTRAQFEWIVTDLIRRTIAPCQKAMQDAEVSKSDIGEVILVGGMTRMPKVQQTVQDLFGRAPSKAVNPDEAVAIGAAIQGGVLAGDVTDVLLLDVTPLSGIETLGGVLTKLINRNTIFQQEEQVFSSALMVKRKLDINVCHGEDNGLG

SEQ ID NO: 1021698 - protein, 104 aa, Homo sapiens
MLSDLEDPGMCGVMVTLYTSGTQYSVLKDNPRAIGPSDICGDSVAVLTGSVYEEMANDKNDDCKHNGKKGVTIQSYKNSADVATAVAGGKADLWFSDSPVVDYA

SEQ ID NO: 1021699 - protein, 308 aa, Homo sapiens
MVPLGLAAAAASLFREEKRDAHSAPGPARRGGGGAGKSTAPAAPEVATVCMLPVEDVHSRPSPWAELLWPGPSPGPWALPLGADAGPLALGSLAGLRPQHDGAQPRAALSRTPRSPPRGLERYPQDNMHQMHKPMESMHEKGMSDDPRYNQMKGMGMRSGGHAGMGPPPSPMDQHSQGYPSPLGGSEHASSPVPASGPSSGPQMSSGPGGAPLGMVLYPQALGEQNRGPNPFNQKPAATSSRATDHGPYMLGQGGPLPRTSQEAVQGKRPLARGSNHKPKLTTLRSSAKKPALGPGPLAPAPVPRPRP

SEQ ID NO: 1021700 - protein, 297 aa, Homo sapiens
LVQAWVFDPAARVVRALWPGGCCLGLEAGEAAPAAATHAEPGWLRGGGGLARAPWLQLVRGALRLLGAAALALVGEPWCACTTRRGGTCAPRTSTAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKRGQTTGERLKMEEDGGRVDGAPESHPRCSEATEDWVYEYVVRKGSRNVSVLQENDRGKTYKKG

SEQ ID NO: 1021701 - protein, 294 aa, Homo sapiens
RRRRHDRCAGVRAAVAWWVLPVLQAVSAPQPLLPTQSRAGFAVGGGLARAPWLQLVRGALRLLGAAALALVGEPWCACTTRRGGTCAPRTSTAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKRGQTTGERLKMEEDGGRVDGAPESHPRCSEATEDWVYEYVVRKGSRNVSVLQENDRGKTYKKG

SEQ ID NO: 1021702 - protein, 289 aa, Homo sapiens
GVRSGLRASSQRSLGEPRLAAAAAEPAAALPLLPHPRLARGLLPGWGPSRATARRRRRGRNPALPSLPPQPASGRRSPRGVEREEPRGPDRASGAAPGSQLRRSKIEPQWRRSEAELCRGRAGYIVFRSFRFFPGRSPLPLPGPSPLLPIPLCTPPGPCPALPPRMDRPQAADAARGRVARTAVPQESSNGTKCQVGFTVTRGRQSSCEDVSNTGRLAIRYRMYCQVQLPRHCEQDLPFCKGDVLTIVAVTKDPNWYKAKNVGREGIIPANYVQKREGVKAGTKLSLMP

SEQ ID NO: 1021703 - protein, 279 aa, Homo sapiens
TESDWYRIKQSIDSKCRTAWRRKQRGQSLAVKSFSRRTPNSSSYCPSEPDDEHPTVLPGELPQPLGRSAGTLNYALANAQQVQIHQIGRKTDSVQVIPQGHLPHRPGAARGSKVLVSRTDSEGNLQIHQRGGQGTVTVLQEVHKLIAGGLLRTPGRQGGPCDWVRPTSMVTADYSQGPRSTVQAGRHVEVTTRPGAQDRAKALKPRLTGRRLQLEPRWAIPDSREAGAPWQPGSPSRVSDLRAGPPKRPGSTGARPQAAGCTCSARSGLKGVPPGNNLY

SEQ ID NO: 1021704 - protein, 164 aa, Homo sapiens
MLSGFPRRALASPQGPPPLLVAIDAFTLKASAKQSLTVQEENAVTNHLKFAMLAAWKSFWYQKSALHPLTFRAKTIPSSVVSTGYVEKITCSSSKKNEFKSCRSAVRWNNPYFGSSKGLSVCVALIFAFLVIIRQQTIGQKGSGKGAGSKSTPYSYIPPLYPGS

SEQ ID NO: 1021705 - protein, 83 aa, Homo sapiens
LLTPVLMIICVAEAYGVPTRKATGNPFEETSPQKRESIGVKNNEFYQSKYHFSALVHTGQKICHLIKVTSLGLRKDCYCTLEG

SEQ ID NO: 1021706 - protein, 284 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYTDQTYGNGSKCDLNGRPREAEVRFLCDEGAGISGDYIDRVDEPLSCSYVLTIRTPRLCPHPLLRPPPSAAPQPILCHPSLQPEEYMAYVQRQADSKQYGDKIIEELQDLGPQVE

SEQ ID NO: 1021707 - protein, 256 aa, Homo sapiens
ASAAECRAEEKQLEASLDALLSPVADLKNSLGSFMGKWENEYGPADLGHLSLDSLCLCISGQAEHRLNKVCVSMKKTSACPGIQVIISIWWFVSRPESERVVMRADCDMDRVPCFQATDGKSLKPAENPERLSLVKVVKKEEIANCTIMTAAPHLVQGWRTTIAESTSLILTTVFKAFWYEHSQQDDGATNSEELEVSRLEHSRMLSTSTVHVLPWLAVVAVRARTSLMETFRRGGPGRRPAELGDLVDLRFSGMG

SEQ ID NO: 1021708 - protein, 118 aa, Homo sapiens
ASAAECRAEEKQLEASLDALLSPVADLKNSLGSFIGKWENEYGPADLAICPWTAFAFAISGQPEHRLNKVCVSMKKTSACPGIQVIISIWWFVSRPESERVVMRADCDMDRVPCFQAH

SEQ ID NO: 1021709 - protein, 137 aa, Homo sapiens
MLVSSGEKCPFCGDIGQTKNIDHFLPIAHYPEFSVMPINLVPSCRDCNMGEKGQVFAVDEVHQAIHPYIDKDIFFREQWVYANFVSGTPGAISFYVECPANWRQEDKHRALHHFKLLNIANRYRLEAGTHSGSSRHP

SEQ ID NO: 1021710 - protein, 69 aa, Homo sapiens
ESLLVGVGVHNGVDHGRMWWKKPSAGLPGALVEAVIIVLVVSFISLGMRAGLVVACSNSVGAVDSLNIH

SEQ ID NO: 1021711 - protein, 284 aa, Homo sapiens
LAIYPPCGRRKIILSDEGKMYGRNELIARYIKLRTGKTRTRKQVSSHIQVLARKKVREYQVGIKAMNLDQVSKDKALQSMASMSSAQYRLCQCPAEQGSAHRSPLSPRPSSPLPSRFWSSPPLLGQQPGPSQDTLSPLHMTDYTISEAAPACASDAAVNDELLAHRSPLSCCLCCLCGRTRTIASSRLRLLELFSLHGGAADDPDTYSKHLCVHIGQTNPAFSEPALEAVDVRQIYDKFPENQGGIDTELYAEGAPYCISLQRTGPTSQNTQERPRNPKQKHPH

SEQ ID NO: 1021712 - protein, 112 aa, Homo sapiens
MKLVVGMNIEKVQVREPGVSSVSHVWMPWRGSWWHNLQHSCTVERTALLSPSITSCKVPGTDVLHGQAVGSNPGPDLASLFCVEAIALRTLKPASLRACGDQTSKDEVSMVE

SEQ ID NO: 1021713 - protein, 200 aa, Homo sapiens
MVVRAAAAADGCHGRRGGDVPGSGKSARPSCSCATTCGYLVTQDELTMTLEEFKAQFGDKADVRGVPRRTDLTVLVAHNDDPTDQMFVFFPEEPKVGINDHQWCTAMRMQEENITRALIVVQQGMTPSAKQSLGRHGPQSTSWSSFCRQELLINITEHELVPEHVVMTKEEVTELLARYKLRENQLPGSRRGTLWRATLG

SEQ ID NO: 1021714 - protein, 276 aa, Homo sapiens
PPECWAARSCCSALDPTRQAQATHTRLCAAAPRSIARPTLALPTATGRWDWLVTGSGLMGTCSSGALSALGCLQPCSLPAFPRACGPFPPVDAWLVLSGCPTCTCAGKLAGRHVQPPLAGLSCARCIGPSGLLYLRAALLPLVRGELVLTETRPGPAGAMSFFGFGQSVEVEILLNDAESRKRGRAQGLEDRRKKEKYFLFYDGETASGKVSLALKNPNKRLEHQGIKIEFIGQIELYYDSREHHESVSWVTDWPGLERLPSLQAFDFDVTTLRAV

SEQ ID NO: 1021715 - protein, 107 aa, Homo sapiens
MSGDDRISSVYVESDAIAYYGDNEELRGSTPEAAAQVVQWVSFADSDIVPPASTWVFPTLGIMHHNKQATENAKEVNVRRILGLREYVLTCKTEDFFWLRRNRDDIG

SEQ ID NO: 1021716 - protein, 106 aa, Homo sapiens
NIQRVGTVGGDGQAELFQDVGALGVGEQFIHQLDGVVEDVRILLGQAHDAGVEGHHVIVGHAHVQQALAQGGVEDAFGDCRRTWCRKRCTAGCRAVRGSNRESLES

SEQ ID NO: 1021717 - protein, 54 aa, Homo sapiens
VCSTDVQLVVVSVKLNGEHGNRAFAFPWGRNPLADGFAPELSNSHRVTFWLPHP

SEQ ID NO: 1021718 - protein, 628 aa, Homo sapiens
AFLTPLRHGPVKKLVVKGGKKKKQVLKFTLDGTHPVEDGIMDAANFEQFLQERIKSEGKAGNLGWRGGDHRKGARSKITVTSEVPFSKRVLEISQQKILEEENLGDWLLRSLLTEKRVTNSRYFQINQDEEEEEDEELNSFIWKICHEFLNKIGTKMGVNRGISAVSVRTRPFGIIVKGLPLVRIIYLDLTSFSLVKIQSPGYTTLQDGGYRLKPWTTSVLNGREHGLNIATQVYGPRPGTATKKRLISEPGTRSERKSLVRWVLYCQLCLLIVTPNYPHQLVITLTTHLLPHNDRSITDVINLRLKTPTETQTNDQYCSTSKTEENNEDHRSTEPARQRPESARKHKTEAGRNTEAREPDDTHQEKNDREAENRTADRDQTTTDAHRTHTTTRKAESHADSPNEPRCGHTQRPHKHTPHATRETERGENTAGMNSHKHSRAARGTETTEAKTERPRDDQPKGEDTNAAKRTADAAATPRTHRGDERLHDEEDKEEHEKRPPDQRQRRAGKRRRERRAHAGTRTEEAQRDRQNETQQNSRQEGTKRKPEKRREDRPRRHRHETDTENAQPTTPDRHKNRTTHSNKSRKQRNITGNRDHGARRKEHAQQRDRREQTRTRRKTAPTNSAK

SEQ ID NO: 1021719 - protein, 188 aa, Homo sapiens
EIDGLLISQEQPRMTSRGSQRSCNNPPGQLYDREEGEFKLHSSLRPELQPVAGACVPSKRRAGTVGGRGFSPRVVGRTVTECDRVWALNRTQRAVTASPVQVPTTDIDAKVHFKKGFKASVAFSLREEAASSVARGVHGAVSNHTAMGKEEYLPRRFHITYSVSYIHLEVHPGFPPLDLRNRASGANV

SEQ ID NO: 1021720 - protein, 212 aa, Homo sapiens
MSGVTTCLRFPGQLNADLRKLAVNMVPFPRLHFFMPGFAPLTSRGSQQYRALTVPELTQQVFDAKNMMAACDPRHGRYLTVAAVFRGRMSMKEVDEQMLNVQNKNSSYFVEWIPNNVKTAVCDIPPRGLKMAVTFIGNSTAIQELFKRISEQFTAMFRRKAFLHWYTGEGMDEMEFTEAESNMNDLVSEYQQYQDATAEEEEDFGEEAEEEA

SEQ ID NO: 1021721 - protein, 212 aa, Homo sapiens; identical to SEQ ID NO: 1021720

SEQ ID NO: 1021722 - protein, 104 aa, Homo sapiens
MELALGRFPYPQIQKNQGSLMPLQLLQCIVDEDSPVLPVGEFCGAMVYEFHHSVLCENRPKERPAPEELMGHPFIVQFNDGNAAVVSMWVCRALEERRSQQGPQ

SEQ ID NO: 1021723 - protein, 69 aa, Homo sapiens
APRVTRCPLDAGSSRMPSASAPGLGGAAVPSFGLRTRLVMASQNSFRIEYDTFGELKVPNDKVLLAPSP

SEQ ID NO: 1021724 - protein, 104 aa, Homo sapiens
MMDVLLSYVNSVRRVLVQCLHTLVALAPPVPVGPARRPLSSVEPAAGGAVHPVAGPCGPSSMRQAGSEAHLKVRRPEWLAVITLLNEKEQELRETETHCCTNEK

SEQ ID NO: 1021725 - protein, 168 aa, Homo sapiens
AGRGLSGRYRRGTSAICCARRRRPALLRTPALREYGNLRRQASPVLCRQTQVRPAGINRSCVWRSEQLLSSATCTGEECGLMLAAVFETDERIMGQATFWSIWLSREQRIGLAVPWRRRWRAWGPILMPTAPGSTQPYYIKALSKDLPKAVELLGDIVQNCSLEDSQI

SEQ ID NO: 1021726 - protein, 327 aa, Homo sapiens
AGRGLSGRYRRGTSAICCAAASSALLRTPALREYGNLRRQALQFCVRQTQVRPAGINRSCVWRSESAPLSATCTGEECGLMLAAVFETDERIMGQATFWSIWLSREQRIGLAVPWRRRWRAWGPILMPTAPGSTQPYYIKALSKDLPKAVELLGDIVQNCSLEDSQIEKERDVILREMQENDASMRDVVFNYLQCRSEVSRAHLIAQAVEGPSENVRKLSRADLTEYLSTHYKAPRMVLAAAGGVEHQQLLDLAQKHLGGIPWTYAEEAVPTLTPCRFTGSEIRHRDDALPFAHVDIAVEGPGWAAGQMWLASGNAIIGTYDCTLWC

SEQ ID NO: 1021727 - protein, 60 aa, Homo sapiens
SLPFTARTAITAITAITAITAMHCHALPCTAMHCHALPCTAMHCHALQCITCSACTACTK

SEQ ID NO: 1021728 - protein, 69 aa, Homo sapiens
MTAITWSRVTSTPQADSEREASPLGSSVEPGTEEKSLISDKTAEWIAEDDDDVFVASRTTEDLFTVIHR

SEQ ID NO: 1021729 - protein, 116 aa, Homo sapiens
MEGVNLYVKNLDDGIDDERFRKEFSQSGTIISAKGYDGEVVSSKGFGFVCFSSAEEDSKAVTEMNGRIVATKPLYVALAQRKEERPGSHSSNPVYAENGQVYELFPIHVINTSFER

SEQ ID NO: 1021730 - protein, 198 aa, Homo sapiens
GLLGRDYEKVPLPYSVFVNTTESYEVERQLQGYKPSGESRQDEFLTSIRATPSYQVSGHSFPGCARCGTQTFMNKCAGNYRIFEKRLRKVPTMEGRRSVFVKCRAALVDARTTAHCAAHANQSLLLLAPLRLQLGLGDGTSDVAAQAKAVTGALTPGHTGSHRGPDPTEATQTDMGPLWEGEQEQGCSLPRASVMDIS

SEQ ID NO: 1021731 - protein, 186 aa, Homo sapiens
GLLGRDYEKVPLPYSVFVNTTESYEVERQLQGYKPSGESRQDEFLTSIRATPSYQVSGHSFPGCARCGTQTFMNKCAGNYRIFEKRLRKVPTMEGRRSVFVKCRAALVDARTTAHCAAHANQSLLLLAPLRLQLGLGDGTSDVAAQAKAVTGALTTEATQTDMGPLWEGEQEQGCSLPRASVMDIS

SEQ ID NO: 1021732 - protein, 173 aa, Homo sapiens
SQDYKWRHLITPAGLVLMLLCGQLPPVRRFCPDLLVPEVSVGGRHLGPFPPFSAPPGLGGPGGPHSGSLGLNVGWGMTAVLSDVSPIKIWVNGSANPRGHPGGTGAGCESSSRVEPVLIVGSKLLVLGQFDGIHPFGDFQLPGLFGGRLPKALTELLRVHVFNRYTPGIVRID

SEQ ID NO: 1021733 - protein, 60 aa, Homo sapiens
GTVCPYLAPEYIHVSKELEYTIGQCYKRAREARHEFMTVEHLLLALLDNPSAQAVLKACG

SEQ ID NO: 1021734 - protein, 44 aa, Homo sapiens
LKKLNRIAWSNQHFRTPTVLEKALAAIQQLMMTLDRTVSEDGLK

SEQ ID NO: 1021735 - protein, 110 aa, Homo sapiens
TPYTKTHSTIHHTAHTCDTKTHSTIHHTAHTVTLKHTQRSTIQITPVTLKHSTIHCTDHTCNTKNTLNNPLYRSHVLHKHTTIHYTACTCDTKTHSVIHCTAHTCDTKTH

SEQ ID NO: 1021736 - protein, 222 aa, Homo sapiens
MGVARFFDSMCLDVFTQWLPLSNFVPPRPSPAPSDSPASPDEDLQAWNVSLPPTAGPEMWTVAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVYYNNKGYHSMPTYLNSLNNAILRANLPKSKGNPAAYGITVTNHPMMYARADSSVQVG

SEQ ID NO: 1021737 - protein, 103 aa, Homo sapiens
PLCPIPAVSRAVRASCGLAECLEARTSHSYYLPRRASGRSTREMYLHRFWGLVTVCKSNTSLKAVKKKKTPGLWARRNLLLESTQELPGSGLWEALGFHLSSV

SEQ ID NO: 1021738 - protein, 388 aa, Homo sapiens
SGASPGDNCGTERPMPAVPPPPPPQDSPSEPLESLWQNSNGRRSSCSPGEHGCHLRWIEPGQVAARTHSQVAVAPASPDRMSGSDGGLEEEPELSITLTLRMLMHGKEVGSIIGKKGETVKRIREQSSARITISEGSCPERITTITGSTAAVFHAVSMYCFHNWMRTFCAAPANGGTCLQASSDPAPCHPCQSSCGSLIGKAGTKIKEIRETTGAQVQVAGDLLPNSTERAVTVSGVPDAIILCVRQICAVILEYPPKGATIPYHPSLSLGTGLLSANQGYSVQAQDGGWDPKLEGTKAPAAPNAMQGPFGNPSVVARTGSRDTDQLTGVLGSQRFAWLCDRAPEDIHRYSEIRQMSRGTYQDRETKQRAPESGLSPSLALRSPSACP

SEQ ID NO: 1021739 - protein, 397 aa, Homo sapiens
SGASPGDNCGTERPSRRAAAAAAAGQPQREPGQVAARTHSQVAVAPASPDRMSGSDGGLEEEPELSITLTLRMLMHGKEVGSIIGKKGETVKRIREQSSARITISEGSCPERITTITGSTAAVFHAVSNEFAVFPKTFGKLKGNPLFLLGPLGPFPPFGVPKAKKSFVGGALWAGDNTKIQTFVGFLSQASSDPAPCHPCQSSCGSLIGKAGTKIKEIRETTGAQVQVAGDLLPNSTERAVTVSGVPDAIILCVRQICAVILEYPPKGATIPYHPSLSLGTGLLSANQGYSVQAQDGGWDPKLEGTKAPAAPNAMQGPFGNPSVVARTGSRDTDQLTGVLGSQRFAWLCDRAPEDIHRYSEIRQMSRGTYQDRETKQRAPESGLSPSLALRSPSACP

SEQ ID NO: 1021740 - protein, 360 aa, Homo sapiens
SGASPGDNCGTERPMPAVPPPSAAAGQPQREPGQVAARTHSQVAVAPASPDRMSGSDGGLEEEPELSITLTLRMLMHGKEVGSIIGKKGETVKRIREQSSARITISEGSCPERITTITGSTAAVFHAVSMYCFHNWMRTFCAAPANGGTCLQASSDPAPCHPCQSSCGSLIGKAGTKIKEIRETTGAQVQVAGDLLPNSTERAVTVSGVPDAIILCVRQICAVILEYPPKGATIPYHPSLSLGTGLLSANQGYSVQAQDGGWDPKLEGTKAPAAPNAMQGPFGNPSVVARTGSRDTDQLTGVLGSQRFAWLCDRAPEDIHRYSEIRQMSRGTYQDRETKQRAPESGLSPSLALRSPSACP

SEQ ID NO: 1021741 - protein, 209 aa, Homo sapiens
VQPGEPGTWSRSRRETPVVCVLECGLAVIPPLTLLPGGGPWREISDLDLDDLMQACVCLRAHQVRAECQGPVLLSAMMRSWRVMSNVQRVDSPVTCVRADIHGQFYDLKELFRVGGDVPETNYLLHGGTIVDRGFYSVETFLLLLALTVRYPDRITLIRGNHEQRQITPVYGFYDECLLQVRLGDCVALLVLRSFDYLRLSPSSMARSS

SEQ ID NO: 1021742 - protein, 136 aa, Homo sapiens
PDCGIECMTAREHGIDINPSTIIIRPDARIWQIVYKNVGDNDRGITRLQEFNYYATRMLQNRQPGEKVLAVVGRSHMNTARNVPGVAELTGGIGVGVYPATTTDKSIAISGPSIRRDAGASVANSHTAGDYQIFQK

SEQ ID NO: 1021743 - protein, 455 aa, Homo sapiens
MTHVYLWEYGYVASLMGPKQRPSLPGYDPVMKQCWWKAYLRVLDFPKCLHGVTLLSQSQDSWTWDLELTDAASRKDCSIAVASSCDPTPTMTATRRSPLPSTGGGGPPAAADAWHQKGVKRRIAVMQRPAGPQTTWRTCRLCCRRGAQVRVVDMQKLTHGVLHSQVLGGWTRPTSTWAVPTMDWRSLTQCQRSWAWSCTTASCLARDLSKIFEAYWFLGQAGSSIPSTWPRFYDTRYNQETPMEICLNGIPCSGLPGECAPTPVSKWPHSRPEGSTQRGGQLPGVSSTVAVMNYLPTLEFSHPHRFWPAIDDGLRRATYYAWRPGAPVHLAAGDYSEPVHAGRSCSLWSVPADNHSPARDIQVTCLCGPRRSDGPGSDSHMPVSNHEQRYMVTERASYIGVLQGGLATIFTETAGTSLLVALNGRGGLREPAGGHFAEGLGLPLWAWPFTSCPLG

SEQ ID NO: 1021744 - protein, 38 aa, Homo sapiens
TPITLNNNVSIQKYCTISQPLLPNWNKESGAKFTWIEM

SEQ ID NO: 1021745 - protein, 68 aa, Homo sapiens
SGLLAPPSSLNANSALPQMLDLTGVRYKTVTKVKSSDYYRCKWQIHLKKEILKKVSETDYATSGSTEV

SEQ ID NO: 1021746 - protein, 68 aa, Homo sapiens; identical to SEQ ID NO: 1021745

SEQ ID NO: 1021747 - protein, 49 aa, Homo sapiens
ADNYNSHCMPILIILRSTVFLGTALYFLIRPDLGQPSDLLGYDHIYDVI

SEQ ID NO: 1021748 - protein, 116 aa, Homo sapiens
VYASWVTGSKRLAGGSSGFEALVGLQRCGKQSTSELRRTARRPSPARADSEGVALICTQQSAGGVRVLGPRSPSPSFSLIPTYCGFPHGPRPSSCWAEASSGLVLSYHLSRAPVAP

SEQ ID NO: 1021749 - protein, 207 aa, Homo sapiens
METRDTHSLAATWDASGVARVLPPSQQSVSRPLGGFRRPLLVLLESECAGGSSFPGVCTNFTSDVCLGMDDACWTPGDGLGQPLIACLRAPATCPVAMEGPRELDMPDLIMAPWDPSGSDSVAEGPMMFAELSSGVHASRHASKGKKALRPLARGAGTLREQPETQRTQSNRSKDGEAHTRGPGARGTAGPQPADGRHHTREHEQPR

SEQ ID NO: 1021750 - protein, 310 aa, Homo sapiens
ENAPAIIFIDEIDAIATKEIRCSDRGRQGGSREILLETADIYMDGFDQNVNSLKVNHGPQTRGQTPWILALATGQDGMAPEKLKFSIFHDRRQEEIDFVFHIFTSKMKPHHDGRLICWKDIVVAPAQSKDFAESLISDLHSVRRDGKVGWSVKTDYIVPGPEDVLKKAYKYMLHSEKDAAGSMKFSQCDPIPIPLLSQHHLRGWGFSRSPSTSVPKPHSLFAFTQGLGFFKLDTDKDVPYRDEDDRTFESILCSGSRTEQEFIVLVTVARPVVPWNPGFLFVCRRDNLPGLPYKEGPYNVGNPGSPVDPG

SEQ ID NO: 1021751 - protein, 60 aa, Homo sapiens
TEVLKSVVAKFNASQLITQRAQVSLLIRRELTERARDFSLILGGCGLTELSFSRESRLLE

SEQ ID NO: 1021752 - protein, 318 aa, Homo sapiens
TKWSSIPCFECHGWVTCSHEDLQHPPVPGGVSVRTCVLEKLQLAPVPPVHEMEPWERGEQCLLVVRVTPDGTHFACTKFASPFVMDDPSTLSSEGSDTQRRADDFPVRDDPSDVTDEDEGPAEPPTAPKLPLPAFRLKNDSDLFGLGLEEAGPKESSEEGKEGKTPSKEKKKKKKKGKEEEEKAAKKKSKHKKSKDKEEGNGVSGDVRAAAAPAQQGEDGCLMMLECFPGVCAGAPGRACHPGVWRLRWSSRPAWAVCRPVGGVCVPVTAWGGICLCTIALCRCPVACRVLLLSLEEAGHLVVPRAGPCRVLGLQGPV

SEQ ID NO: 1021753 - protein, 41 aa, Homo sapiens
MPGSAAITMVSRAIRCTTRCHCNSSEHRKTIVGAGLLAKAA

SEQ ID NO: 1021754 - protein, 295 aa, Homo sapiens
RWRLPSESAADLEGGSGYGEPKGRILASPVRVPSSHTGAMEVAEPSSPTEEEEEEEEHSAEPRPRTRSNPEGAEDRAVGAQASVGSRSEGEGEAASADDGSLNTSVSRPLSPGRCPRQPLRSKFGHQGSTVHEKVIICLDLSEEMSLPKLESFNGSKTNALNVSQKMIEMFVRTKHKIDKSHEFALVVVNDDTAWLSGLTSDPRELCSCLYDLGDGFPVPTFQFLGKDFSSLIQQKTDAFRSQQNVQTIPPPYVGPDIPGLQPSNFASPSLLEEPMMKHVPVPYFFFDVGYIPQA

SEQ ID NO: 1021755 - protein, 281 aa, Homo sapiens
RWRLPSESAADLEGGSGYGEPTQEPWKWQSPAAPREEEEEEEEHSAEPRPRTRSNPEGAEDRAVGAQASVGSRSEGEGEAASADDGSLNTSVSRPLSPGRCPRQPLRSKFGHQGSTVHEKVIICLDLSEEMSLPKLESFNGSKTNALNVSQKMIEMFVRTKHKIDKSHEFALVVVNDDTAWLSGLTSDPRELCSCLYDLETGFPVPTFNSWAWDFSSLIQQKTDAFRSQQNVQTIPPPYVGPDIPGLQPSNFASPSLLEEPMMKHVPVPYFFFDVGYIPQA

SEQ ID NO: 1021756 - protein, 132 aa, Homo sapiens
SSESTAMSGGPHHHTSSFGENLDSQRTPAVVSLLLVLSPKPSTRASSSLENYQAQMNTALAAIQGSGWAWLVQDKQTGSIAIKTYGGKLILGFSWWQRRSYLSKSHFRTRTPLLDSSSPSLVLMLGSTLLSE

SEQ ID NO: 1021757 - protein, 340 aa, Homo sapiens
GGAAVGRPGSAECSAPEGQCLRPSVARRQVGEEAAGSRRRYTAGRRFASPVPATGRILFARKRRGRCGNPSGRAAGFAGRRQCRSSPLRVAVVCSSNQNRSMEAHNILSKRGFSVRSFGTGTHVKLPGPAPDKPNVYDFKTTYDQMYNDLLRKDKELLYHSNEDFTSCLDRKSGESKPQAQKDSSNCKGPVLIVIRHLQKRRVYDLGGGKILNFQITGETCQALCHVVTVDSRTTTEEGPPGGGSHLVSSGKCFQHTGQTLRHELRELVQEFEEKEWAAFLEPLVYEAGRLALWVRGRVPLEWLSRVRAGATHIVLLGGPPQDVFPLGVTSHERRYVPRQ

SEQ ID NO: 1021758 - protein, 100 aa, Homo sapiens
YLYIFRYYASSRPGLLSPQSSVSIPLTTWLDRLHRQAAGPGGADQGAGAEGLAHIGVGAGDEQGAHQQGSISGLTASARRSTSASEWPAVKAIRRRAVPA

SEQ ID NO: 1021759 - protein, 86 aa, Homo sapiens
GSTCAACCCQLEVMLITDTGVPDRFIDTDDWGGEVMLRLDDGWCAALDRDTTMCTIYEKRPLICREFEMGAPECIDERQGLATVYR

SEQ ID NO: 1021760 - protein, 300 aa, Homo sapiens
AERREQESARSRRQPPAQQSWSCEEIRAVTLPPLRPATGRFCPRTHSNNLVETMVDLRMQVLGVHEHNASPEDIKKAYRKLATCKWHSKIRIVLSNKEREQQRKFKQVAGGDMEVAATECLNEYGHIYDKYWRKKGLRLVEDGVWKISLAQSISNFGFTFRNPDDVFTGTFQVEGTQSSFDFFGKALTRLMPVGTRRGPRGKQKPRDGVVTHLTFSGFPSFGSWIHYYSIQRKQHPTGSTTRPQAGTSRTTTQPNDHYGWAPAPWAHTTNSNTHTRTPPKTAQDSTRTLDKRNRRSTRPR

SEQ ID NO: 1021761 - protein, 241 aa, Homo sapiens
MTYTASLPRRGLFTKGEESVSLATCKWHSKIRIVLSNKEREQQRKFKQVAGGDMEVAATECLNEYGHIYDKYWRKKGLRLVEDGVWKISLAQSISNFGFTFRNPDDVFTGTFQVEGTQSSFDFSGKALTRLMPVGTRRGPRGKQKPRDGVVTHLTFSGFPSFGSWIHYYSIQRKQHPTGSTTRPQAGTSRTTTQPNDHYGWAPAPWAHTTNSNTHTRTPPKTAQDSTRTLDKRNRRSTRPR

SEQ ID NO: 1021762 - protein, 236 aa, Homo sapiens
MRSARRDSYKEAYRDNWLLKWHPDKNPEKKEEASSRKFKQVAEAYEVLSDAKETGSSMIKYGQKKDESGGGRRWEVIFDSPFEFGLHYSVTQMMSSGNFLVEGTHFHLDFFEDPFEDFFGNRRGPRGSRSRGTGSFLSAFSGFPSFVSGWSSMDAGFTSLGSLGHGVLTLFSSTSFGGSGMGNYKSISTSTKLVNGRPITTKRIVDNSQDRVQVEDDGQLKFLTIGYEQLLCLDNK

SEQ ID NO: 1021763 - protein, 655 aa, Homo sapiens
LLRAGIMGSRSSHAPCSRRHRAVRAPSVAYPAALHPRRGTGALVRPDSVPLRSAVMATKIDKDGLPGGYNLVRDDGSAVIWVTFKYDGSTIVPGEQGAEYQHFIQQCTDDVRLFAFVRFTTVDAMSKRSKFALITWIGENVSGLQRAKTGTDKTLVKEVVQNFAKEVISDRKELEEDFIKSELKKAGEPITTPRRSNPSPRPHQPLPKSSACSPGEQRPPRLKLLAPPGPPRDANSKPLTQAAAPPTLLLHHAPHPIPDSPLQQPPAPALPSSLHCHRPPLRNNPSLSPLYCNPSHILLSHILVPTPPSHPSSNTHRSSLHTTPPTTRSHSPPRHSAPPGAFPPLPPYRPTTSARPTSPRPRALAPLPPFAPPPPPHPPPSFPSPPFAAPPNFHPRPSPFPLPAPHPAPRAQPRRTGRRTPPFGPPPPHNALLRPPGRHFPPLGPRSFRPPTPPCFRRHARGFFTGGASLLVPSAPLLTRAENGAAPPPHSAGGVRASARRCVSTVSRRHPAPSAPPLHRNIYSPRHLAARAAAVQLILHSLTPRHHMVRPGPRPAAISPPRAFCSHHPVIRALLARLSPTPPREALLLLRPTLAPRQRHVSPIRQGRPPRTCLLRARPRAPAPHHTCCPSRATKGSPPLPMPTLLVRAPSASPR

SEQ ID NO: 1021764 - protein, 620 aa, Homo sapiens
LLRAGIMGSRSSHAPCSRRHRAVRAPSVAYPAALHPRRGTGALVRPDSVPLRSAVMATKIDKDGLPGGYNLVRDDGSAVIWVTFKYDGSTIVPGEQGAEYQHFIQQCTDDVRLFAFVRFTTVDAMSKRSKFALITWIGENVSGLQRAKTGTDKTLVKEVVQNFAKEVISDRKELEEDFIKSELKKAGEPITTPRRSNPSPRPHQPLPKSSACSPGEQDRRASATSPTMPTTGEEKPVRWQRPTNMCPQDPHHSRVPIRTHAVSISHDAHGSLISLNLHLYYNSPLIFKVLKKKSFRCKVLPCHQIRGASLQVTPLPCALLIPQRRGLPSETHGNEPSQFALPRRPRGTLYRANPKIKPWSHMIIWCYQMDGGTALGPVKLVTPSDMSSTYKKRQHSVPVTPNYRAPETSVEVLTTGGIPVIGTRVQYREVDTKNAMVQDNKARALHPEWGQKAEREPEGTKHRNAQTGRTTSTGYKNINPGEKRKQERTEDRKTKQWYHSKLNQKIAEVDTQKVARDIESPAVAGEGELHEGTTTGPPELGQATVGSESTARSEGKYTTQRERPSRTQHTVQHTGQVGTRYGSREVEDRENTKTHTGRTTACISQANDISARSAQPTYGA

SEQ ID NO: 1021765 - protein, 202 aa, Homo sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPLMAPQLPSGKPRSRGRGGTPGKDAAGPRSSLIASRNSSRTFPLIQTCRARLRELVISNEQKELLPLTRPCPDTLQVSIYLYLVDARVKPGKSLEFGRPFLKHLAPHSVYGN

SEQ ID NO: 1021766 - protein, 205 aa, Homo sapiens
MKALSPVRGCYEAVCCLSERSLAIARGRGKGPAAEEPLSLLDDMNHCYSRLRELVPGVPRGTQLSQVEILQRVIDYILDLQVVLAEPAPGTTPLFEIGAPPKPFFFPPPISKTCRARLRELVISNEQKELLPLTRPCPDTLQNAGAGSPFCLGTPGTSPAGSRDGRDGPQLRPAHLTSPNPFPGRLNLVLQERRTVHLVGCKKQS

SEQ ID NO: 1021767 - protein, 195 aa, Homo sapiens
MKALSPVRGCYEAVCCLSERSLAIARGRGKGPAAEEPLSLLDDMNHCYSRLRELVPGVPRGTQLSQVEILQRVIDYILDLQVVLAEPAPGPSLDGPPLFPVQTCRARLRELVISNEQKELLPLTRPCPDTLQNAGAGSPFCLGTPGTSPAGSRDGRDGPQLRPAHLTSPNPFPGRLNLVLQERRTVHLVGCKKQS

SEQ ID NO: 1021768 - protein, 164 aa, Homo sapiens
MVRQIRALDSDMQTLVYENYNKFISATDTIRKMKNDFRKMEDEMDRLATNMAVITDFSARISATAAGPATSCITKLAVGPLRCCGKLQFLFELPSRPHQVLLELGLPMGRRVRYQGRAQAVLAGSTNTCPRSAAIQDDCQVSHVAVLAQSCGSAFGGGGRGPGQ

SEQ ID NO: 1021769 - protein, 100 aa, Homo sapiens
MCSHQVAGLHVQFLQQKVELRVLSKLLLQLIHFLLEEHFHILQNHLRLFHPLFCGLQLILMFFPLRIQAPPGLLSLKAEQAMQLGHTVLHQPDLLQVLGL

SEQ ID NO: 1021770 - protein, 73 aa, Homo sapiens
SQLRPAKRSTQVLGRTGMHLHALLIFIFLVGMAFTMLALSDPSALASKVLGFQASVTTPDPSLVFQHLGTTLW

SEQ ID NO: 1021771 - protein, 165 aa, Homo sapiens
MSWLGLSGGPRTLPGFLLPEKLVPGPPAGHRLPGTGHWGRCRVVASGLLGCCLLGLGLPAALVPAVVFFCPGAGVCWGRCRPGRLGCGHLHILINVKSRLPGFLDGAPRRPGFLFCFSGLMSSSMMSSMPSERRPSFQSSSRCGVCGRGFRGPFFSRAFLNGGVW

SEQ ID NO: 1021772 - protein, 176 aa, Homo sapiens
STAAGRGCGGPERECVVTGQRQARPPLVMVIVLQSSEEEIPAQEAGRVTQGSSFQSLEDPVLSVCPPEALRFCAGPPAPWKQGELQLGAPPLISLRVALASSPVEGEAQETKAAALLTARYQEFVTFEDVAVHLTREAWGYLDPVTEGPLQRSDVRELWERGLTGHTSPPSHHPDS

SEQ ID NO: 1021773 - protein, 93 aa, Homo sapiens
SQARTTGAPLYLRCLLFPVREAQETKAAALLTARYQEFVTFEDVAVHLTREAWGYLDPVTEDLYREVMSENYGNVVSLGILLRLPTTRIHSVT

SEQ ID NO: 1021774 - protein, 188 aa, Homo sapiens
MFENAAVLPQPDGGGRGKLAVVLGEAVARGRGLRRKPQGDGGPEKISGSGTVSGNAPVAQEEAAGVVAAGLARTLRQFWPPLLRLCVGHLFCGRGRPRVGRGSGGGCRSNSGGTVTFGPSRERPRAPMAEHCDPWVGSRMEWLGRPLAQALGGLASRGAFWEESCPRGIWGNVVRKHGRRGRQSLSDL

SEQ ID NO: 1021775 - protein, 308 aa, Homo sapiens
GGGGGEGTRHAADARPVPQPERVEAVARSGPGPWAPRAARVMRTEAEVAGTRIEPGDFGKLALCPSSSSSTTWDCGLACSRMVLRYLGQLDDSEFEMMALQKLQLTRSIWTIDLAYLMQPLLSCDGTTAVPRTAVVSTRATQKQSVLAGSSGLISGRDPGESSCCAQSKGPARCWWRKCPVSVNGQSRRDLASGASVRQSVRGRTRGLLALVSCGSQARVTRNRLFHPPVAPTCVLATLPDYQGHFIVLGLVTTVATGGYSRRPSYLDQEWWVQLSDLRRQKPFGMRHSWLMERATDRGREPEHINTG

SEQ ID NO: 1021776 - protein, 152 aa, Homo sapiens
CLWLDSSSIPSICHGQDAQALCAPALHFLVLAVVAGMTPSWTRCWDWNWNCPSEGRGAHLLITHSSLGLSTLVAYAVCYCTWSGNGGSGSRLILALSQQARPESHEEVAALMATQEAGRGGVREDSSKISFVTPFTAPTLALPYARFPSSNS

SEQ ID NO: 1021777 - protein, 88 aa, Homo sapiens
PEVSYEIALREVRMAQQQRRDEPGRASGAAAIRKSPYPARSPPTRASSRHGMASSFRPRRGVPEEAHHMKLREFKHSYASRDRVAHCP

SEQ ID NO: 1021778 - protein, 96 aa, Homo sapiens
MVLMCYPRCDEWTMMDVMLCMLQYLHDHDVTMEAGRCLSGPFDVHDAWDEHVWPTMSVHVHYVAGADDTGLGRWLGPMGTLLALGSAVPLGWSWAS

SEQ ID NO: 1021779 - protein, 181 aa, Homo sapiens
MAGSRPGVRCEAHIFNGSNGIMLIYKGGDEYDNHCGKEQRDAVGDDLLQSIDDRYADNFNPVSEERGKVQDSFYLLSELDSSLAVFTKEIVPPQVWVPSYLVDVLHQLVAVYVVGGFLYQRVVVGAKGMEQFPHLAFWQDLGNLVADGCDFVCRSKPRNCCLQHIVVWGMTSWGEESRRKG

SEQ ID NO: 1021780 - protein, 139 aa, Homo sapiens
RRRDLLVERRPLERSGAEIAPSQPARRRLRCSGALTPAGPCKAATVLAMHAPGAECLPHGKGGGGGEEGGVRGRGGVGGGGGLRGGGGGHGGGREEGEGGVGEGDGAARGMVLRGWGGRKVRWGEMKGGAGGVEVRGVR

SEQ ID NO: 1021781 - protein, 214 aa, Homo sapiens
MHAPGAECLPHGKAWRSLATTCCMENFRKVRSEEAASGGAGGRWEAALGSGPLRRPGAVALGAHCGSRKGSKILEPDGLRHRPALAAASHAAPIVFSELACLGHHPRTVTVAAEDSFKAPAIGGAVHQVSRGLRYREAVREVWQSLPPGPTQGQTPGEPGAESQRTLRNVPGLAILLSKDAHGSATARIPAPRIPQSWSLVPARTANVQEELGE

SEQ ID NO: 1021782 - protein, 103 aa, Homo sapiens
VVVVTSEQADLLLKPALPGIALRRWRLLHRVKQAHAAELFHVTQSTISRWESGVQAMEPAAHQHLEQLLAARLEAAADQVLARLVKESPRPMHLVLIHWYQQS

SEQ ID NO: 1021783 - protein, 91 aa, Homo sapiens
SRGLWTMRYAVLTGRKKAFSEMCAALRQRLEEAQRKGGEIQEMLTASFAKLNAEYGFGLATPKAPDLTRFIRDLDLIERNYMQYRVAHLSI

SEQ ID NO: 1021784 - protein, 176 aa, Homo sapiens
CASSSSLAASRCLEPAGAPSLAIVGDELRQAGSNGGKAYEPCSNALVGRGGVAEIKPGVTVCPERTVITENLPEKLTAFKEKYMEFDLNNEGEIDLMSLKKDDGEALVSPRPTWSMKKMISEVTGGVSDTISYRDFVNMMLGKRSAVLKSVMDVGQENANESSPKPVGPPPERDIC

SEQ ID NO: 1021785 - protein, 140 aa, Homo sapiens
MRATYYNRDPRARLVLKKQRTQARLANEKESLVLQVSVLTDQVEAQGEKIRDLEFGLEEHREKWNATEEMLQRELLSRTSLETQKWDLSAEISNWKWKLTAVEKDRWDYEDKSRDTEGRDQEIKDWRLKVSERDSERLQL

SEQ ID NO: 1021786 - protein, 103 aa, Homo sapiens
MRATYYNRDPRARLVLKKQRTQARLANEKESLVLQVSVLTDQVEAQGEKIRDLEFGLEEHREKWNATEEMLQQVCAEARTKMDFPAELCEMLHFYVVFALMQQ

SEQ ID NO: 1021787 - protein, 86 aa, Homo sapiens
QPQSNPSPGNTCPWDGLSPSTTLEAPTRWVCPLVLLLCAVHLLCASSVLSTSSVLSTSSVLSTSSVLSTSSVLSTSSVLSTSSVLS

SEQ ID NO: 1021788 - protein, 149 aa, Homo sapiens
MGRAASAPRRGCLWRGGGAAAEAEAEAVAMAPFPEEVDVFTAPHWRMKQLVGLYCDKLSKTNFSTQHTSSASPALIRVLLSHRQLPPLPCTHAPANRDITPLLASRASTQRQPRPTLIHRPFLDHSTLLPRIRTPSICNSGTRTPCFTP

SEQ ID NO: 1021789 - protein, 94 aa, Homo sapiens
MAPFPEEVDVFTAPHWRMKQLVGLYCDKVTELLSLPLWAVRAAMGSGLGSWGGLACAAPAAPCRRRASSRLRSCQWPARFPSLPAPCEAFAEPA

SEQ ID NO: 1021790 - protein, 328 aa, Homo sapiens
MEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVIMSRKYQDVSCLQFTGESSNFISGGKDCLVLVWSLCSVLQADPSRIPAPRHVWSHHTLPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVCLWDVQSKQCIRTVALKGPVTNAAILLAPVNMLSSDFSP

SEQ ID NO: 1021791 - protein, 151 aa, Homo sapiens
RFLSDPFRVFKMSKRGRGGSSGAKFRISLGLPVGAVINCADNTGAKNLYIISVKGIKGRLNRLPAAGVGDMVMATVKKGKPELRKKVHPAVVIRQRKSYRRKDGVFLYFEDNAGVIVNNKGEMKGSAITGPVAKECADLWPRIASNAGSIA

SEQ ID NO: 1021792 - protein, 31 aa, Homo sapiens; identical to SEQ ID NO: 957009

SEQ ID NO: 1021793 - protein, 75 aa, Homo sapiens
PVNKGRNVIGLGWMLGGLSFAGMLFGPSNMAMVVGLYSLGLFFLIGPYSAALFFISESFPTSIRATAALFTVTAT

SEQ ID NO: 1021794 - protein, 262 aa, Homo sapiens
MKLDDLPEDDQAEFDAEELTSTSVEHIIVNPNAAYERVQGQESGDKRDWISQIVVEKTKRTGYESGEYEMLGEGLGVKERPQEKYQRAYCMRSRELKTEVEKIKKTVKESATEEKLSPVLLAKKLEALKQQLVASHEKLLGPDAAINLTDPDGALAKRLLLQLEATKNSKGGSGGKTTVDPPDSSLVTYELHSRPEQDKFSQAAKVAELEKRLELETAVRCDQDAQNPLSAGLQGACMETVELLQAKVSALLAVLDQVEARL

SEQ ID NO: 1021795 - protein, 160 aa, Homo sapiens
MPVSRALDTHDSQGPWFRSAVRPACGLRGAMPMLREPVCSAFLRDCKEAKWKSVSSSGRKAAVPALLRTAPKTPWDGPDVMPNPMPLPLGLLWCWTSCDTTDTRMTIRAYGRPGALATDERLAAFSFRQPYAGFVLTLESSTVQTRWRPLLEPPAELPIA

SEQ ID NO: 1021796 - protein, 234 aa, Homo sapiens
RRLCSDRGLQRSFGSMSAAVTAGKLARAPADPGKAGVPGVASSLELRRLAPPAKRDPGGPSGPTQPGWRICAWAAFMGNGLALPMCFRDLGRGHQRRCSRAQIVPKSLLLNAAPEGEDVHGKYPFTRSLAPPARSLLTSKAIHEDQRLRCYARVGSSARRKGLSWKPATKRRKALTAALEARITSLRQIGAVACQYLRRNRVYPRDLKLGKLFPEWKICRWKIRGLWNGNQSRI

SEQ ID NO: 1021797 - protein, 47 aa, Homo sapiens
YRLPGFHPESSADYRAEPGGRRQLVKLLNDVRKVAIFAGAGVEGAHD

SEQ ID NO: 1021798 - protein, 250 aa, Homo sapiens
PSRERDNYAAELSTQNEPWTSTVTAKRSLLPSVLSWTILLLPGQLAITDSEHSDAEVSCTDNGTFNLSRGQTPLTEGSEDLDGHSDPEESFATDLPDFPSINMDPAGLDDRGATLDIWTLPHGFGIGYTCVPPGPGELRGAPRGSNLASRGQRLALPGAPAMDALPVGSNLYQSNLVLARSPMGDDSGLALSWGLREPGRFLEHAAQRATRGFLRSPSSDLDTDAEGDDFELLDRVGAESGWTLGSARSH

SEQ ID NO: 1021799 - protein, 175 aa, Homo sapiens
MGEVSVALKEQQAAVTSSIMQAMRSAAGTPVPSAHLDCQAQQAHILQLLQQGTNTGQPGADSGAGGGREVCETGDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGFVTPSLP

SEQ ID NO: 1021800 - protein, 130 aa, Homo sapiens
GHRIPKETKLKQALTAADLNLVLYVCETGDPAQVFGQPPCPLSQPVLLSLIQQLASDLGTRTDLKLSYLEEAVMHLDHSDPITRDHMGSVMAQVRQKLFQFLQAEPHNSLGKAARRLSLMLHGFVTPSLP

SEQ ID NO: 1021801 - protein, 570 aa, Homo sapiens
SGVTEAFNLEHKTTGESSRGPPRRMTRGSHDSRTLGGKCEGKKTMDLGPIYTDGKAYKLANEGLSEGSLGFRGRKFHRGRRYKLSRGGWGAITLARDTPGQSVCVARVASRERACGAVTREGRGARGVYAKRGVHLKRGLVALCAPNRGLILWGHQKGVSLCEKILAVARGQTPFSPFFAVSPKSSLSPLPNFREKRKPGVCDHFVGTKTRASRRSSRATVCAPTYGSVGTLWAPSCVRTVRPKQPPGVSEREIERVYLLSEVSSPGDSELEKPNLVRSGPHKALVVALVWGPKILWDSRLVEKGEEILRAPSGRSTQIPGACALLRKPTWKGHTCGTEETHFPRDNPRGRIERTELPYYVAGVGARRGEESIPYPPPQYQPLGEFSCGTRCGRGVTTFRGATKGFPPQKVTLPRGVTPDGGQIFLRDMRTPPTWGRKHPTERQKRSLLYTQRPPPQRVGHREQKMDPRRGRTQHGRRTIGEPHGAPNLPRNTAEKHPGGPPTHHCPQQPHTSGGARVHKKTYSKQQEQLKSKNVRGKNHAVPTTGEGTQHLAQITRGASHTKEHKQTKA

SEQ ID NO: 1021802 - protein, 193 aa, Homo sapiens
TVSLPQMKPSEPCHQRERSRLLEDAKELANILKYHIGDEILVSGGIGALVRLKSSQGDKLEVSLKNNVVSVNKEPVAEPDIMATNGVVHVITNVLQPPANRPQERGDELADSALEIFKQASAFSRASQRSVRLAPVYQQLFREDEAFRLKHLQEECTTAAHPPISLRFPQRLFECFQNQVSHFNVHGPHHNEM

SEQ ID NO: 1021803 - protein, 205 aa, Homo sapiens
MPTALPATPASLPSQGLPVCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSTRHVSGRTGRCLMVLPACELAKGERMAGDPIAKRPLAGSITWHCGPKNTVCDLDPGITCLSKGEL

SEQ ID NO: 1021804 - protein, 246 aa, Homo sapiens
MVSSARVACCLDPGGASYSCCRPLLDKWTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSTRHVSGRTGRCLMVLPACELAKGERMAGDPIAKRPLAGSITWHCGPKNTVCDLDPGITCLSKGEL

SEQ ID NO: 1021805 - protein, 525 aa, Homo sapiens
MGLEKMLGVHLSWLQGSCPVTIYPRIFNRTWDCLGCRSILEVAYSWSVILVIDLEDKVGVSYNRYGDGIARVHGLRNVQAEEMVEFSSGLQGLSLQLGNLTMLASSVFGKCINTHFKARQHISEQQAQAAIAGTFPVGCRKLVRVVLSLHALVINAHCLAKGSKYGFRTTRSARLGTAKPPVIHSSTLFRLRGHHTARPGAITRLASRLRLGSPTHWHRGITALTRESHRVDQTDLATPNLDTSSLTTTTPQLHPQGHTSQTGCDSCTRHKERQLVTGIARYAYPGPQTQDIPTRELPTLAEKNKNMHNDTAAKTTANEYQRKKERLSRDSRNLRHIIAHRTQHQTTENNTYNSQEKMTTTKKEQKSLQQETTQHTNTRHQNPPEQNKNYKQTKGKPDATRTPQDSKKDPDRTNPWTSERPNTRQQAETTKTRHGENAKNEEHTVNAEYRNERPRREYTREKKNKRRNKEKGAVTHGSSNKGRSNRRRTQSQRQSKTREDRQPGDRQTRKDVDNNSATQKPEPSK

SEQ ID NO: 1021806 - protein, 188 aa, Homo sapiens
MLSICEFEHCAPGLGRHQNLAFSRLIIRLNATDTIWSANPEVSSCAGSTTFKSVSQYSFAIRYSLPACANEVWAASFFSLLTWFLAWRLAIHIAAMIAAIDPNACTHDAKPGWLSIQQNTTSQLITHSPVDPGTIHGEDPLCPHNKKLPQFIHVQPSMGLPFEKELVVDLFAGVAAPAPASPGHTGAD

SEQ ID NO: 1021807 - protein, 34 aa, Homo sapiens
FRKSKNILFVITKPDCLQVALTSRILYNTFFRGT

SEQ ID NO: 1021808 - protein, 327 aa, Homo sapiens
RQGARRLDLVSRAAMAQWRKKKGAPEAPEAAGLPGPRSDSEDGEFEIQAEDDARSRKLGPGRPLSYLPHSGMHPRNVLSRTPRGDGCVPERTKKQINHILEASSPCGLSYPVVQRPHEEKAYKVPRHRIQMNDHPVILGWQGRVGHWPLDCCVGARQRCFRVSPELFEAGVKTLPVLPDLVARALYPSRLTSDELALQNPWNVRLRELGTVSLALHRFACSWVYDAACMTMFCSPCTEIIIDVFISLRTARTGWVHCLLVAYAALNLQQVLDTVGGSGGRLPGFLELGFRRNTLPGDSICAAVPGGPPQGWFPAGCQNGGGIARAAS

SEQ ID NO: 1021809 - protein, 122 aa, Homo sapiens
MTDDSETIDSVLVMCRSDVPIGDLDRLYLACACLCMLVACSSWRLADCGGVSITVGLPPHPSPSYVPDWSVDIDPHVRSLLFRRSVLAALCGAYWAPLLWVCGPSLWRLLVDPRGVHGCVAV

SEQ ID NO: 1021810 - protein, 194 aa, Homo sapiens
KDKARYEAGGIGRGEIQGIFPFETLELPPLERKPGGFDISLFYRDIISIAEDEDSGLTLRNPAARRPVAEGSRKETRKRALSRLKLKLNKDIVISVGIYNLVQKALKLFPFPPKNLKKKGPFSLKISRGGGKKKPQKNEPVKTKTRTFNTSTGGLLLPSDTKRSQIYGSRQIILEKDGNQQELNNGLVIQCLDA

SEQ ID NO: 1021811 - protein, 169 aa, Homo sapiens
KSLPMTLMSQGSDYSLGELLCVCANLCTDVQLQCSDGHYRVINASCIEMIDYSHLMVIVHVLNSSAETEGPKKPVSLRRYEASSVDLECTLKETCEGFDRVVRCSSTMSTRSSTMHDVSDADLRASTFERIHAKLRKTLLREQVRSQRRSQDIDAAHAELDTLESFNHT

SEQ ID NO: 1021812 - protein, 70 aa, Homo sapiens
MAFTPLVQAHLDAWVACAADFGPFLSGQETTLTLNEQRKAYEQVLCSHPIPAGVSFCDVDMGGIPGMMST

SEQ ID NO: 1021813 - protein, 70 aa, Homo sapiens
CHRVTDFRLSEPQQVKKQIGHGDSGSHCALLLRKDGCALLKMILYDSATRVGPSLLQAVPRCLKEHSKRR

SEQ ID NO: 1021814 - protein, 222 aa, Homo sapiens
MAPGNDSKSASLLFGMRNSAASDEDSSWATLSQGSPSYGSPEDTDSFWNPNAFRDWIPDLHGWMDEGPGHLQGPITGTIANRELDLSGKPPVGRGSLLTGEHGPPKSESQAQPETGFRNRNGSRVMAHFLEGIDPCDEAPMELGLNGTWGWGLFDLPSSEPQPRAVAPMRMEKLPPLEYQPRDQCVSAVRSLGWVEMTEEELAPGRSSVAVNNCIRQLSYHK

SEQ ID NO: 1021815 - protein, 57 aa, Homo sapiens
TCERTDHRSNAFVEAMNGLLQQAKRAARGFRTSQNFIAIAYLRMSKLKHLPISPFAC

SEQ ID NO: 1021816 - protein, 231 aa, Homo sapiens
RGLLPSTGSCEDSRHSVLWAPQKPAFRSRTRQPEQEPWDRAPHPLRRVMGPRRREPKARGPEEAHPEPDPRPPGPSLAGPLPSGASSHQTQSGGDNGLAKGDSERLQKSTTPSLIKEAALSSRLARRKYVLNSLVVWTSIGQAQALIGPYKEAAEAFLVNLFEDAYLLTLHAGRVSLFPKDVQLARKAPGALKEGTRVSSLHPVFLSVLPAQPGGLIRGLSEPASPWICEC

SEQ ID NO: 1021817 - protein, 30 aa, Homo sapiens
CGVGSRTCAETASVAAAGSGFISNAATEAA

SEQ ID NO: 1021818 - protein, 70 aa, Homo sapiens
VNRDLAALFDDICGCRRCRKVQLRVEAWVYMFNATVTRSTLPVRSPLPNRQPSTRSRRIRPNSVAPRRPY

SEQ ID NO: 1021819 - protein, 146 aa, Homo sapiens
MPSPNMASLYVGLHDVTKAMLEKFSAGILIVKDITSLGYAYVNFQQPADAECLWDTMNFDVIGKPVRIMWSQRDPSLRKSGVGNIFIKNLDKSIDNKALYDTFSAFGNILSCKVVCDENGSKGYGFVHFETQEAAENLLNEWNAPK

SEQ ID NO: 1021820 - protein, 146 aa, Homo sapiens; identical to SEQ ID NO: 1021819

SEQ ID NO: 1021821 - protein, 41 aa, Homo sapiens
CYPGRTTDFALSDRYGPSSVLPPPLCSSSVCPPSVLSSSVL

SEQ ID NO: 1021822 - protein, 98 aa, Homo sapiens
GRYRSVTSSLCGYRYWPSGGSRLPSHQEATHLVRHIPVLATSRCWFRILYACPQPRPEDPWASLHRDRLPATAYESSTNSRPLSGQSIAPWVGIPLWV

SEQ ID NO: 1021823 - protein, 116 aa, Homo sapiens
STKGAKTFGIHSFLASNTVTHLYYPELARQLFELAVEIKEKLGISLDFINLSGGIGVNYRPDQEPNDIALIGEGVRKVYEEVLTPAGLGQIKIFTELGRFMLAPHGALVTRVTHSR

SEQ ID NO: 1021824 - protein, 191 aa, Homo sapiens
MRSLVKELAALPKATILDLSCNKLTTLPSDFCGLTHLVKLDLSKNNAACSCQQTLAVCVNLQHLDLLNNKLVTLPVSFAQLKNLKWLDLKDNPLDPVLAKVAGDCLDEKQCKQCANKVLQHMKAVQADQEREEAAAGLDKVAHVEGQQTDRRCRAYPQQAIAEGLQDPGTLPDTAEDTAERSTEPRTHGRL

SEQ ID NO: 1021825 - protein, 151 aa, Homo sapiens
HRAGSSTEQGAAQSQGTAQSRGTTQSRERHRAGNGTEQRNGTEQRTGTEQETAQSLGAAQSLGAAQSWERHRAGNSTELGAKSPDHALLAGPYWPLALTADCSGHVPGLSEQEELPVLTRPRVLHTAGNQCSLHGWKPSSRTCCVLTGRPG

SEQ ID NO: 1021826 - protein, 211 aa, Homo sapiens
RQANVAVVICTSKFKEGRLSPSEATDMADSARSFNDYLIDSHGGRFDRSHVKLLENAGATRQGIMSALGQNFLGNAVGKDDLVVVYLATSAFPTTDGNTYLCTYDCALDNIYGTCISMQSLMSTLKKNVHSDRILLVLQAAYSGAAELESGAKSLEHRAAQSYNLDPNKVIMGNGFIILSSTQANEITWSTAFSKNLTTALRQILAGRFSA

SEQ ID NO: 1021827 - protein, 74 aa, Homo sapiens
GIRKAVSSLGKSYLVFRCQGYNPLFELVPDNSSKDVSSPSTTSSSFLTSLKKPYGIFSFLDNFISCIHRIYYLI

SEQ ID NO: 1021828 - protein, 193 aa, Homo sapiens
RYAWCKSDEAPGACPPLPVGTTAVAAGRGVGGSVGFCLTVGVRAVQLPAMAELDPFGAPAGAPGGPALGNGVAWCRRRKTLVAAFLAQLMRARLRGIENDEAFAIPGRVVRPRAPSRNGEAAGGVRDAVDGVIEMVNTTRKVMFQTGHDMQAIFTKVDRLQSEPESIRKWREEQEWKPLVKHLGCQFSGSTEY

SEQ ID NO: 1021829 - protein, 149 aa, Homo sapiens
MPGVNLDEAPGACPPLPVGTTAVAAGRGVGGSVGFCLTVGVRAVQLPAMAELDPFGAPAGAPGGPALGNGVAWCRRRKTLVAAFLAQLMRARLRGIENDEAFAILGRVVRPRAPSRNGEAAGGVRVNGPSRQLCNAITPKWIGFGMSEL

SEQ ID NO: 1021830 - protein, 123 aa, Homo sapiens
DPGIADSPFVRSPRLSCFAPCCLLGAAQCDWRWWVGELCQSLFLCWMMGQVNALSAVSYSTPASPVFGPSLALNRSVITPDNILQPVISIRVTNHPLEYTFQKRDLHQMVSPRQLAAPHQTTN

SEQ ID NO: 1021831 - protein, 224 aa, Homo sapiens
GDIIYGDCHGCGSKGCRYDILQMPSAAAMPKAKGAELDHTVKSRGMLHTWLLLQAMADKAELEKLDLNGNTLGEEGCEQLSVSVLEGFNMAKVLASLSDDEDAGRQAGRQGSKQSKATQEASTASRQAAQSIAGQSSAATASRQRGRGGKQSSHQEAAAARSRRRSRTRRIQKRNKKITWETTYNNMGGKNQGQITPMNNDQYTHKHIHMKETVHHKSFHIETY

SEQ ID NO: 1021832 - protein, 348 aa, Homo sapiens
GDIIYGDCHGCGSKGCRYDILQMPSAAAMPKAKGAELDHTVKSRGMLHTWLLLQAMADKAELEKLDLNGNTLGEEGCEQLSVSVLEGFNMAKVLASLSDDEVRWMEEEDGEEDEEEARQKMEEEDEEEEEEEEEEEAEDPQQSRAQGEKSAMPSRMILDPNTGEPSSRAVLPTLLCESVIARFTGLLPSSREAACAIGPKSSVLIAQLDYTSDPEKVVSAFLKVSSVFKDEATVRMAVQDAVDALMHKAYNVLVPSTPTPSSPGCSCTMVCSRVTTRFKAIANLLRPPDGSEHMVPARTISPRRLAPPCCSAFGDASPTRALASLLLRPANSLLPTLSPGLRLTGSSR

SEQ ID NO: 1021833 - protein, 144 aa, Homo sapiens
MPETAHKAVSLRVLTVDDSSVAAQAGHAVACKLVGVEVVALNDGRQALDYLRKLADEGKKPEEEFLMMISDIEMPEMDGYTLTAEIRNDPRMQKLHIILHTSFVGGIQSGNGQEVSVRMTFWPSSVLDDLASRVVARIKAADHG

SEQ ID NO: 1021834 - protein, 79 aa, Homo sapiens
RRRQGLSQGRDMRLVASAEREATIPGPVWPGCKQGCLEKRGGGEGSDRTRAMLHAPCSGVPPAETWPTQHPTLPRHQGR

SEQ ID NO: 1021835 - protein, 260 aa, Homo sapiens
LTARYEAGCAEGPLAVLRDRAQQISCPLYLCPMLDVPSMNGGPPLTLGLEWGRTSWSKSLPCAIACFAQLLVLACCAVTCHVLLGVMPNGIQGHVAPVGMLAPVHLCSMPTSHMLCSVCFCEHWMCACVPVTACVLAVLLVPLTCVPWTVLLHNLPCMLLHVPCVALVFLPGRLHVACREADAGWPRWFDVLLFNCYLGTWCDPGGPAVKLLQPCQFDYAVFCPNLTEVSSTGNADQQNFTVTLDHVLLRCLEHQQHWRQ

SEQ ID NO: 1021836 - protein, 352 aa, Homo sapiens
MRPRRGGRTLGRSELASGPRSLALEPPFRPPPGPRPRPGLARPPPPPPGPMDYSYLNSYDSCVAAMEASAYGDFGACSQPGGFQYSPLRPAFPAAGPPCPALGSSNCALGALRDHQPAPYSAVPYKFFPEPSGLHEKRKQRRIRTTFTSAHFKELERVFAETHYPDIYTREELALKIDLTEARVQVWFQNRRAKFRKQERAASAKGAAGAAGAKKGEARCSSEDDDSKESTCSPTPDSTASLPPPPAPGLASPRLSPSPLPVALGSGPGPGPGPQPLKGALWAGVAGGGGGGPGAGAAELLKAWQPAESGPGPFSGGLVLLSPEARPRPEDQSLLAAGLWRLRASQRRPFRT

SEQ ID NO: 1021837 - protein, 70 aa, Homo sapiens
TLEEPLLVIQAVEDVSHSGSQKDLAGEVAVDQEAKRLVRVRENLARLGLSAELIAADGRDTATCDCLDYK

SEQ ID NO: 1021838 - protein, 195 aa, Homo sapiens
MCCPTWPVPCVAAWELPGLLCAGVGMPLHVEVACFPCWCLPLTCDPVPAASSLGLVEHLQLLLGPMYIEPPDLCNNREVLYRAHRESGGPATAPRSPWSNHQSCTGRPSSHAGILKLRQIWNPEVDAVWVTEDIGPLDSGPGGPTASAQICPPTALPRRCCQQSRTLSETSVHKEYIHFSVGSFLSGMVTKVVFG

SEQ ID NO: 1021839 - protein, 257 aa, Homo sapiens
MAGNRRVRGPGGARPFAARALFLWLVFSAGASGGTWEIMGSTLGEPWLGAARSLPDGLSALCSTLLHCEGWLQLPVDLGLPELLCDVVHLPSAVLRVFSSSVSGRGFLVLVEQCAGDSDSILNQSNMPILVCILATHYSYGKCCLRDYCWASVLMLLSSLDVSLLVLAYLARGSLFFGALVEFLHLFGITTYAYHIVSLNVDSGFPGKVQETPGRRLMKCTDALNPKPRLASSCFGFGHCDALPKGGISWVLEGLDV

SEQ ID NO: 1021840 - protein, 148 aa, Homo sapiens
MVLRLGLIRAQEPDEFAAECTGCGVTAKMLSVRVAAGRGPRPSSCGPDWSPEMLWVHLSLLQGNFHASNTHLQKTGTAEMSSILEERILGADTSVDLEETGRVLSIGDGIARVHGLRNVQAEEMVELSSGLRGYVLDTWNLTMLVLSV

SEQ ID NO: 1021841 - protein, 267 aa, Homo sapiens
MVLRLGLIRAQEPDEFAAECTGCGVTAKMLSVRVAAGRGPRPSSCGPDWSPEMLWVHLSLLQGNFHASNTHLQKTGTAEMSSILEERILGADTSVDLEETGRVLSIGDGIARVHGLRNVQAEEMVELSSGLRGYVLDTWNLTMLVLSVCGNDKLIKEGDIVKRTGAIVDRSSGEELWGRVVEMPLGPAIDGGGPVGANDGVGELGLQAPGLIPRVSVRAPMQTGLRLWIVGGTWSWPVDRLGARDGRPPGCWRAYPKVHVLLEKGRL

SEQ ID NO: 1021842 - protein, 208 aa, Homo sapiens
MDGRVQLIKALLALPILACDAIAGGTRISYYPETFDVLIPEPTTRRYICADEAPTVFVDERHVSSSDALKGDCSYIIAAYTGTTALRVGDPPTIEAMESPLPTMIYRGYSGRDRSEYYMDEEEDEDYLGRETLGPGGGCYWGGYRCSILGRRPGSPPGCHYPTEPTLPAYEAAEMYPCATCIPTLRSSYSPLCYHGNKLLPGSKLDDP

SEQ ID NO: 1021843 - protein, 68 aa, Homo sapiens
GRPPIDEGAQDQEPSEDVQRGLWGEEHGGHSWSDRSVQRWDGSRKPKKSRPWNQVEGRQPGHDPEQVI

SEQ ID NO: 1021844 - protein, 152 aa, Homo sapiens
AECASSEGTGGSPSSSLRASVSGWALTSHLRRGSEPGPDPGDCRPLLSSLHEGFPASHTPPLDLPFLLFSACGGSQRLGRSEPGGRPPLKTSRGPIHHGRRRRRERQEPRSSPEPLEQETVSTMQPGLGEVQRHLHSSPTELAHSACHFHIM

SEQ ID NO: 1021845 - protein, 318 aa, Homo sapiens
MMPTPVILLKEGTDSSQGIPQLVSNISACQVIAEAVRTTLGPRGMDKLIVDGRGKATISNDGATILKLLDVVHPAAKTLVDIAKIPEMLEVGDGTTSSDLGVAAEFLKQVKPYVEEGLHPQIIIRAFRTSHPQRQLTRSKEIAVTVKKADKVEQRKLLEKCAMTALSSKLISQQKAFFAKMVVDAVMMLDDLLQLKMIGIKKVQGGALEDSQLVAGVAFKKTAHSRWVSTMQPKKYHNPKIALLNVELELKAEKDNAEIRVHTVEDYQAIVDAEWDILYDKLEKIHSGAKLCPTPGDVGQYFAEQDMFCAGEYLGSEE

SEQ ID NO: 1021846 - protein, 377 aa, Homo sapiens
MAAPRWSASGPWIRGNGQGCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 1021847 - protein, 114 aa, Homo sapiens
TSERHPLRAVLPRRVLGEIFSCQLKPLAFSFLGGPGVQLCITDVLPILAKMLHGHKAEPLHLCHRLDKETTGVMVLAWDKDMAHQVQELFRTRQVVKKYWYEPADVFQSMDPLD

SEQ ID NO: 1021848 - protein, 378 aa, Homo sapiens
LRLLKRNPLGPRYRATLGRVCGSLFTLVSKPFCAAAAASTAINAQRLAEKLRAQKREQDTKKEPVSTNAVQRRVQEIVRFTRQLQRVHPNVLAKALTRGILHQDKNLVVINKPYGLPVHGGPGVQLCITDVLPILAKMLHGHKAEPLHLCHRLDKETTGVMVLAWDKDMAHQVQELFRTRQVVKKYWAITVHVPMPSAGVVDIPIVEKEAQGQQQHHKMTLSPSYRMDDGKMVKVRRSRNAQVAVTQYQVLSSTLSSALVELQPITGIKHQLRVHLSFGLDCPILGDHKYSDWNRLAPQKLSVGTLKKLGLEQSKARYIPLHLHARQLILPALGSGKEELNLVCKLPRFFVHSLHRLRLEMPNEDQNENNEAKCLGAQ

SEQ ID NO: 1021849 - protein, 175 aa, Homo sapiens
MLLCAPWVRHALLPAVLALLLCAGQVTALPVNSPMNKGDTEVMKCIVEVISDTLSKPSPMPVSQECFETLRGDERILSILRHQNLLKELQDLALQGCQGEGTSGRRNTAVLKIELSEVLENQSSQCRAEMRLVEEPSSKDVMENNERIPMDVQRKVGEANRLGAMAPVPSLEPMQ

SEQ ID NO: 1021850 - protein, 70 aa, Homo sapiens
RAGGGGVEMAAPLRIQSDWAQALRKDEGEAWLSCHPTQPVGSHQEASMLCADAFIVRVLLELGKRIFVMC

SEQ ID NO: 1021851 - protein, 273 aa, Homo sapiens
RAGGGGVEMAAPLRIQSDWAQALRKDEGEAWLSCHPPTWQARREAPQYSEVRMLVRMLLVAVCSNRKPSLYGRLTCSERIGASMVIPRRLTELQEGFDCDMRNKQGKALHIACPKENAVFYSIFGTIYYFCSRNSYRRSVSIACAHFQPEEVIGVIFPGGSRRRTMKRVSGEAFQLDELRMQYLEGHVFDVKLLQVLSHQGLVVLSGGMDAQLKIWSAEDASCVVTFKGHKGGILDTAIVDRRRNWWCLLSRDGHSTDFGDLSGAQACWGSPL

SEQ ID NO: 1021852 - protein, 76 aa, Homo sapiens
RAGGGGVEMAAPLRIQSDWAQALRKDEGEAWLSCHPPGKNHSLYGHGLQLVMDISARRWSSRGGLQSFRKRFDMCT

SEQ ID NO: 1021853 - protein, 174 aa, Homo sapiens
MNPSVRLDFDIWGPFKMEYLYVFGFSFNLEIIPSHALKKFLLRSGAQVFGELWDKLDTPLYLYVASPSWAPGYWGTWVRLEAIYEAGSSIFGVLQAQGSRLSLVGPRPGFSPLLRKVGVGGAAHTGFHLCSRSARIHSGGYVPAPYVFQCPKTGVPGVSGPHRRPAPLGRGAFL

SEQ ID NO: 1021854 - protein, 269 aa, Homo sapiens
MAGPFSRLLSARPGLRLLALAWSGVSSRCGFCSDRNLYELASCNDRRPVSLRALSTQNIRRENNNCVAMSPVPQQVYALASADKVTTTSHGLDARSVYPDWRGSNLVATPSIKTVAHAVAGDVERPTEVFADLFDPVIQRNNTNEYDPRTMKHTMDLDASKIRSGYFDERYCIGPLESELAEGIRGLSLPPACSRAERREVERVVVDALSGLKADLAGGFYRAQEMTEAEQQQLIDDHFLFDKPVSPLLTAAGMARDWPDARGIWHNKE

SEQ ID NO: 1021855 - protein, 45 aa, Homo sapiens
TLEAPKVFGLSPLEDIAVDSERGRRGPGRIADNEYRENHSSLDPK

SEQ ID NO: 1021856 - protein, 207 aa, Homo sapiens
MRECISIHVGQAGVQIGNACWELYCLEHGIQPDGQMPSDKTIGGEMIPSTPSSGETGAGKHCAPGARALYDLGTHSSFDEASHWHLTRQASVHPGGSIMDKAREDCCHSNYRPEGHYHHLAKETHFDHRCSDRDSAQLACTKCTESPGTSWIDPHALRGAELGSAFTSLSHGTSLSQRYGKKGPKLEFSIYPAPRVSTAVVEAYNSL

SEQ ID NO: 1021857 - protein, 177 aa, Homo sapiens
MPLAQSGLLATARSLLPCWACHSLPGLGEGCCCQWLLEPIQKVMTYQQPFSNRRTCPNRLIVDEAINEDNSVVSLSQPKMDELQLFRGDTVLLKGKKRREAVCIVLSDDTCSDEKIRMNRVVRNNLRVRLGDVISIQPCPDVKYGKRIHVLPIDDTVEGITGNLFEGIPYAVLPGSV

SEQ ID NO: 1021858 - protein, 142 aa, Homo sapiens
MEENFPLNCVTTKNTIARPQDEIPEYEGGNGSSTSGEPTTRSQVKMALTEIATYRELLEGEESTDFSASSQRFLLDLGGTNLEFNSLWVITHLQEEHCLSKERVKLEMDTVYPPELSQDFTVALEYKYCSTTPVQPYITRQD

SEQ ID NO: 1021859 - protein, 138 aa, Homo sapiens
MEENFPLNCVTTKNTIARPQDEIPEYEGGNGSSTSGEPTTRSQVKMALTEIATYRELLEGEESTDFSASSQRFLLDLGGTNLEFNSLWVITHLQEEHCLSKERVKLEMDTVYPPELSQDFTVALDINIAAPDAVARRT

SEQ ID NO: 1021860 - protein, 186 aa, Homo sapiens
MVCTRKTKTLVSTCVILSGMTNIICLLYVGWVTNYIASVYVRGQEPAPDKKLEEDKGDTLKIIERLDHLENVIKQHIQEAPAKPEEAEAEPFTDSSLFAHTGARSSAPKAGGVALKQFQYYGYNAYLSDRLPLDRPCLDLRTRGVTKLSELDSCRSDIEDTTNERSGRRDTSTARKGPKKARNQGD

SEQ ID NO: 1021861 - protein, 67 aa, Homo sapiens
LQTQDEEPRVDQRYLSPGMVNFSSASEVDFYIDKDMIHIAVHLRLVQVVYGDFFIRQIQQHFEESYI

SEQ ID NO: 1021862 - protein, 126 aa, Homo sapiens
MDVGHGSLCNVLVRLILFLVPFYEALSTFILFRYHAGARLKGGDEVIDVAPARLLKQNAPCNKTGLVGAARGERHATSTPLQSLVRQRPPVFSVAARRLLSHRVRPLPFLPCLFPFASPCLGPHTP

SEQ ID NO: 1021863 - protein, 215 aa, Homo sapiens
MDVGHGSLCNVLVRLILFLVPFYEALSTFILVCFHLVCRSYLGCWGGIQTLSQGPAWEGRRGPPPRQKSMPFAVACKQACDSTCRSQIACRGRGANERHSRRTEWGVEELWRCLDVAQEGGRGGPIHRQGTRQWATLTITKWLRVSPRRNDTAIKQVLYGPVVPRGRGATSSLWVWVRPGTPVSAVVTWCRFSTSVLPCPLAWLFPSANLAGPIF

SEQ ID NO: 1021864 - protein, 258 aa, Homo sapiens
GSREERRALGPLPPCSYALQLGMAGYLRVVRSLCRASVLAAVPGRRLALTAPTSQEQPRRHYADKRIKVAKPVVEMDGDEMTRIIWQFIKEKLILPHCVHIHAKCIYSSWSPKPVTMTDVTMVTIDSALATQKVHVWLSIVPPSPLIRPVWKTVQAEEDVEKSQCELSWNILGGTVFREPIICNNMPRLVPVLDQAHHLLAGTPMFDLVQGAQYFWWQYRGRHFPNMVFTPKRMAVVFRGTWEVYNFPRRPPLGVGLF

SEQ ID NO: 1021865 - protein, 197 aa, Homo sapiens
GSREERRALGPLPPCSYALQLGMAGYLRVVRSLCRASVLAAVPGRRLALTAPTSQEQPRRHYADKRIKVAKPVVEMDGDEMTRIIWQFIKEKVQAEEDVEKSQCELSWNILGGTVFREPIICNNMPRLVPVLDQAHHLLAGTPMFDLVQGAQYFWWQYRGRHFPNLVFTPKRMAVVFRGTWEVYNFPRRPPLGVGLF

SEQ ID NO: 1021866 - protein, 75 aa, Homo sapiens
MMMPCTETLKPWHRARVRGLGDCLVRITKSDGIRGLYQGFSVSVQGIIIYRAAYFGVYENGIFIGGTELGSRLMV

SEQ ID NO: 1021867 - protein, 332 aa, Homo sapiens
LHTLVYCNTRSGWEVRGVRMAAMPDVCAHPCLLVSMATVDRDPWGKPGHVGLVGEGWIQGRLLRSGFPFLPDSTIPCDLPLSCVFSSILVSTKALYSPTPMPGVQLTPSHPQRPEEATRHPYRETFTRMDVWAAAPITKGKAPGSWASIRGPPNTQYPFRHLHRRSPYTIKPGLAASHERPGQREAGLDGRARGQMGSLCLTEYRSCRLWGKINSQVFRALHPPWSPKLGTTIDDPTKTPQRALRHSGATHNNPEGEMDTDLRHIHTKKVRTLKRFEGDIKANRRKIPQGNLDTPQGATNREEPIHTPRKWPILAHDHKMKPSVERGIPLTS

SEQ ID NO: 1021868 - protein, 36 aa, Homo sapiens
MTHVLSAVAWPYANWPRATSGHVAGFGVPSARYCLM

SEQ ID NO: 1021869 - protein, 239 aa, Homo sapiens
SLGPEQPTHQPRQLQVTMDAEGLALLLPPVTLCSPVWTAGSGEDCPWAQLQQPWSAGAGPSQAALWAKSPGVLAGQPFFDAIFTQLNCQVSWFLPEGSKLVPVCQSGLRSWGPAHCLLLVGTGWPSTLLALLQWHCQCCRLLQVEAAKGGRLDWARGRHEEDHRQGFLAGGEVWAPWWAGPAFDTSYDLGVAGDGDRITMWKDGREDVEKAVLGWTEQGGVDFSSEGGKWKWQRDLEGR

SEQ ID NO: 1021870 - protein, 150 aa, Homo sapiens
MDNVLQTKECNIEEIVVFGYENYNNMQLDVVSNRIKSGVRIDNGEAVMKRLAGVVGATVVLTFGMAVGAFASTSGNIGIDTGQNVSFHGRYTYGVAHRGWAGKAVEGHRNLGVTGSNSGHVNVPQQGYSWRRIGHRNIGRKVGVTSDVEP

SEQ ID NO: 1021871 - protein, 301 aa, Homo sapiens
MTPVRMQHSLAGQTYAVPLIQPDLRREEAVQQMADALQYLQKVSGDIFSRISQRVEQSRSQVQAIGEKVSLAQAKIEKIKGSKKAIKVFSSAKYPAPERLQEYGSIFTGAQDPGLQRRPRHRIQSKHRPLDERALQEKLKYFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDWARCLRLMFRPTCLTCPALPATSCTVRPGPGLPPLPLAPFQKLPTFHTEVAEPLKADLQDGVLT

SEQ ID NO: 1021872 - protein, 279 aa, Homo sapiens
SGEAAAGASGRAARRHHDSCEDAALPGRSDLCRAPHPARPAARGGRPADGGCPAVPAEGLWRHLQQVFSSAKYPAPERLQEYGSIFTGAQDPGLQRRPRHRIQSKHRPLDERALQEKLKYFPVCVSTKPEPEDDAEEGLGGLPSNISSVSSLLLFNTTENLYKKYVFLDPLAGAVTKTHVMLGAETEEKLFDAPLSISKREQLEQQVPENYFYVPDWARCLRLMFRPTCLTARHCHDLMYSATWARIALSAPGTIPELPTFHTEVAEPLKADLQDGVLT

SEQ ID NO: 1021873 - protein, 258 aa, Homo sapiens
RNQARGTLRLEGGAQDCGTRQGCCLSQQQRKMSDSEDSNFSEEEDSERSSDGEEAEVDEERRSAAGSENRRRRLRTTEDGRTEEEEYDEEEEEDRLTDLNRPNDNPCQWKCFNSWTDGCMFDRLSTEDEDHVGRTGAEDILEKEEFEASNISIVVLLVMIIRCRVARCLDNYPRRGKLDQRRKKELCEFYMKKYAKSSVGETVYGGSDELSDDITQQQMLPGVKDPICGLSLYDGGGTGHAISLMRKFLPPVTERPWI

SEQ ID NO: 1021874 - protein, 161 aa, Homo sapiens
MTASPDYLSCVLFGITAGATGVQRYGSDEKDLILLYCTQSRLWPTTTVGQLHEAASYDRESVGTDLERLLTKETYHIDVEMPVLGVAAGPKPSDRFNQSVSNELNHWTRDFLLSLYLMGSFMSGKSCILRLPRTMSYYLNCSMPSGIFDKAIHDTVALVSP

SEQ ID NO: 1021875 - protein, 147 aa, Homo sapiens
MFVNGASLGAPVAAMFERGPRGRPGPFLRCYPRAWRIHSFTQAHPLLSSRSTRLQLGKNNPVVGQPSAVGKYRSSSRGLAPCNIVAKGSLGPLNERTAEKDCGSEPARVPERLTGLPLGQLEDAQKLQGATSMGQRVSSGVGGIRIR

SEQ ID NO: 1021876 - protein, 71 aa, Homo sapiens
MFVNGASLGAPVAAMFERGGNYVLEGGATMVLRGSSLEASLATMSEEGQTAMFVRGASPGAPVAAMYEMGT

SEQ ID NO: 1021877 - protein, 109 aa, Homo sapiens
RLFSRAHRQLGRSDPRGSAKDKPVGLKEEEEWKKNKKKTQCKVTGPSKFDSLEKKRAVGRQCEKIELARWIGIDDDHFSKLKESSVFHLRTLCWAQRTPRNKHFGDQIE

SEQ ID NO: 1021878 - protein, 99 aa, Homo sapiens
LALALRPGSMGLPRLVCTFLLAACCCCPRVAGVPGEAEQPAPELVEVEVGSTALLKCWPLPVPRQPQPCRLVFCPQGEADAHLPVCASGQGQMRTLGEY

SEQ ID NO: 1021879 - protein, 62 aa, Homo sapiens
EGTGSITAPPSGETVGGQEEGCCGSLSPWKHVSPSEAAAGHQARSWSVEVGQDVFRSCMDRA

SEQ ID NO: 1021880 - protein, 225 aa, Homo sapiens
ADVGEGCGRKRAGRGVPGAWWGSPAPAPTAPKKAWPWVPSAEPWGVWGRWCPGAADGPGTLQRPELAPVPAAAVPGWRGLSYCRWATSSSDLCASMWFTYLLLYLHSVRAYSSLLAAGGCLLLAGAMVGRDWCCAHRSWGYEDLTAPQAVCARYGPRIGPVYLVGTVLMSCLSFPFIFSPCLGCGAATPEWAALLYYGPYIVIFQIGWASNRSHTKTHPGARNED

SEQ ID NO: 1021881 - protein, 34 aa, Homo sapiens
VVHLVPQYCFRIRGYHPLWPDFPFRFANNTAKEY

SEQ ID NO: 1021882 - protein, 115 aa, Homo sapiens
RKMSRGISLCYLARYLVVVVTSVPSVCIQPKESLGRNGNRACPCFMENSFFWLWVLWENETGNKDVGVSDGVKVNVCVSAVVPSSSAMVWLEVNSGGSSWDIFRVDVGESVRAEV

SEQ ID NO: 1021883 - protein, 76 aa, Homo sapiens
LVFHIIVTTVETHHPPPHCAHIHSLVSINIQEVLMDVIGCYFFHVEECSDTPLLHMHFCVRYRSVRLALRCHTRQA

SEQ ID NO: 1021884 - protein, 234 aa, Homo sapiens
VRLRLIAELALPRARPAGSNLNMCLRDSQIYAVDYETFDCGLFSGRLAAWSWAWCLTVLPADEPASCSCSACLPALRAWACLVTRKSWLVAARRAVLLAASLLGAGPTTRVQNLDHVEWPGGILTFKGKTESEALEIEHVMYHDWRLVPKHDGGGLHRVHAWRRKTCLASVPYPPLLRGHDYQQNDRKMETQATEEPMLNVQRIRMEPWDYPAKQEDKGRRKAPPSKCRTVGYR

SEQ ID NO: 1021885 - protein, 156 aa, Homo sapiens
NCEAARSRILSIQKDLANIAEVEVSIPAKLHNSLIGTKGRLIRSIMEECGGVHIHFPVGGSGSDTVVIRGPSSDVEKAKKQLLHLAEEESKAKEFHVLTSRAKPGGQRLPDQPFPPVRCKVGAGEQFLGKCADSTGARVIFPAAEDKDQDLITIME

SEQ ID NO: 1021886 - protein, 102 aa, Homo sapiens
KRGMYWSSGRVILPSQYESFTFSRANEKGVLQALFTHIYTDYMDVKDGHLNTHGSGDIRVLAEFDTPGHTLSWGPGIPGLLTPCYSGSEPSGTFGPVYHVCG

SEQ ID NO: 1021887 - protein, 132 aa, Homo sapiens
MGWRTHRPHPMLPTRLWDPPCHMTASLTAPVAGESGSPGNPLTASRDVRDTERGGAISDPYVLARWGEKDTPVRAGSEARIRRDDPGTRAEARILRDMLRNQGASELGTQSGKVSKEVRIEGGTERYPEGHN

SEQ ID NO: 1021888 - protein, 206 aa, Homo sapiens
RLGSRARGASVTPDSGPRAFSASAADASQNLLVPSRARPAGGRNPRFTACPPRTLLLEGEGTPNQPASEKEPANARSQRGERGGTEDEDDEAGRQAAGSSKKQSLIRGTGKRDTAHTTSHEVDNASLFLTERAIYNCTRTQGQHNLVNLRGYILSLKKTKTDELRNLQQDCFTTGQATVSSLKKNVGQFSGFPFEKGSVQYKKKEE

SEQ ID NO: 1021889 - protein, 206 aa, Homo sapiens
PQRDSRKGGREGAGGTAPHHSYRYGPNLPLPPPLHRPGARTPPNPVCPLGTDTPTETETQPSATTAAAAWLGRGPAPPWPHYPSEVARMDLWPGAWMLLLLLFLHAALTCMTTLMVLQAPDAKYFFKMAFYNGWILFLAVLAIPVCAVRRTQRRPLSTAPPPPVRAPAVRGAFPPSPPSVVVSPPPSLALLGLMEVLPGRCVPIAK

SEQ ID NO: 1021890 - protein, 356 aa, Homo sapiens
PQRDSRKGGREGAGGTAPHHSYRYGPNLPLPPPLHRPGARTPPNPVCPLGTDTPTETETQPSATTAAAAWLGRGPAPPWPHYPSEVARMDLWPGAWMLLLLLFLHAALTCMTTLMVLQAPDAKYFFKMAFYNGWILFLAVLAIPVCAVRRTQRRENMKILRTNACVHNQDYDVTGLRVEVATGAQTVTLPPGPIVGCLQPDQTLVSTLHWRMHGGYLPMAGDVAQFARAGEQLMGLDYMPGLDLRCWARESILPDEPEARRGDSPGTEGRRGSDGDQTQERPWRRPAGPVKGDQARGSPSEGKRRKRDMGARSGGARQQRSARHTTNATQGAPAGRSRRGAQRGRRRPNQQKEGGT

SEQ ID NO: 1021891 - protein, 221 aa, Homo sapiens
MDPACAGVCWALWPGGCALAWRLGVPPPAAATHAKPGLASAGAAGGLSPVAAARTGEPAACWELRRWPCGGALGLYHTAAVAPARPRTSMLSAQPRTLPVHPPAVTLYQYNDVSFYSKVRAFLDFHALPYQVVEVTPVRRAEIKFSSYRKVPILVAQEGECRQQLNDSSVIISALKTYLVSGQPLEEIYYTRHDVYQPGGGGWERGLARGGPVVAAGAMAV

SEQ ID NO: 1021892 - protein, 199 aa, Homo sapiens
GSVPEIEFRSYLPDLPGIANDLMYSADLGPGIAPSAPGTIPELPTFHTEVAEPLKADLQDGVLTAPPPPPPPPPPPPAPEVLASASPLPPSTAAPVGQGARQDDSSSSASPSVQGAPREVVDPSGVRATQQETIRQAGGNGKAKLRSVKERKLEKKKQKEQEPSREPRVQGKPDPPNKLAMRRKGIPGKGPGAGEGPGT

SEQ ID NO: 1021893 - protein, 298 aa, Homo sapiens
GSVPEIEFRSYLPDLPGIANDLMYSADLGPGIAPSAPGTIPELPTFHTEVAEPLKADLQDGVLTAPPPPPPPPPPPPAPEVLASASPLPPSTAAPVGQGARQDDSSSSASPSVQGAPREVVDPSGVRATQQETIRQAGGNGKAKLRSVKERKLEKKKQKEQEQVESHEPRLRDFDRADALAHKSASLRSTTGILWERTWGMVDGAHEKEHFAPRSQTTSPCLCRHRSSHRTEEDEERLGMRSGASSDTFTPPDPDMGHVLLTWTQPGQDCSDTACLGGGDRNQSSVTETSFKERKDWR

SEQ ID NO: 1021894 - protein, 55 aa, Homo sapiens
PCHDSEHVRPPPGSLLEDVASLQVSPQAPEAGGQRGLSQLLGCWEQTESFLMDWH

SEQ ID NO: 1021895 - protein, 432 aa, Homo sapiens
GPPDVCPTPCRLSGAGSELRSAVEAADAGGARGGHSSMGQSGRSRHQKRARAQAQLRNLEAYAENPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPALLVLNSFGPHGMHVKLMATMFQEPVPLHQRAPRVNLNTIKRCLLIDYNPDSQELDFRHYSIKVVPVGASRGMKKLLPGEVPQHEPLQDISELLVTGAGLSESEAEPVRRPHTSHELPQGLSLAVAQHAGAKSECTCGSPRSALRMTLQLIKVQEGVWAGPPDVPQFCAARRSEELQAPPGSPGVKKLRLKRTGGPQARNVHRKQEQRDAPNEEPGGLKKAGRVGKEASVTLRRDCVAFRARERCPPGKRAGKIPRA

SEQ ID NO: 1021896 - protein, 438 aa, Homo sapiens
GPPDVCPTPCRLSGAGSELRSAVEAADAGGARGGHSSMGQSGRSRHQKRARAQAQLRNLEAYAENPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHQKRARAQAQLRNLEAYASEPALNSFGPHGMHVKLMATMFQEPVPLHQRAPRVNLNTIKRCLLIDYNPDSQELDFRHYSIKVVPVGASRGMKKLLPGEVPQHEPLQDISELLVTGAGLSESEAEPDGDHNITELPQGLSLAVAQHAGAKSECTCGSPRSALRMTLQLIKVQEGVWAGPPDVPQFCAARRSEELQAPPGSPGVKKLRLKRTGGPQARNVHRKQEQRDAPNEEPGGLKKAGRVGKEASVTLRRDCVAFRARERCPPGKRAGKIPRA

SEQ ID NO: 1021897 - protein, 52 aa, Homo sapiens
MTYNYSRSPERDQDIQKRTGNKDEKHGVTYQRGYRDVRIEERGRKHAERAER

SEQ ID NO: 1021898 - protein, 92 aa, Homo sapiens
MRSRGSQCDQLCGRVRARADRDLVEVMDPSFVCLKIGACPSAHKPLLGTDEVYMWAQANWCQYHSRQQPTCNAARRIAKRHVVELWSDGGVP

SEQ ID NO: 1021899 - protein, 225 aa, Homo sapiens
GHCAKTMVVGVGTTLCGVAVRESWEAGLVRARRCDAQTWAPRFPARLRSPGRPDPRHVCDPTWQKEYKCGDLGVRQDERVPHYLAGSVIRTTMPEAVPVKINQSQQTTNVYSFSVTHETAFLGPKDLFPYEESKEKFGKPNKRKGFSEGLWEIENNPTVKASGYQSSQKPELCGSSLNPEPRSMPAVVHGASQHRGNASRGSQRTQDRAQLVIDEPAKEKNEKGA

SEQ ID NO: 1021900 - protein, 32 aa, Homo sapiens
MLHYINPWNKEKPNINDEMRWGSRWMECGCAC

SEQ ID NO: 1021901 - protein, 252 aa, Homo sapiens
ENLCEEREGASRDFKGRCEAIMDAMKRGLCCVLLLCGAVFVSPSLGNPCPITESGCHDLTKVAASQGVSTGAPDQQALYFSDFCVPVPREDLAWGKVAGEIRLPGPRCYREHQGITLQGARGAHSDEWRPSAPNWNKQRVRPRQPYRTGRRPDAIRLGPGRTTTLLQQTQIDDSKPMVHTVFKCWGSTSSGVHVRHHLHIDSDGKTVTATLGNGSAYCGNAQAHRIGCLLTTVRIHDPDRQGYTTRTQCQHW

SEQ ID NO: 1021902 - protein, 184 aa, Homo sapiens
KDANSVTSSLRKANLDKRLLELFPVNRQSVDHYAKYFTDAGLKELSEFLRVQQSLGTRKELQNGAPGASFSGMPDRGGGALCQMNDTEEEVIFQETAADWLLPVEHCIMNACSDVEPKKRTDTLLQSQALKHPASNYAPLLAVFSSQRPAQSLILLQTGLRKYVRTTNIHFSERPFQKIVVSLL

SEQ ID NO: 1021903 - protein, 33 aa, Homo sapiens
LRRKQYEMICCSRLSPKDSSYLFTCRCACLGIV

SEQ ID NO: 1021904 - protein, 69 aa, Homo sapiens
SISTCCSSIALTVSCYVHSHWVCCRCAEAGTAGTATLSVVSGTKPSIKSATLRTSTTATLVVVYISHVF

SEQ ID NO: 1021905 - protein, 415 aa, Homo sapiens
KEKVADEDDVDNEEAALLHEEATMTIEELLTRYGQNCHKGPPHSKSGGGTGEEPGIPGTSNGDAHETLERSQSRETPSQENGPTAKAYTGFSSNSERGTEAGQVGEPGIPTGEAGPSCSSASDKLPRVAKSKFFESTVQDESDEAEEEEEAPREGMQRGSRMATAVRQAENEEDEDDTEEAEEDDEEASKKQHDGARDGKATEEPGSDSGTTAVVGPDTREAVEIVATRKETLDCVVSEAGKRFKTMSYDHKPEDEVETSTAIKEMLCGKVTMDGRVNAGAVKHLLEPIVDHFISEKTKNRANLRTQSDLQPRILTIKVHVTLTDDHEFTGQLPVMASGNVMSSQEVVDFIHIKDAASVMRNGRSFGLLSSIVEELLDQCWTPNTPGDGYQGVTTLTCIHHLLQPENTEEAPAKK

SEQ ID NO: 1021906 - protein, 141 aa, Homo sapiens
KEKVADEDDVDNEEAALLHEEATMTIEELLTRYGQNCHKGPPHSKSGGGTGEEPGIPGTSNGDAHETLERSQSRETPSQENGPTAKAYTGFSSNSERGTEAGQVGEPGIPTGEAGPSCSSASDKLPRVAKSKFFESTVQRM

SEQ ID NO: 1021907 - protein, 195 aa, Homo sapiens
SPSSGVICADRLAGLFNGSGLQVGTVWLMERTAPQESEPQPGCGGRYRCSAPSEKGIKWWGTILKKKCINHCWLFAYLVRIGFIFDQIILLFFAINQIPHIYWYEVLHPPLYVSVFLGGLHSLLPSPSSPPHIMSPKRVCFLSRTPVMPSSPIPRAPYCRSYPGQGFFQVGGTEHEQSDIPTAPQTCKATKAGGV

SEQ ID NO: 1021908 - protein, 117 aa, Homo sapiens
MVSKFTSPATSSMEATSIREPSTTILTTETTNGPGSMAVASTNIPLGKGYITEGRLDTSHLPIGTTASSETSMDFTMAKESVSMSVSPSQSMDAAGSSTPGRTSQFVDTFSDDVYHL

SEQ ID NO: 1021909 - protein, 236 aa, Homo sapiens
GSPGTLAKLQGPEQGAFVHDPSTGTVHHTHPLLALGKGCLSFQQAVFGGGQEKEVCTGELNNSQRGQNLSLQGVSVLVTTQEEAETFVVESEWGSYLYKSSSQRTCTSGIAYLLFQIRAQAKNLPGVFSIQPRGPHVELLFRSPICAGPSSKPFAVGNLPGQAMIIPQVTFCGLRLSPMGGVPNPDALPWCGAPGSPFCPPCCVSLRPPWGSPRRVIHSGALGGERHIRRADSDPV

SEQ ID NO: 1021910 - protein, 283 aa, Homo sapiens
LSGRAWAAWRILFAMPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGPEDRVPAAICKGDHWTTRCPYKDTLGPMQKELAEAAGPVYCREGEAGGRARAGAGHAGHDREYVPRAWATGQPPGGPWGHRERKRPPGPILRRGTTGGSGWPPEPGGKGPGSTPGEGR

SEQ ID NO: 1021911 - protein, 146 aa, Homo sapiens
QEPVRAEQSRGRAASGAGLMRAPSSRHGPWNTLSSLLPAGVDYSTKFDDEQEFVDEQEEAAAAVLAGAGPGTPERWWTGLLLSKGDMLRGIPMQALLETLPVKHQRINAVTGSEAQGVVLKCAHRNFREQLQIEQAVRVTWTETWR

SEQ ID NO: 1021912 - protein, 382 aa, Homo sapiens
MRRSADASHVPCPWLRSLTLVARMDDEFTKVMHNTDASLPDYYVEHLKDDAQVCAIIDRVQRYLEEKGTTCRGLAAVYTDCVIPCIDPELQSIDLSYAPSHVAQSDPVLRAPQSLMQDQEKDEGDDSAVLMERLCKYIYAKDRTDRIRTCAILCHIYQRECRAWWYMWQGWQHVPPCSDSRWYQARTHAHDHLQDNIQHADPPVQILYNRTMVQLGICAFRQGLTKDAHNALLDIQSSGRAKELLGQGLLLRSLQERNQEQEKGGAGAVRSPSNLHHQPWRLLECVYLAVCHAPWRLPLHGRPCEERVPADAMIKQAVPPPGCALEQSDRGARGMGSALQSPMARKHVDRLTSKCHGRMGDWEAPVDRFVSSMRTMNGKVCG

SEQ ID NO: 1021913 - protein, 365 aa, Homo sapiens
MRRSADASHVPCPWLRSLTLVARMDDEFTKVMHNTDASLPDYYVEHLKDDAQVCAIIDRVQRYLEEKGTTCRGLAAVYTDCVIPCIDPELQSIDLSYAPSHVAQSDPVLRAPQSLMQDQEKDEGDDSAVLMERLCKYIYAKDRTDRIRTCAILCHIYHCSDSRWYQARTHAHDHLQDNIQHADPPVQILYNRTMVQLGICAFRQGLTKDAHNALLDIQSSGRAKELLGQGLLLRSLQERNQEQEKGGAGAVRSPSNLHHQPWRLLECVYLAVCHAPWRLPLHGRPCEERVPADAMIKQAESTTQACALEQSDRGARGMGSALQSPMARKHVDRLTSKCHGRMGDWEAPVDRFVSSMRTMNGKVCG

SEQ ID NO: 1021914 - protein, 60 aa, Homo sapiens
LEDSKSLIAPGILYQPTCVGFGYGLTRRLFPGTPSPPGQSNKTERYTASVTIRWPGNIHP

SEQ ID NO: 1021915 - protein, 325 aa, Homo sapiens
MDLECQSVGLGQQMLAGVAAIGRATGQRPTGLSTNKPAGGPGQPPARVPEGPVGYRTARETRQTPKGGEFGQAGQNPPEGPGSPDSPGPQQAGILRFTDRVRKAPRVPGNIPFFRNLRDQEASQSSKNPEPKGVPTFPKFPSVGSFPESPGIRRVPKCTRYFGVPREVPPAKWSKEGDIREFPGYGDSEETFPQKGSPLDGRTGTRVGPFTDTMIRFESRDSRQTGKGHAGHTSSPVDHRRGEPHPSQLQMKRPCTLANTNEEQDDGTTPQAHGAASHRPRRTTRIEEDKSKHDDGGKDKKKTTQSAENTAESTSSETRTRHRTR

SEQ ID NO: 1021916 - protein, 247 aa, Homo sapiens
PWNTVAPELVSLRPEDPPRWLDVLRLCGAGDAGCVMLVLLCGACDAPAGPSSMRPAVTPAEVLLCLPSPAKTYLIFLAVCNCVDVLIDPSATNRQLLCLPCPDLEPLWSVLQSNVPASALLTGCALRCLWSSVPLFLTCVLTLVLLHACWVPVEAWPPPGAAPLLGMLLCFHLKCSAKQRLPVQEEKLSAKHLKFAIAGWWKSQEVAEECSPCSNFRAKTTPECGPPRICRENHLQPHLEQIESNSC

SEQ ID NO: 1021917 - protein, 104 aa, Homo sapiens
MAVTEASLCASALLLRPQNRSKTVYEGFISAQGRDFHLRIVLPEDLQLKNARLLCSRQLRTILTGYHRKVHTDDCSYSPDPMSIYDGDVKDADWNAGLENRQEL

SEQ ID NO: 1021918 - protein, 198 aa, Homo sapiens
PRQCPAASRKRKKFPERLRSRAASQTPGEPSLQLPGAAEGGGGSGPAPLPEPSPERVTGGRRAGFPAPREGWCRDRGVAARRLSSGGGAGGRPPPPCRPEGLQQRVEFLAQAREEVGATRGGSGKGAEAGAAARSTAQLQVAPLATRTPLRPGKGRWRAVLPPPFGKPATSHPLRRRPGKGSKGSRSRSCYPAGFSHS

SEQ ID NO: 1021919 - protein, 97 aa, Homo sapiens
VIQIWGRANFKTAKAQVSSKGWGKGSRCSAPGTLELWGTCNLALSNQFKFLGFSWKTFYTPIFLPSILKFISFQIRLFHFLSFCWDITTFCISSCSM

SEQ ID NO: 1021920 - protein, 189 aa, Homo sapiens
WLPGLKGKRFGGRGPDLGRGVRPQGQFYTGISISTLPILLSVDLRAFVHFIQEAPISARHPENPEWCDAGTLEFLSGVYKFSEEAQRVERYVADRNMCCVRSPIAGLSCVDLRILPDKTSLSLRHIYVAEVSKQNSVTTMCAWWGASLLGGRKYKRREIFSREYLCGETHKGVSLRDAPKDWGVRTVER

SEQ ID NO: 1021921 - protein, 486 aa, Homo sapiens
MEEKLRGVLRFLMAAAACGTKAMALFKRTLVLSPAAAPSVPWAQAPAPAGLLLASCPPGPCKGLASCGEVRQCCGACLPQSHSHSQSQSHSHSHSDSMLLDVSHRRCVLSAQQDSLSSSLKTCYKYLNQTSRSFAAVIQALDGEMRNAVCILIWFSETLDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGQRVLASRGLEQVCSRQSGGFAKPGGILTVAVQGLNELYNQCTDHIPDVITTFRDSETRSVFNFCAIPQVNGHWHFGWLLIITSRWFKGPVEDPGGQAVTLVMIAPICSGKHQYTIWRELHRSDRPLCKQDFPSREFQGGSKPTIRSRGAGTHLRQCRQTWGTGLQTQKSRRRGTFVACE

SEQ ID NO: 1021922 - protein, 422 aa, Homo sapiens
PGDRRGESRARESAAGARMECVKLGHPEEFYNLVRFRIGGKRKMPKMDQDSLSSSLKTCYKYLNQTSRSFAAVIQALDGEMRNAVCILIWFSETLDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGQRVLASRGLEQVCSRQSGGFAKPGGILTVAVQGLNELYNQCTDHIPDVITTFRDSETRSVFNCCAIPQVNGHWHFGWLLIITSRWFKGPVEDPGGQAVTLVMIAPICSGKHQYTIWRELHRSDRPLCKQDFPSREFQGGSKPTIRSRGAGTHLRQCRQTWGTGLQTQKSRRRGTFVACE

SEQ ID NO: 1021923 - protein, 282 aa, Homo sapiens
MIVESRGSHMVEMTLQWDLNAWTKSAEAFGRDCGRASWHSAHQALAPMGPSQEPQGPWSKQGSGSSRPMERAGGLWALGLADDPYYTVRSPMCQVSRRSRSGEGEVSGLMRKVPRVSLERLDLELTADSQPPVYQGTSQAVTTEDYNLYMLLERGCCLLQLPASQWTAPAGTPGAPPLAGMAIVKEEETGGCHWSPSYQPLEGPETKPVLIGYYAEGYLVLEGPRLAYNLSGSTSSVAWKVGGYLSGTYRPQVVAREPLDDSCHHFAGVCQKPGDTGNVQPV

SEQ ID NO: 1021924 - protein, 258 aa, Homo sapiens
HQPRARVEIFYKRPSGAPVCDNTVGPELMPSVVLPGPFFFFLLCLCFVLLFFFFFFFWAFRERYPGSGQSCLRAKDQGPIMLDEVQCTGTEASLADCKSLGWLKSNCRHERDAGVVCTNETRSTHNLDLSRELSEALGQIFDSQRGCDLSISVNVQGEDAWASVANGHPDANLEAQALWKEPGSNVTMSVDAECVPMVRDLLRYFYSRIDITLVKCFHKLASAYGGQELQGYCAFAILLPQDPSFQMPLDLYAYAVAG

SEQ ID NO: 1021925 - protein, 268 aa, Homo sapiens
MHGHDPSRLFWVWLLVAGSQGVIDGDMWLVDGGATNQGCVVMFFEVSGVLCVIFVGFDVMLVLSAGFWAFRERYPGSGQSCLRAKDQGPIMLDEVQCTGTEASLADCKSLGWLKSNCRHERDAGVVCTNETRSTHNLDLSRELSEALGQIFDSQRGCDLSISVNVQGEDAWASVANGHPDANLEAQALWKEPGSNVTMSVDAECVPMVRDLLRYFYSRIDITLVKCFHKLASAYGGQELQGYCAFAILLPQDPSFQMPLDLYAYAVAG

SEQ ID NO: 1021926 - protein, 192 aa, Homo sapiens
SLPPRRSPRRSRLRVPPPHPLSRRWLCHPRMPILANLPVDVFTKGYGFGLIKLDLKTKSENGLEFTSSGSANTETTKVTGSLETKYRWTEYGLTFTREMEYRQYTRHRGLLWKIILHVDCKLTFDSSFSLNHWENKCYTSMTGYNAGAAVKPVVCDMDFDIAGPSIRGALVLGYEGWLAGYQMHFETAQDPE

SEQ ID NO: 1021927 - protein, 145 aa, Homo sapiens
IPVIFDALVDADCVVQNNLRLEGTFLSVDQQVNGAWTRVRSDSHPSTLYQWNRTNTVCRTPPTLHPAMHLFTIVPLRRFWDTAWSTSRGPLSPTLPVSILSVTLHCNEYILTISLAAGSYRLAYFRGREGSTSTGTISPFEGTSS

SEQ ID NO: 1021928 - protein, 172 aa, Homo sapiens
APRVRPCVSAQAGLCPPPPPPAYVADIEVTLRGAAGAVSLAHPDSRCWFLAWNPAGTLLASVLAGDLENSCTLVGTGLVDTLDLAQYCPNLKASQRTVRKCSLVPRAVITWPLPGFDATTCIWKKNQDDFAVCKPRLEGHENEVKSVAWAPSGNLPGTACEARDKERLGLGS

SEQ ID NO: 1021929 - protein, 102 aa, Homo sapiens
MRQFLRGLDFLHANCIVHRDLKPENILVTSGGNSQAGLTLAWPRIYSYQDGTYTRGWLHSGTELRSSSGVHICNTVDMWSVPDSEQVVLETLYVELDSDIAN

SEQ ID NO: 1021930 - protein, 102 aa, Homo sapiens; identical to SEQ ID NO: 1021929

SEQ ID NO: 1021931 - protein, 85 aa, Homo sapiens
VAALCTMTAPATLQGVRMRMAVATRAMWLIDEYAMSDFEVCMLEPEGLEKATTYNSHTYSPSGGEVSEELSLKLPTNVVEDSARA

SEQ ID NO: 1021932 - protein, 268 aa, Homo sapiens
ASTRLGLNRPRAQVSLAEGAAPRRRSGSPVGADAPVLAQIPRLGWQRASSTPRVPGSRLHPSCSPDLDPCPVKMCAVCRVPADYMPLPWMQHFFRAENFCISSSMQQTGPGDMTRRVNTQAPPPPGGGRTRGAQEKPLAAQEADPAAMAEAEEDMSILNTVRAAMMMKKMISPAEDRFCRHNSKMFRAQWMFELAQVYSSSNLEQSTLQKQQEALSRKHREDTKRRNKNKAKEEKARELFLTAVEEEQMELFYEDIQDYRKGNELVLI

SEQ ID NO: 1021933 - protein, 33 aa, Homo sapiens
MGPVEKNGEETKMMICFSSIGLRAVASLSMSDG

SEQ ID NO: 1021934 - protein, 40 aa, Homo sapiens
MEAMLNDRRRQARENYITAQQAVPPRPRQVFNMLKKYVRA

SEQ ID NO: 1021935 - protein, 125 aa, Homo sapiens
MRRRPDMGASGSKARGLWALRLGGRRRRLRWQQELRQALERTLEGPKAVPPIRYFTTPRLYGSMIEGWGSGITEILIEETIVNTRNGTEAGQAEASAIRNLIPQGIVKLDHPRIHVDIPVILYEV

SEQ ID NO: 1021936 - protein, 106 aa, Homo sapiens
MRRRPDMGASGSKARGLWALRLGGRRRRLRWQQELRQALERHSGTEAVPPIRYFTTPRLYGSMMRCDPGSVADQKSPPAPGRNSQAQIKEDGYPIEEPRAVAQTLK

SEQ ID NO: 1021937 - protein, 224 aa, Homo sapiens
HLVYLASMSGPAAMTGWQWPCAKANVCCSSRAGLQFPVGLMYTCAAAVKWPLRLMLLLAAVLRQCTWLAVLDVPHLLRSCDAGCGNAGPADNKNDCESSPATCMLAILQLTMDAQQCLLWLAVTDLPMGGVLPNIPVPVLLPKKDQRHLWGRMAPSGRQEVPPSGSQVSTNEVPCCLWPGRHGLPNATHKWALLSVPPTAPHGQELSLLQTAVATAGAAVPVPA

SEQ ID NO: 1021938 - protein, 115 aa, Homo sapiens
MPGAESPWVPARNTQLIITSRKTPRPRPPETPGLRNPLRAVPPWAPRSALTSPGGFPSLPLRFLHLAIIHEEKALTMEVVRQVKGDLAFLNFQNNLQQVRCLPAPCLLGSASLTP

SEQ ID NO: 1021939 - protein, 141 aa, Homo sapiens
PAPPFSAGNGAVPVLLPSHGFTSRPSATCWRCVTAALIFFAIWHIIAFDELKTDYKNPIDQCNTLNPLCTPRVPHPRFLLCHVSCVQPEWLTLGLNMPLCGISYWRYMSRPVMSGPGLYDPTNIMNADILAYVSEGTDGAN

SEQ ID NO: 1021940 - protein, 262 aa, Homo sapiens
GGRKGRRRTCETGEPSGSRVRRHKFRGPAQVYLPGPGACVREGEELVMDEGGYVLYQRVEDWCPPCSSSFDHSPGIHPVEDKAVTELPLYTFTCVCWDPKAESAQSKQELMMLRNAQIVHGDQEPAQPFRRGTGLNGTTRGQDTTGKQGGKQRRRKPFKLGNALGPMGGPNLMRCALSNAREGFRGGWLTGAFARFDQGMAPLLDQPWGAWVALHGNAQGGPKGWASVGPWAASRRRRLPCQACVGVVAPQGALGEALFSRG

SEQ ID NO: 1021941 - protein, 357 aa, Homo sapiens
GSWVVNRHRGVTCWVSLTGLSLHLLILYWCFLKCFLEVARSRMQRIDHQRSLSPTSLPLSPPPSLPLSLSPPPFSLLLSPSLFFSTTLPHLLSTLSVSLPAKESGNNGELLRTAMASQWGPLMRRQRTEDLAGWEATSNERSGDYAPDLQRAHTTLGKVGVSKEPQLLARDMPQSASNASNAAGRRVSEGSARSNTAVGTEEEVGERVTTEHDVKRQKAPNHRGSAGNRPREGGSTPKRGAHNQQEESRPAREKQAKLPTQEHMHKSGPRCYEQRHKEDEYHKSETKKQTDCHKGENIHINARANVCQGTGTRGGIPAGKKGEHGTKRRTKGEEKRGEAGKQHTRSKTRELDTTEGP

SEQ ID NO: 1021942 - protein, 265 aa, Homo sapiens
GSWVVNRHRGVTCWVSLTGLSLHLLILYWCFLKCFLEVARSRMQRIDHQRSLSPTSLPLSPPPSLPLSLSPPPFSASLFSLSLPPPPSHFLYSLPRFRTTPLSLSDLSPCYESGNQVDECQDTLDIPVAVHLDAPVDLNALTYGPHLPRPGGLLPPHLAREPTPLTYLVLREHSTAFRHPATSAPPSTHDALGLRVKELQRTKRSCETAKQARQTRDPVADLALKMSFPYKLVVDSTLLLARIPPHLPTSTEHPESQHHPHLPNL

SEQ ID NO: 1021943 - protein, 108 aa, Homo sapiens
MNEEEATKEDAEAQASEIMRACMAAPHVSRGAPSTVPAAVCVCYWAKLARACKLGTPFPPQRALLFYSLFPLQAQPMEIDLDGAGHLGLTSRSPYSYDLSQSHVFSLE

SEQ ID NO: 1021944 - protein, 284 aa, Homo sapiens
ILDEACTLLIPAALASFILAFGTGVEFVRFTSLRPLLVMGSLESWWSGCPPGMVWLPWQEPTAFLAPLAWDLEARCLTDLLVVKSACLMAAERVKAWTSRYFGVLQMVICIVACTAWALQLADAGTGTPISRRPCCGGDGSWLSHWAVLGAVSSCFVLLVSVSWLRHLYASFSSLTMLSSWASMQVSLPMLVGLVRCLWSRAVSPGSQSSSRRPAPPSVCGAADGAVRWCLPWARTGSSLLIAPYRSTWVLGRGLDRVLSSDSSVAPSYGDQSICSLGPDGVAR

SEQ ID NO: 1021945 - protein, 441 aa, Homo sapiens
VLLVCMGSMVASVFGSGPGGESLLLALGVVRKWDCVFLVSCMVGDASSLISGVLPPCCRVPSAVLHAPRIGLGHLSQGGTHKAVFYVAAGLGRRPPVRLLVFDPVKSVFSSPPLLVFASPPIAVSSRPTNSGLLAHPPVAPRGLVRRVPDFLGFYRWCEDTFSFGPPTRSAGRKYQPVSHPPRERDLVWEVGPPSPGKPFGGVMAPGASSRTIMPWPSVCLAPATRPVGPQVTPPGGCYPGEASLGTGPLSRCGTHTCPTAGSSWVEPCDPGRFLEKKHSPKYYVMDRFHREELCVIAHGRRGGTPPSPGATSPRGLTHLEAPHALVSSSLRLSNTASTPTLPSTLCETSRGSAHLALSHTSHLLFTSSLFLGMTHRNFGYTANTGLVEPPLGPPLALPTGGKETPGATQPHGQSTQRKERGPSTSLGSSLPPHSRPPPTT

SEQ ID NO: 1021946 - protein, 244 aa, Homo sapiens
MLGTSRVLASSLVRSACNLLLLRHGLSCIRLRRVTLAANEVYVLGTLVPQSRLRRGYLPRFPCELTCSGPPAANGRGRYRHTAFGQAVDRARRASGKTTYCLGMSESYLRALGRRVAVVEPRTRDNEGLAVRVCRWTVERRLGGGWGDRRQDALAPRGPTAAQLYCIGVPRKGQPRTRLAVAHATTPYRGHYTILLSTSPVPGRSSSTHTRRLAQHLLPNWRSGTYRLDCRTTYVDTHYLHRPC

SEQ ID NO: 1021947 - protein, 160 aa, Homo sapiens
GLWHEEMKNQIIACNGSIQSIPEIPDDLKQLYKTVWEISQKTVLKMAAERGAFIDQSQSLNIHIAEPNYGKLTSMHLPTLEAGFGGGGLLRGRRGMYSFTGQDQQANPIQFTLNKEKLKDKRKRYQKEGKNEKERKHRQPMVVLFWGEIGDEWSGMVWIP

SEQ ID NO: 1021948 - protein, 151 aa, Homo sapiens
GLWHEEMKNQIIACNGSIQSIPEIPDDLKQLYKTVWEISQKTVLKMAAERGAFIDQSQSLNIHIAEPNYGKLTSMHLPTLEAGFEDWDVFIYRTRPAANPIQFTLNKEKLKDKRKRYQKEGKNEKERKQHHVSLGDRVNSNLGPEKAGRDT

SEQ ID NO: 1021949 - protein, 180 aa, Homo sapiens
MNILGLVVFAIAALAVALSEQLVGLNGEPGYIRLSSISFQLRATDGFVVSLALTVGTVPVLAHQVFAGWSGNRVRERLRGLVGFTSCVPHVEPMYTLMMHALPWVTVQSSVSSLDTDTAHSYVSIFPPDKKTPPYAAFPWWGDNSDELARTWVPTYDHNWENRPFHRFPGLTILTQNMTD

SEQ ID NO: 1021950 - protein, 231 aa, Homo sapiens
RTKVRVHGLMLKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSGTPTPAQLHPSSGEEVLRNIPTQFLLLSKVIFINPFQQ

SEQ ID NO: 1021951 - protein, 209 aa, Homo sapiens
TYVLGTRLGCGNWPPLREPGGTRFPPPRGSASGLVLSPAAPCRRSHRSSYRREWRADQGAAGLPVRHFPCLCARGGPPEAGSPMPLWPEAHLQLYARPRRPPCGRRERMGEILCQSVALGLGLAAGKLGGRQGHPLVLGLEGTWVAAWLSGGFGGGDPSPSTSCHPFRESNCAWLLAVKQSKAGIFTGDGLLRASGTSLMYKICIRLAE

SEQ ID NO: 1021952 - protein, 181 aa, Homo sapiens
YSSGGRTRLRGFRALAPDMQRQNFLAPNILLTLVLGGVRFGVAGSSFLGEPTGGVRDHWHAIPVLKRNGYWESGTDTACLYGAPGLRPYGEQVHVSREHWAAASRGAGSGLRPLAATLAPTPGPPRPSSNSATPQGSSRPTPRVLQGHLHHLDQGVLEKKECLMSWKIISSLQCLKILGLA

SEQ ID NO: 1021953 - protein, 40 aa, Homo sapiens
YQVRSILVSNDVTHVSKAKELKDRHRDFPDVISGAYIMKY

SEQ ID NO: 1021954 - protein, 156 aa, Homo sapiens
MTDAAVSFAKDFLAGGVAAAISKTAVAPIERVKACLLEGWRYCHRQGMITARIKAIHQTAIYKNRGGGPVIPQRGRRGSSGPFQGGGKTVGQLVHQDYFPQPKVSINFGFQKINTSRSSWVVWTKRTPVCGATLCREIWHRVVPQGATSPVFGVPS

SEQ ID NO: 1021955 - protein, 111 aa, Homo sapiens
PRSAGVKAGSRPSPVLQQSASSFNMTDAAVSFAKDFLAGGVAAAISKTAVAPIERVKLLLQVQHASKQITADKQYKGIIDCVVRIPKEQGVLSFWRGNLANVIRYFPHPGS

SEQ ID NO: 1021956 - protein, 105 aa, Homo sapiens
LCTVGSSHEYSCLVYGLKSRISSLLSLVDFKSLVASLSAKAPECVCVPVSNNVRRWRDQPNLGVHCDPCSHADLCFLPSHLSCSREVGLDVSISVSTLCALSHNF

SEQ ID NO: 1021957 - protein, 325 aa, Homo sapiens
DLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 1021958 - protein, 356 aa, Homo sapiens
IEQVSQLSALLWMHSVDYHRLAVQILDELAEKLKRRMREASSRPKREYKLLKPRVALLTLVECSSPNWVASPVDPQTPRSHGFIVFPIFRQDPIRSPLAGALPPLDQPSCKALYDFEPENDGELGFHEGDVITLTNQIDENWYEGMLDGQSGFFPLSYVEVLCAPAAVTHPCARPGPPSTLAGVPPAGSPAFHGAPAARAVSEPAGATWAPALEVLPEQDPTLGWGGLSGWVGMPVLHIALTPKGDRLPFPTPWRQPPPPLPNFSPSWQRRGNTKVLLETLMFLWGSPNSVLTRRGPEPTAYPRVPQLNRMGSRVPWEWLRDRTLVLNPSPAGAGDRAWPYSRPMSHDSKRTPSLK

SEQ ID NO: 1021959 - protein, 83 aa, Homo sapiens
LTATVVKYDHVIPQNKTIRKDSIVPNEEMEKDETVSDCSPHIANIGRLVEDEEPAKVRSTLNEIYLGRTKDIVNELRSVQTFC

SEQ ID NO: 1021960 - protein, 167 aa, Homo sapiens
WSHNALTSIETWYFGRWRPHLVYLWGSGSWVWWSGSPIKKGGDGIQGKIQGWWGIPFPRLVESEGESRGRTAITSLTSKVMLWLPDQQIWLWHHEPREAAFTRQMEKDETVSDCSPHIANIGRLVEDEEPAKITSTLNEIYLGRTKDIVNELQVCADFLLTNPNKKL

SEQ ID NO: 1021961 - protein, 209 aa, Homo sapiens
MSCVLCGFLRVCRLRRCRASLDPSSRWLSLLVFTITCSCSRLFSGLFVCDCRTSGRPARLPRSVILLILLLPVSRFVCVVGVDRSLPPFSRSSTGVFVGDLMIVVDCCSVSFAAPVECTLAVLDIMGSSLSGPLALDRSSAAPSPSLVAALSLPSAIQGRSVTFMRVPRASLFMTRCTQHVLSRPDQPRFGRGLPAPPTVFQPLLSSAP

SEQ ID NO: 1021962 - protein, 209 aa, Homo sapiens; identical to SEQ ID NO: 1021961

SEQ ID NO: 1021963 - protein, 43 aa, Homo sapiens
MEETRTTQSWKAGGRKDTIQLTLQIQNADLSQLVQWDVTSNFF

SEQ ID NO: 1021964 - protein, 45 aa, Homo sapiens
PWQKYRYGDNLAHSCSSVSDFNFVTSHAGKETVDSDFDFSMVSMS

SEQ ID NO: 1021965 - protein, 41 aa, Homo sapiens
LAFMEADSVSSKGLPRPLQHVFGSGTPDPAPARDHRSRISH

SEQ ID NO: 1021966 - protein, 135 aa, Homo sapiens
MSRWLRAGGRRRSGVELAEALAGIQMVARQVGQHWQRFDVIVSPTLAQPPLPVGALRDDEDPAADFDAQCRFTPWTSLWNITGRPAMSLPLHNTRIDGVELPIGIMIGGRLYDEATLLALGCALENTRDCERSCR

SEQ ID NO: 1021967 - protein, 147 aa, Homo sapiens
MAICQFFLQGRCRFGDRCWNEHPGARGAGRSDGRSRGSEPSGNNRRGWNTTSQRYSNCQSRPSSFSKVHTMVGAAEIKKSHISVLLILELQLTGKEGLGLSENPVCFTYVLMSRTDEKEHFWNDIVTDMRGLGNHQGRWMFTGIFTQ

SEQ ID NO: 1021968 - protein, 150 aa, Homo sapiens
MGLPPKTGRNALSAEREKRDICDPPWRERKCSRERDPTRDFSHRRPPGLYTREPRDSRETQIYVFLWRETFERCFSLRTISAPLSLKYISTKSPVILGATAGAHLIDVCCARSLEAHNDIVIEKAHNVVGDSIYKGIEIHSDVHRDSYKR

SEQ ID NO: 1021969 - protein, 53 aa, Homo sapiens
MRFMLLFSRQGKLRLQKWYLATSDKERKKMVRELMQVVLARKPKMCSFLEWRD

SEQ ID NO: 1021970 - protein, 320 aa, Homo sapiens
MYRPNGLRVAEHIRNGMITNGWGKGVTQTIGYEWSERSTEGELKLEFVGSPLRKTMICSTSIELRRSCLEDLLLGPNEVRTPVLAPINSTQCGTPYQVPNNSKPGDHDLCILGCLLGNGCRKGPNPPWDALKGKRTGEEHRNQGGLGKGRWLPKPLWERVPFEYSKHPSWALIGAPHAGASYKGARAGARAGRPQTLSWEHLSSSQSFLFPGSVAALAAPHHGNIVTFGAPNHAVTLWVSPQEGPPYPCQTIYTSVGALLAQVTPDARAANNAAATSCNGAHMSHKTPCQRQNTNTPADPNCCARNALTQHRHNQPVTTL

SEQ ID NO: 1021971 - protein, 642 aa, Homo sapiens
HEIRRPLSSGCLFNTLRRYIHKRCAAAPKRREAMATVLRSCSADEESDGKWGEGRPTLIGGERLDATKSELSLAQKTQWSRIIETLFLAVQGSQNEEGKCEVTESDVSVDGEASINNRKGKLIFFYEWSVKLNWTGTSKSGVQYKGHVEIPNLSDENSVDEVEISVSLAKDEPDTNLVCLNARKRGVYQLLMMKPLRECTSSTLIDMQTVHPHVDMYSINLHIEVRRWSGRITMYVWEREVICEKLDVRLQAYKSLESLSDKPPGSIEHLIEKITLLRHIYGEYSCCTREQPVSLIGSAKKGGLLLEVAFSTNHIEPELRGHLYRPNGLRVAEHIRNGMITNGWGKGVTQTIGYEWSERSTEGELKLEFVGSPLRKTMICSTSIELRRSCLEDLLLGPNEVRTPVLAPINSTQCGTPYQVPNNSKPGDHDLCILGCLLGNGCRKGPNPPWDALKGKRTGEEHRNQGGLGKGRWLPKPLWERVPFEYSKHPSWALIGAPHAGASYKGARAGARAGRPQTLSWEHLSSSQSFLFPGSVAALAAPHHGNIVTFGAPNHAVTLWVSPQEGPPYPCQTIYTSVGALLAQVTPDARAANNAAATSCNGAHMSHKTPCQRQNTNTPADPNCCARNALTQHRHNQPVTTL

SEQ ID NO: 1021972 - protein, 115 aa, Homo sapiens
EVAKMATALSEEELDNEDYYSLLNVRREASSEELKAAYRRLCMLYHPDKHRDPELKSQAERLFNLVHQAYEVLYQIPGRPALRCLVRGLVRPSGYQEQSQQDRYMMDKLRKEPDF

SEQ ID NO: 1021973 - protein, 306 aa, Homo sapiens
MVAKMATALSEEELDNEDYYSLLNVRREASSEELKAAYRRLCMLYHPDKHRDPELKSQAERLFNLVHQAYEVLSEPPNSHGSIYDIYGNERTGKLERTGEVVDKDVRTPADKFDEDVSTRLHETRETRRGRFAAANQSQGERSALDVDCHRPFCIATDEDVCTDVLRQVAFRHDFEHLITMQHNPRSIEAPLTATDTDILSGEPLNPEWNMEEVPLTPRSDAVTSRQSGWRRARNQETGTTYTAAFVSVLNAASANLTPTMPSATTTPRSAVFTTVDIRPGLTTDHTRHLHKNTAQHRTGERYPAP

SEQ ID NO: 1021974 - protein, 219 aa, Homo sapiens
RAKVERSKPRRRWKGWRTHLNMWNPNAGQPGPNPYPPNIGCPGGSNPAHPPPINPPFPPGLSPPQESHGSSSPGGPHLCKQVSGCNVVLPLIHVPESSVILVRHGGPAVIVDKKMQKKMKKAHKKMHKHQKHHKYHKHGKHSSIIPPPLPAVILTEYRPWTLPSSLTSSALPSSFRCHVYWGNVALVLPTPLPPPEPHPAVETLMWLGEWEEDCHGLAI

SEQ ID NO: 1021975 - protein, 168 aa, Homo sapiens
MAIAAFPPRWDPTHPVTNSQGIQDAKPLGPYRSSIPIDCPWNPSCESLGSWHGYGPAVIVDKKMQKKMKKAHKKMHKHQKHHKYHKHGKHSSIIPPPLPAVILTEYRPWTLPSSLTSSALPSSFRCHVYWGNVALVLPTPLPPPEPHPAVETLMWLGEWEEDCHGLAI

SEQ ID NO: 1021976 - protein, 46 aa, Homo sapiens
QNAITKSCLVAELVVRWIKTPPFKISVRLRSCSSRRPPGEAPVTGV

SEQ ID NO: 1021977 - protein, 346 aa, Homo sapiens
PSPPDRKRFNGGHEPWEAGLGSGATPGARAMDVRRLKVNELREELQRRGLDTRGLKAELAERLQAALEAEEPDDERELDADDEPGRPGHINEEVETEGGSGAGGDRCSHLAARGCSLPLRSPGGYSGPGRTIYAMDNITKAEPNSTIPKSSNKKTSQATRGDHLELEQQQAYRPEMTDRDEARSTQPASSRPEGFSTQARTGQQFQSRKEAFMKKTRGTGGTFDAPAEDRRGRSPLLLCSPRMKMTLTDNHGRHIDTYNCERSLHGWTEIASKWLSGPLIDVLCSTLLGTRRAPLSKRKRGPERAACIAFETGKISYRKSTGEQHLRDTVSLGPQLRYTQADDWDP

SEQ ID NO: 1021978 - protein, 226 aa, Homo sapiens
PSPPDRKRFNGGHEPWEAGLGSGATPGARAMDVRRLKVNELREELQRRGLDTRGLKAELAERLQAALEAEEPDDERELDADDEPGLTRAHQLMECLMLHAMPLQPWDGYMPWATAAPLASTSTTTVPTNYGSYWRYNTGPLYPTATPHRTEPNPQTQLQPRHSAPLPSTENQTNRPGPARTAHTTGNYEPRGHTPRRHKRKHHKITKKPPPTPKEPQRAQATHTTQ

SEQ ID NO: 1021979 - protein, 100 aa, Homo sapiens
MNILQQPAGKRGTGEQEQGSPRDEMAHPRAQRKRNLSEIDGKTQTNKGQRYPISDKVKHTTENNPRANKCNRKDQQHNTHTTTHRTPGPEGGIETPERPY

SEQ ID NO: 1021980 - protein, 55 aa, Homo sapiens
GSGRSKARLLESKGFSVGQKEELQKSLNILTAFQKKGPRKRSLKRLSCDFARSSV

SEQ ID NO: 1021981 - protein, 367 aa, Homo sapiens
MIGPKDFFPLLDLCHDMPRDTLHLIIATRCRDADVMSASTAPTENAGILEQSRIPHLHTYFPSYPVQSHPYAVPHEMKKELLSSLTECLTVDPTQCQTSGGSCTLSTCHSPAVLLEHLTHAPGEQIPKKVQKSLQETIQSLKLTNQELLRKGSSNNQDVVTCDMACKGLLQQVQGPRLPWTRLLLLLLSLRMIGFLCHDLKVTPDSFTGPPITGRWLRIILAFSTLHKPKPYRLVDTAPNKWHSLNIHRKPKGFPFGQTGGPINRLGTLGGPFWERAGKLESEPLGPPGILRAPNLAHRGAAQLAAGLGSHQCHSQTSFLPTVPLTLRGLGDSLTSLSQKDTDPAYPDSVNHATPLSRAELPLQYHQ

SEQ ID NO: 1021982 - protein, 243 aa, Homo sapiens
RAPRIRPRDGPPPPAPREARTGQCAGGWVLAARADGTKAAGVCGRFPRLVDPGRARNAGWQGNMADAEVDYFAKESNMIEKWRQESHWPEEDVCRKYKTLKNFLSKPESKVCISLEHVLSGPPFAKRSSQIRLNCKGQTHVYEPSCTVVQDSSERETIGDYIMDRFHLILDKPSNPSSHEVVAWHSNGILLGGEDQGTGGTLEYQVTGCYIVCIEAMPRRLVEVYNRVQAKEYCGDRPAAQCY

SEQ ID NO: 1021983 - protein, 167 aa, Homo sapiens
MTPNTTPSDYAETDGGGGLDDSESRVKTLTTWTPDACAMQPEQRGTPGNSTWYGEATSNGAKEYPGTMVGPPQGARRDRDIPPINSTTATDMTGPSGAPPPKAVQKPHTENRGGTSPKEHCRRTPTDTNDRPTPHTTEPHPRRRKDGADTDRGPKQGPRKHQENEPN

SEQ ID NO: 1021984 - protein, 310 aa, Homo sapiens
PISKGSTHPLTPSRHHQVSPSLAPSTSNNQLFAPGAATEPGARAAAGGSGAKPSDAASEAARPATSTLNRFSALQQAVPTMKAQIIDVLVQMEYALSLRTEGEKTLETEETAYESGVNGGRGAVGTGVDRCAEHLATKRRLSGRNVEERSRERASQPEGLRKAATPSRRHSGAVGGTRRESEKLGLAPSEPPEVRLLSEEDAETKKIQGLVSIGEHVISYLGVEHVTPVKIQGGAGKEDWDVKRASVSFNPPITDMSRSEDSYKNMRRAAVDQWRRGKPVMSAKTWLPREGASAGVGASMAYYGPQAITQ

SEQ ID NO: 1021985 - protein, 434 aa, Homo sapiens
QNWEEELEAGGSPRSGRRLEAAHRVPARIHDLTGPREPALPLGCPGSVWDAQCSQCLAVAVAWRAAVSLAVRGSAEEREPAAALCCCAALAVLCVNVCMFLCACGLLPSGMWLCCGSTSCQVVMWPLCVVLCLVQNLGRNVKRFGCMVQCGLPLKVEAVGVGPWSASIGHLLGEVQKRYPTGERPRQQYGLPIHTGCALNGLWLFTYITGISRQWLDGSDKRTECFRSFERRVEPHWGGTTAIENCARHWGAPGAFPFSEPGRIAGGKVVRFIPREKSYSGGNQHWETLGGGIRFPICFGVPHMGSRQRPRGQDETKAKVPYSYHSGLGKCFGGPQESADRNRTAKIPPSVEWGDLFPKHGLVQKHTGGVEPFNPKQAIGLPKGSPTTGISWGTLSDVWTSDPKGKHKRKSTGPGRLHVDCDNYSDNTQLRERT

SEQ ID NO: 1021986 - protein, 238 aa, Homo sapiens
QNWEEELEAGGSPRSGRRLEAAHRVPARIHDLTGPREPALPLGCPGSVWDAQCSQCLAVAVAWRAAVSLAVRGSAEEREPAAALCAAACGREGQFLGLGLLLQLGWRLPAQSQGPWVGCWRLENIKFVRSVIARVERGGLGPLALYGGNFPRKAAKGALAAEQAFVTGYRQAGGGGCLAEGDPGHLGFPPGPGSSDGDGEGAIQNLREQEHADPHFGPGPRAGKTTILFKLSWAVGDH

SEQ ID NO: 1021987 - protein, 204 aa, Homo sapiens
MMGHGSDYSLSEVLWVCANLFSDVQFKMSHKRIMLFTNEDNPHGNDSAKSQRAEQKPVISEIQAIFLDLMHLKKPGGCDLCLLCTEISSSIEEDEDSGFILRNAEARRLLGRFASSEYPREMVAVMRLKVMLYITISSDLCGHFLSWSRRTLMPHRIKLYRETSETSDKLLIPDFNYRVQAVLVLLSRYQEGLEILWESSRIIT

SEQ ID NO: 1021988 - protein, 275 aa, Homo sapiens
QVAGRLGLGCPLHLHVFAVVSAMLPLLRCVPRVLGSSVAGLRAAAPASPFRQLLQPAPRLCTRPFGLLSVRAGSERRPGLLRPRGPCACGCGCGSLHTDGDKAFVDFLSDEITEDKNNFRSIKTFPKMSGGWELELNGTEAKLGAESCRGKKSRSLFNINNSIPPTFDGEEEPSQGQKVEEQEPELDINSQFPWLKFYTNDDGKKALCGTVIIQRMRLARRTRVRSDIFSIGKLGFSPLASLDGRYLFSLNTDFWEVYMTPRVPAGGGDNLGERG

SEQ ID NO: 1021989 - protein, 354 aa, Homo sapiens
QLTASVGTNDRERGNEFTRNQAGSTGGGKPEKENEEKDKYVNLAQTQINFTCGLVEFHVPSNGNPFTVHIPCTYMESPTQAEAPYCAWLLTCVSEKIIQHLRHVTMMFPALVLLGPKAAPLDGQSVSPLRFPSVDGRSQADEPLMAVGIECASCEAYQLQSCCTCAGCTVPAHNIWPLWITHCGRGNACWACASEWLPGTLVLLIITVLWVISDMAQTKEAIVNVVPKLPMSIIIVGVGQARVRRHVVELDGDDVRISSRGKLAERDIVQLVPFRDYGDRAGHTCLSIGPGPGPPKERLVGQKDPCTNLVVPSLEGPAISHTVYPTRQVKPLHTSGIRKESTHTTQAKENGKKK

SEQ ID NO: 1021990 - protein, 38 aa, Homo sapiens
MRIGFPFNHIKVMVSNSPLSVGRLLEVDVGIAQVAAGD

SEQ ID NO: 1021991 - protein, 89 aa, Homo sapiens
IELRYHMRLLHMVGEERYIDNDTEEEFYLRRLDAGLLVYQHIGYIMAEICNANVPQTRQRVHQILNMRGSSIKIVRHIIKEYAENIGDG

SEQ ID NO: 1021992 - protein, 378 aa, Homo sapiens
AAAAVSESWPELELAERERRRELLLTGPGLEERVRAGVGSCRRGFHPAAAALLGSERLRELAARRGLAWLQGLPQLHSLVLRRNALGPGLSPELGPLPALRVLDLSGNALEALPPGKAWAPPSRRAFRSCRASTSAANRLRELARPTWRAAPRALQSLKLTGQLPRTPFPPSSFAPAALPLLSELADVNNASENSAPNRPTGLAQDVGPLEQPAERDPLQSLRDCPKLKEITFPWGTRLRDKRLEKMVSGADQIILEVPARREAVVVGRGKARPRGSETRKKSREERGGRRKHRREGCACRGAVIWRSGRVCQGLHVSKTRNYDSQSEPEVREFGLNSGACEDTDRNPQRSTGTVTDFKRVTSTDANRIRKKSANTRE

SEQ ID NO: 1021993 - protein, 182 aa, Homo sapiens
MAQGVLEYKDTYGDDPVSNQNIQYFLDRFYLSRISIRMLINQHTLIFDGSTNPAHPKTHLAASDPNCNVSEVAKDAYDMAKLLCDKYYMARPPVEARGKDPKAGNPKLPQAPKRSQRAKPRKFHKWVYVPSHLYHMLFELFKNAIEGDLWKATESSLILPPIKVMVAMGEEDLSIKISDQGG

SEQ ID NO: 1021994 - protein, 166 aa, Homo sapiens
MAQGVLEYKDTYGDDPVSNQNIQYFLDRFYLSRISIRMLINQHTLIFDGSTNPAHPKTHLAASDPNCNVSEVAKDAYDMAKLLCDKYYMASPDLEIQEIDAAESKQSIHMVYVPSHLYHMLFELFKNAIEGDLWKATESSLILPPIKVMVAMGEEDLSIKISDQGG

SEQ ID NO: 1021995 - protein, 285 aa, Homo sapiens
VSREKTHPESSRCAGFYTTIMLSFCCPCMIEKVDSRGSEMPQLDSLQTLNAMLMLLYGQKELNGLPPQPYWCFYHCMRGCFHDGKLSEVEGSSGLAALLLPDLQCKFSHLLLAALHAAASAPLNSFLSRNIRTGPARPPPCAQPGPLTTWLLRPTLPTAAQHAPPTTLPLVAQAPCLTSMHTQAKQTPDPHNMPRTNNDQPKNHTHQEGQNQAERETKYHSTQNAHPRRQTIERHRSHTQTKQPPEHHNTQHTRPSYNKRHTNKPQQTHHMTHTRHTQQHHRQTT

SEQ ID NO: 1021996 - protein, 112 aa, Homo sapiens
VSREKTHPESSRCAGFYTTIMLSFCCPCMIEKVDSRGSEMPQLDSLQTLNAMLMLLYGQKELNGLPPQPYWCFYHCMRGCFHDGKLSEVEGSSGLADPSYSLTCSVSSRICC

SEQ ID NO: 1021997 - protein, 172 aa, Homo sapiens
DRAEEDMDEEAQAATCNHTVMALMASLDAEKAQGQKKVEELEGEITTLNHKLQDAVCRGGVTEKRKPGLKRENRGQEVLPQLPGLQLRCGAQLLMCAAGPQRSVAVRSQEAGTSVEGPSCSFRCEHSLDLIKFERVNGATRLAGEHGVAGEGPLSRSGGAMGQSWVWDTVGV

SEQ ID NO: 1021998 - protein, 258 aa, Homo sapiens
ARLFPFGSEAFGSSLFRARRPDPSRTRSSDPSVSAGLESRCLTRCSRLLLRGASSLPCPGALTSGFFPRALICAALCGVAQEVMHGWRVGGALGGGGVAWSCGGKRAGTARPPPARRAAQTMSPEEWTYLVVLLISIPIGFLFKKAGPGLKRWGAAAVGLGLTLFTCGPHTLHSLVTILGTWALIQAQPCSCHALALAWTFSYLLFFRALSLLGLPNPTPFSNAVQLLLTLKLVSLGSEVQDLHLAQRKEMASGLQQG

SEQ ID NO: 1021999 - protein, 232 aa, Homo sapiens
ARLFPFGSEAFGSSLFRARRPDPSRTRSSDPSVSAGLESRCLTRCSRLLLRGASSLPCPGALTSGFFPRALICAALCGVAQEVMHGWRVGGALGGGVRGLELRRQAGWDCSAASCPASSSGPGLKRWGAAAVGLGLTLFTCGPHTLHSLVTILGTWALIQAQPCSCHALALAWTFSYLLFFRALSLLGLPNPTPFSNAVQLLLTLKLVSLGSEVQDLHLAQRKEMASGIKQG

SEQ ID NO: 1022000 - protein, 209 aa, Homo sapiens
MSGAAHLWCQRAATADADARPWRRVSNMVQQVLECTLRHSVARSGPSRVRVLVVHNPCGSRWSWAAPGAPAVVALVLMLLKDASVQGSIRFLEDQVMMMGSARVADAAACSHRSAEVLNVLPPRPRLTPYPCHYAVREGFLDTLVVLHRAGARLDVRDAWGRLPVDLAEELGQSRCRTGTCRCWLRGAPEAVTIARNRCRGRVPSDIPD

SEQ ID NO: 1022001 - protein, 119 aa, Homo sapiens
AQYPKQYLQLRILPGRPQPIGMAQEFVNCKIQPGKVVVFIKPTCPYCRRAQEILSQLPIKQGLLELVDITATNHTNEIQDYLQQLTGARTVPRVFMGKDGIGGCSDLVSLQQSGELLTR

SEQ ID NO: 1022002 - protein, 441 aa, Homo sapiens
VRSLGRSCCVHLVCLLSNSLLVTPLLFCGLRLMLLLYSLFFRAVVVARRVGFVLAPGPSAGSAPGEKFLCRGPAPVKWFGARAAEELSREPAQRVGLRREAPPRAKSITKFFPLFFGAHTTKICVRPLCLILSLLLCVEDALFLPRCGAKPVLSVVPLSEVLRAIIGVLFFVSAHPPPTAHTEDGWERGWWERASPLGLKKATRPLVVAPGLVYALGVEPLGVFSTTKRMVPHAVAHIWRRAVLRDLHSVHSTSPRFCLEILVWRPPTLGVSHTGGALLTNSCPTPVSPTLCLGVPLWVWERATLGPHRVITQRESLLCVGHTVSGEPHPHPPQPPSCPERPLWGPPPLGGPPHSVWRPLNGELPHSVALLGVHTLVNAWVKGSGRGEGEEFSTERPAEKNIGLALSEEKEIIERRGLVVEISVEKEDRVKEKKGRGRKSN

SEQ ID NO: 1022003 - protein, 95 aa, Homo sapiens
MDPQDDSESLSGKSKNILLVITKPDVYKSPASDTYIDFGGSQDRRFIPASTTQQLLRNPKFKVKLSQTFKKTHRLQLYKKESAEEEVDKPVVKFR

SEQ ID NO: 1022004 - protein, 72 aa, Homo sapiens
RTAAIRVSGGCGRLVFLGYTVGGSEAGRRGATTGLRNHCDDGAGSDLKKMSGFRRGLEMLSNALDVGGKAQY

SEQ ID NO: 1022005 - protein, 169 aa, Homo sapiens
AVPEITMESAAACQGAWGPSDWKLHIGTLPPVPQGPRMPITSLACTAGIWRLPQSSSEKQAASLIDTSRWTASHLHGIARSGCGLAILVEMAMLYSIRPLQNDVTMGRDDEKMICSAECKAGSQGPPLWLADGLTGEAGPRGHIASIAQVAHRLSLSGYTIKGSCHRYQ

SEQ ID NO: 1022006 - protein, 69 aa, Homo sapiens
LLPGSQKRAKEENISCDNLVLEINSLKYDYTITLKEEMLVTEPRVSWSSPVQQYGFPCLTPSRFVCFRV

SEQ ID NO: 1022007 - protein, 30 aa, Homo sapiens
MPKHEFSVDMTCGGWLKLSPRGPKKLGGVS

SEQ ID NO: 1022008 - protein, 169 aa, Homo sapiens
MAVSGEAGAIKEEHVIIQAEFYLNPDQSGEFMFDFDGDEIFHVDMAKKETVWRLVGLWRFASFEAQRALANIAVDKANLEIMTKRSNYTPITNVPPEVTVLTNSPVELWEPNVLIWFMDTFTPPGVNVTWLRNAKPVTTGVPETAFPPREDHLFRKFHYLPFLPLTEAA

SEQ ID NO: 1022009 - protein, 37 aa, Homo sapiens
HFAQLVLCLFHCDAVNSKTALGVIDQAEMFTCLLDAG

SEQ ID NO: 1022010 - protein, 336 aa, Homo sapiens
MRCPRVRMVQVQGEVARPLVGWMCRVRMVQVWGEVARPLVSWMCGVRMVQVRGEVTRPSVIWMWHVLLVITEVGMCNQARPAASRPSRESDDILRPQITMPPCADRRAYSTIPTLPPRVLTLTLYTGGTHVHTTCTHGDIHLTHTRERQGCHWNAKKIEKDDIAQIQAHRHFAQHVAVPALQRQALVGGNEIRVQGQTIEDRPCDHDPMPGNASPETPTAAPPRSPLHANLARPGRGRNHIGTTTARTETTPQHHGYHEQNDTRPGHTDERDTHNDRPGGKGNPATQDEAHNPQRRRHTSTTRPPRHNTTGTRPHRNAPRPPATDHAHTSGPGHST

SEQ ID NO: 1022011 - protein, 57 aa, Homo sapiens
SLRVQHRGEEQLTANAAAALIPAMLGGNAELVCAPGCKPFPSHDATHSRSLGQTADT

SEQ ID NO: 1022012 - protein, 192 aa, Homo sapiens
MFLCSCVCARGFVYALVVCVWCRPPSLLGVPCGHSPFPDLCLLSSSLLESGSFQGLPGPLFIWGPWHRMSSFVVCHVAGDLHAAISPALVRRSPLVLLLWKHSHTLIIEEQNFFGSCNVQILMSKTLYSEATSLFIKLNPAKVLTGRLLVHSHLIFAPPQIEASCPPNTLLPPLLDPCREKTCPTVTFRTAF

SEQ ID NO: 1022013 - protein, 102 aa, Homo sapiens
MGERREPTWVPLVKTPVDTTAEMGAIIYKERSFCAREGTHLLRKAIFFPPRAHTSGHRRKNFSRESLYKGPTHGESKMSLYKHSVILPTSDDTSHTEKGDII

SEQ ID NO: 1022014 - protein, 73 aa, Homo sapiens
ELSELPYYLKLVWLPGSSLIEREEYGIGKKNVTETIELKVNLDEDTAFVLYGHLSSQSHHKLGIALLSVDTDA

SEQ ID NO: 1022015 - protein, 48 aa, Homo sapiens
TKQLDIKQRLTLLNSEHTLDLPPKPITIPELPELGTDDAGEEWAHAAF

SEQ ID NO: 1022016 - protein, 100 aa, Homo sapiens
CTIYAADKSPYHAQTSSCWELVEVYFFRKLKYTKKVQVVTFVQCCYMGIRELATEGLRAFPRSQGQLSHRSLWCMVHVCPCTALVVPAPAPFTALGYALT

SEQ ID NO: 1022017 - protein, 161 aa, Homo sapiens
MALAVSTVTKTRAARTTTSDGTRTARTTTVESSFVRRSENGSGSTMMQTKTFSSSSSSKEDGQHLRAGGPGQPMGRQPGGCFEKRLAEKKKELTEGAESAQELSLQARKAIDLSRWRTEGAGESPGGPRAAVQRYNRFRGPQRQQYQADAGWTGGRAKTRG

SEQ ID NO: 1022018 - protein, 40 aa, Homo sapiens
FHDGTGLYLIYLRRVSAVQQPSEGVGGGRCSEISAELIRY

SEQ ID NO: 1022019 - protein, 121 aa, Homo sapiens
MQNACKGCPVGGCSQLESNPFGEPRILCFTLKTRREVWLRNCLSKHKVDELTAFKSQENTFSLTFRDISGPFLGGLGPIAKNHRYSMSFLLGVRKLGEGIEFYNSNNLAVFLVCKYFYTIR

SEQ ID NO: 1022020 - protein, 535 aa, Homo sapiens
GAAVVEGASRSRSELPTRVLPAEGWWWERSGSGGAEPGPVGRVGAWAGVPGLADGWDGAAPVSCLRTRLAGLSCSKMIDKNLREGRRRRRLREGEVAAVVVLGSSVEEHQSVKAGMTDSSTRMGYSRGRHMPAVPGRVVYSNTIQSIMAILSKPCGNPADLTFARAPPELDERQARYLHWSCSRRVSKACSLMTCPASSGGSGLTMVLQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICILQVVHRHVHHPLPQARRTCFEEKESHPPRLPVTHSVFPLMLQQGANKYDEAAQLHLRVKFEDLKKLLTTPKEIYTHFTCAHRRHKNVQFVFDAVTDVIIKNNLKELRPLLRGSGAWRDGPPPTLYPPSPEDDGAQKITLPACSPDAFLLLSLFVSGPPVPSGPDVGDGVALGLPVEALPLLRMRYWLGPPFGAQSGLPLLALLTEWDC

SEQ ID NO: 1022021 - protein, 240 aa, Homo sapiens; identical to SEQ ID NO: 842924

SEQ ID NO: 1022022 - protein, 164 aa, Homo sapiens; identical to SEQ ID NO: 842925

SEQ ID NO: 1022023 - protein, 240 aa, Homo sapiens; identical to SEQ ID NO: 842924

SEQ ID NO: 1022024 - protein, 212 aa, Homo sapiens
MCRSRVGYVSRLVQKNSVEWQSSGRWTLTREGRVKVGVMRAAVCIASLVVHLIDPDNEVDDSCLSVIEYKANCQRSSVEPMLPSASHLCLERIKCMPVILEASNIILVVKSSVRGVQIPLQLLRGRGPTSHGMTAFVTQPVRVLTGAPSKSKILSEEPPVWSRVGMLCSDWKVGACWVLVSLPAEEVELRLRARRCLLPSVQMLIKDDSDTE

SEQ ID NO: 1022025 - protein, 223 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNTRTSASVGFHERRPLDVHGRGEELHSQDLGPQVPEPAVPRRIFQVNAPINCVCLHPNQAELIVGDQSGAIHIWDLKTDHNEQLDPLSPQVSITCAPTHPAASSLARLPLRTGKTAAVWNLRGGIGDEVTQVIPKTKIL

SEQ ID NO: 1022026 - protein, 254 aa, Homo sapiens
MNTSPGTVGSDPVILATAGYDHTVRFWQAHSGICTRTVQHQDSQVNALEVTPDRSMIAAAGICDPVISKSPELWWVDLRHSQAFRFSRVSRGYQHIRMYDLNSNNPNPIISYDGVNTRTSASVGFHERRPLDVHGRGEELHSQDLGPQVPEPAVPRRIFQVNAPINCVCLHPNQAELIVGDQSGAIHIWDLKTDHNEQLDPLSPQVSITCAPTHPAAQLPGQPAPSPGKTAAVWNLRGGFGDEVTQVIPKTKIL

SEQ ID NO: 1022027 - protein, 60 aa, Homo sapiens
DAVGPRGKHIRHVDGLSPMGTNIPPQKDAEHTESHMSCYVHMKLQRSSYDRSSQSPDSSS

SEQ ID NO: 1022028 - protein, 102 aa, Homo sapiens
NTKAAQKRREDRLELLKLSTFALIITPGDPHLVISSGCATRLFEALEVGAVPVVLGEQVQLPYQDMLQWSEAALVVPKPRVTEVHFLLRSLSDSDLLAPLLC

SEQ ID NO: 1022029 - protein, 60 aa, Homo sapiens
EWNTGVEKRRLVDREIYSKAPFASNISQHSVNPKQICFMIDLPNIGTHLTSSSQSIRNTD

SEQ ID NO: 1022030 - protein, 377 aa, Homo sapiens
MAGMMKGIRWSCPCHRLHQPDEVLTGEGTALPHPGISGGHAPDVGRPPGCRCVPIGPGSRRAQKVSPLPFLGAVLGPFPPFMAGPEGTTHEPPHESTRSALCSWRRHSRVESWSQPQPGTPRWSRVVSALNRIQGPGLILLGSPITAGLIFPKTHFVWEGVGPRCSAAGAARSGTASGGNKWRPPLMYLYGFSPMALADTQPSTSFLQTRQSPHLFLTFQQLPQPKAGSQRPCLYKSVLRAQFQFRYQTRTGTSPKGTSPGLPSPPKPARQLTQQPTHMANTQHTTPHLHQHCTTDAEPATSRNQHTPHGEAARKTTETQGENPPRNGPRHMAPPGQSRLTPAPRPQRAHPHSPAPRAPTCAHTQRGVNTGTPTEYT

SEQ ID NO: 1022031 - protein, 83 aa, Homo sapiens
ECGGGWHGAPMLPPAWHAFLKDHRISTFKNCAFLEWLLPAALERMAEAGFIHCPTENEPDLCPVLSSCFMELEGWEPDDDPIE

SEQ ID NO: 1022032 - protein, 167 aa, Homo sapiens
MADGGRRRGELALVGGGGTSQASAVGSDWRYCGPAGVLVAPFNPASLPSLATLQLIALIVEHAQEPGAYFDSFRRDCLADVDTKPAYQNLRQKVDNLVSTHLDKQEWNPTMNKNQLRNGLRQSVVQSGMLEAGRRQDYFSVWWIQNVKHIFRPQIERAIQEYLRGPE

SEQ ID NO: 1022033 - protein, 154 aa, Homo sapiens
ENFECGGGSSRRRGRWYGPGGPSARGSRGGELRRALKCEEEEDSCCRSSGQGIVLDAPASGRGRPLSTFPPAPPSTPGLSCESLERRTEVGLKVRNKGVVIPCLTSLRFPVSFSNFGWPKGSGRWSPELARALRRVQATLIWRLADVPGFQWRP

SEQ ID NO: 1022034 - protein, 66 aa, Homo sapiens
ENFECGGGSSRRRGRWYGPGGPSARGSRGGELRRALKCEEEEDSCCRSSGQAKDGQGKMPEKVLSR

SEQ ID NO: 1022035 - protein, 128 aa, Homo sapiens
MPPSLYGATSSGRWILAPPRRQEQEEIQKGWEPNLSSVQFTPSRSKAWWVSRHCQGPLRTAESLEWRPGHVWCEKLGLDPTVVGSRAARQAWWTLLAANKEMTAAWLLSALRVCVCLFGPWWLGLVGI

SEQ ID NO: 1022036 - protein, 61 aa, Homo sapiens
NLYSLRTPGSSFSFVSDFLVSFRASSFFFLASSRLLSSVLRSSLVFSDESLYRVSPKAPVY

SEQ ID NO: 1022037 - protein, 121 aa, Homo sapiens
MTISDAGCDPEKRLASSDVLSQRSQLSGASLAEAMSLTSCASLHPHAIIQGTDCGYVAAVVFNHALIHIHEYWIVCSKKSLHALKTLLSTSFLTYFVSSIYQQLAATTFPLVIYPLSSWKY

SEQ ID NO: 1022038 - protein, 147 aa, Homo sapiens
MAARKNMLLAAQHTVSRIHTNFSAKTGHPMGPAGSPRVLETNIQNCLSRFHALITQSGLASQAICAAVSALQNYIKEALIVIDKSYMNPGDQSPADSNHRTLVTNGDNTLGELRIVNEEEVRRVGKEQDCYKSFSTATDWEPLLAWG

SEQ ID NO: 1022039 - protein, 148 aa, Homo sapiens
KLVEPGLNRRGLLGIAICCCCCCRRKRSRKPDRSEEKAMREREEEADTEEERRAEMKTRMMNSEKNMACLKKKTRMLDLKTTKALQHISPDASCEVHAPQPMPQPGMNQRCAFAVSLNSLAQVKRCQPSMDRRAEKLPLKDSPLVLQT

SEQ ID NO: 1022040 - protein, 41 aa, Homo sapiens
MNCNKWIFGRVTNRKLSCAITGNIDFNSCTTVTNFISARQK

SEQ ID NO: 1022041 - protein, 90 aa, Homo sapiens
EEQFGGDGGGGSGNGGGRRLGGRAGGSHGGGDTGGSAESEGAKIDASKNEEDEGHSNSSPGHSEAATGTVGKMWKVSIGGLSWDNYKRKI

SEQ ID NO: 1022042 - protein, 113 aa, Homo sapiens
GGAVRRGRGGGSGNGGGRRLGGRAGGSHGGGDTGGSGGGGKRSRDRGRNRVWRHRRGQRPSRRGRRLTPVRTRRMKAIQNSSPGHSEAATGTVGKMWKVFIGGLSWDNYKRKI

SEQ ID NO: 1022043 - protein, 73 aa, Homo sapiens
FRTHQCFITKDDCAAGGGYNVKNYGFPQGEAQNYATLTFSVMHDAKKITGFHSTVKGLEEQAIILRKEAESRG

SEQ ID NO: 1022044 - protein, 105 aa, Homo sapiens
MALQLPVNDEVIKVNDMKVRKSSTQEEIKKRKKAVLFWFKRDKRQIYERKQSRSVVGDIGDTVEDPYTSFVKLLPLNDGRYAWYDATYETKESKKEDLVIYILGS

SEQ ID NO: 1022045 - protein, 136 aa, Homo sapiens
PGYTAPPPPPPPPPAYNYGSYGGYNGRPPIPQRHPATGEQTYPQASYNQGSADDAQQRNQYYQNQGQWPPYYGNYDYGSYSGNTAGWHKYTVSQCDPEAPGGPMTEIPPRRRHDSATSSAPRPDPVVHGDGGHPRD

SEQ ID NO: 1022046 - protein, 134 aa, Homo sapiens
FLRKCGTQRRSCSRAGLGLGSMSLRVGARAKRNPWASGDPGGPDQCSLVVGGDAWAHHVAGRVLYSAWCVACWTPGLVRLGMDMRVLGPWPYEDGLLEAQEQVGEGLVSPVAPELCMAKAPGPGRVTGPGYQPA

SEQ ID NO: 1022047 - protein, 205 aa, Homo sapiens
MNGQQGGKNELGEQFENLKIQNECPEGGYMTLDLYMKGYRNRRTRKQQEYRGTVQIQKHGQRLYIEDETNSLMRFLDQQDLLERHDGDTDLERELREFTEVNLKKVGFLKRQGGMDKNCVWSYEIQNSFPAELLAGAGKLEAPEGHVCNGLNRAWRMKNKDVTGCLGKPVGPTMPWGCVDPSGAWEPHQGANGMFCKLAVQGQDR

SEQ ID NO: 1022048 - protein, 205 aa, Homo sapiens; identical to SEQ ID NO: 1022047

SEQ ID NO: 1022049 - protein, 119 aa, Homo sapiens
MKFTAYLEAAGIHNPLNKIYITTKRLPYPIVNFLLIAQLPKLQYNKNLGMVCRKPTDPVIGQFICSTVEQCTSQKIPEIPADVVGALLLEDYVRYTKLPRRVAEAHVPNFIFDEFRTVL

SEQ ID NO: 1022050 - protein, 110 aa, Homo sapiens
MCAKKLQNATAKFWGKWVCPAITRPEPGFEWATPTLVPGDMLHILLERQCPSSRVYTRSQFSGATGLGPVESASTGGSPQCNTVHEDISREKFLARDVCGCPFLFPGEEI

SEQ ID NO: 1022051 - protein, 121 aa, Homo sapiens
GDSPELQRTGSVQSSSAFSNPAVEGRSLFGEGQEEVLHLGGSDSDASSQLLLVGRLSLASKLAPPLHDGTGVPGPRLALVQNRVLAAEKLTLCRAVTVGNGLSCWKACSPGFTEFPRLAMS

SEQ ID NO: 1022052 - protein, 132 aa, Homo sapiens
EADEVPVGRVQEVVDTYGSSILSILLEEVSPELVCSMLHLCSGTRLPALTVQRDSAKGRWLLRYVCKKLVGYLDRNLEKKQQPSRRSWLLLRRGCSFLADPYQKQCDQFVAEYEPVLIEILVEGDGSFLRCA

SEQ ID NO: 1022053 - protein, 127 aa, Homo sapiens
CLISCLDHLLSDLSCCLIYLLEEVSPELVCSMLHLCSGTRLPALTVQRDSAKGRWLLRYVCKKLVGYLDRNLEKKQQPSRRSWLLLRRGCSFLADPYQKQCDQFVAEYEPVLIEILVEGDGSFLRCA

SEQ ID NO: 1022054 - protein, 208 aa, Homo sapiens
RGMNGVRKEGTALLPPLPAPPPAQQGKAKAKAAREIHAVKQVQIDGLVVIKDNQTLSGKKDKATEAAPRSALGVWLVERSAFETYQLLLLSLSTQRMMLTLMKLQVSDWKMMREPFAMLDIDHLHVGVGSSPQYYGSVRLPGSSLDSQFSYQRCQFGRNMSVLIYDPSKELAKDISHLKEYRLSPKSDGKFVEKKDFSPEALKQAHIT

SEQ ID NO: 1022055 - protein, 230 aa, Homo sapiens
MAKCVVVTRWPSQAVMWPGRHGRLADSCIMTRPHVYITGRHLDTLRVVAQEAQSLGGQCVPVVCDSSQESEVRSLFEQVDREQQGRLDVLVNNAYAGVQTILNTRNKAFWETPASMWDDINNVGLRGHYFCSVYGARLMVPAGQGLIVVISSPGSLQYTVQCPLWCGQKLRVTSWLLTGAHELRRHGVSCVSLWPGIVQTELLKEHMAKEEVLQDPGVEAVQIQLLICGN

SEQ ID NO: 1022056 - protein, 75 aa, Homo sapiens
DRARTALCADARMYGVLPWNAFPGKVCGSNLLSICKTAEFQMTFHLFIAAFVGAAATLGFPCSFIDCCLTIFAVL

SEQ ID NO: 1022057 - protein, 329 aa, Homo sapiens
MSLKLQASNVTNKNDPKSINSRVFIGNLNTALVKKSDVETIFSKYGRVVRLFCAQGAMPLLHATPNEPPCPGQHVPGEINGAGLLARGKTLDINMAGEPNSLTMNLKGLKKRAAICHIHGSSDYRGPSDRPCPVPMAVPVKRPRVTCLLWSGVSKLNVPCLSLFARSYTICSPERTLMTYRINVIMTHDDAEQCRIKTVSLTTDQVQAIRCPAEPLGADLLLETYGQSLWLEEPVMEVAPDGCAAAVVGGSALSDCTGGAVAVVAALLQPPRRLHLMLPVSWGELDPILTGLEGPDHVPESCLTVPTPSGLSNRLKVGPRKGGPLWGTR

SEQ ID NO: 1022058 - protein, 206 aa, Homo sapiens
AQVQQRIDYANLTGISVSSLSDSLLCFMYSVRTISKREMWCCRGDHVIDDADQDSPQCRNRVNSININQGSITFAVGPGQGLAPLDFTPGSELLITKAKNGHLAVGRPTAEFSVIKAPTWTLPNAQMLLLFSSSPCPVTKDSNFQRGTQGHPEAHSRISQLLAIPLLREHAGARSYPRSGPGGHQSIRKARPERAIAKRYCRCPTI

SEQ ID NO: 1022059 - protein, 154 aa, Homo sapiens
MCNICLDTAKDAVISLCGHLFCGRVYISGWRPDLTDRCVLFAKLASAETRSSPSMEGADTGQQDPREKTPPRPQGQRGRAGGIEGDSRIGFGDGGFQMSFEFGAFPFEIFAQHLIYMMGGSSSLSLETQYVTSSPVTLFYLWPVIMSGSDAKGG

SEQ ID NO: 1022060 - protein, 224 aa, Homo sapiens
MPLHKYPVWLWKRLQLREGICSRLPGHYLRSLEEELEAHIPLHYRPHGAEGSQDPIHKRRAAEERVEGHGPIPILLYHPESQRWSCGGGEGVCILGRNIMPTKENVSPERRERTVWTAISCVSESSSSEDPGARSSQVTVRQCGPLEPHRWRLTVRSRTCYIATRATKEEPRGSRVVWTGPESRRGCWLVSALARQGTPEIGTPGRNPGAGRVRHSTSKLQGTL

SEQ ID NO: 1022061 - protein, 170 aa, Homo sapiens
MPLHKYPVWLWKRLQLREGICSRLPGHYLRSLEEELEAHIPLHYRPHGAEGSQDPIHKNGQRKSVWKDMALFPSYFTTPNPRQGVVGRQRITRKNCKRQKQEDEESVEDKMFKRFYSEILNKKYTVNTKRPLELIDETNGNIYKTPKRTLCSKFGMNLKRRMLLRLDRRT

SEQ ID NO: 1022062 - protein, 287 aa, Homo sapiens
MRCRGSQNARMGWHTLGVTLSTRSYGVNLLKAPETFGVKLFSLGAKMGLQLSRKCVFPRDVSFVATFVWVTAHKCDRPAWEDSLGFQLPQVIYSLDPSKAHIKRPGLLPPLVIGVAAPASTMCNAQVLLKTEGKELISPVFGEKARKMGPKISLKVLVDSSPHCLNIWFLGKAHMCVEEAFSTSYIHPLGRLCCFAEYMRPRPRFACGCSHHKARWNTRKACWRAWQRSPTSLAHERLTKGYNEILFPKYLPPPPFLNHVGGENRFSRELVWFHNWPHLSLVVKELG

SEQ ID NO: 1022063 - protein, 55 aa, Homo sapiens
ARFISDFIVNQNLPTFLDGLHSRPEQIHVELFKFGPSQCLRKVFSFIEVTQFQFL

SEQ ID NO: 1022064 - protein, 99 aa, Homo sapiens
DYIRSVGSDSAHHTEVVTEEPENVIETIASLLGSVTLDLSQYGMGIVKGLAWSPEIRQPRLMDEAVLERRNLVRQCSDSSAMVSLTKHLFAILGGVGSM

SEQ ID NO: 1022065 - protein, 176 aa, Homo sapiens
MGCAWFSASHRALRLRWVSANGRLCRRFPATSSTCSSVVWASSGGRTARRLSLKERTLSATQPPISGGSASRWFRSTLRLVSLVSFPRERGRAWPRRGGQRTLGACRGWEGDDSPWQEGTDTPGQLQPGSLTAPGDRDKDLTTEAVSTPLRALCSPSSAHYPQPSVPTTKTPHAHP

SEQ ID NO: 1022066 - protein, 233 aa, Homo sapiens
MAKPSVSTERGQGAGRKRGGGAAPYMNISTYRPVRKLDPKIAVAGQNCYNSDYWGFTGEISSWHDKRLRSHVGGFLGHSERRHVFGESDELIAAESDPCSGTGDLGGVIACIGEKLDEREAGITEKVVFEQTKVIADNVKDWSKVVLAYEPVWAIGTGKTETPQQAQEVHEKLRGWLKSNVSDAVAQSNRIIFGGPVTGGTFKELGSQPDVDGFLVGGGSLKPEFVDIINAKQ

SEQ ID NO: 1022067 - protein, 89 aa, Homo sapiens
CSQRITEGAAINVYHWNKESKGIMIKRRLQPAGGPMGQLGFTLDAAVVPPQFYHPTSSFTNMQVLSFPASQIDRQMGKAGAAYTWYSSS

SEQ ID NO: 1022068 - protein, 227 aa, Homo sapiens
SALVPRLLGPPSSHGSGVRLTQPDREASGSGGRRRSSSKSPKPSKSARSPGAAVLARLFALGPGTVNGLTHQLGGLKPMAPENQSYRSRSRRVLESGPLRPGHPLSFLPPRQVYNGRYCGPPYGSDKPWPSLLDKEREESCGKKRLGERERMWRIGELLKYGDFLQRILNQILLNLHHVEDEEPRKALLQGLLQKEDKPGRSLGGSKRKGPEKGERNKSFDGSHKSF

SEQ ID NO: 1022069 - protein, 107 aa, Homo sapiens
PTSQRPVRPGMPSAGAGPRPWKRPGELARGGLGAGRSRGGGAVDPFMDESIVGNTFFSPCGVGGPQVRVLRQPDGLDKVFKNPFPPGDPCPRREIPNDLQSWGVILV

SEQ ID NO: 1022070 - protein, 159 aa, Homo sapiens
DRWAACVMVRPLLGCSELRGAALCARVAPGPSLTSAAHWRREVRLTATTREPGTHVWTGEAPMAVQTVGSLGDVIQRFEMRCFTLVGMKMLQAPESALAQRHYQRYLRERKPFISLALIRLHESHGPVVAMVWEGYNVVRAFEGHDVDTPTRLRLPQEP

SEQ ID NO: 1022071 - protein, 208 aa, Homo sapiens
DRWAACVMVRPLLGCSELRGAALCARVAPGPSLLVQPLAREVRLTATTREPGTHVWTGERSDGCATVGSLGDVIQRFEMRCFTLVGMKMLQAPESALAQRHYQRYLRERKPFISLALIRLHESHGPVVAMVWEGYNVVRASRAMIGHTDSAEAAPGTIRGDFSVHISRNVIHASDSVEGAQREIQLWFQSSELVSWADGGQHSSIHPA

SEQ ID NO: 1022072 - protein, 237 aa, Homo sapiens
GWSGWGAQTQVSGTQALLQVIVREHGLAAGQAELGPLLARGAGRLRRAPRLVPVLACGGAPEPGPSAAAAGRCLPAPWPGWHGAEPLGWGTARRSRGGPWGGDMGLAGGAWLGLAGAWPPAALRPIVAAVREDVCLKTFGGPGATSAGEAGSEDGWNELAHRLQAAFMAPALLTDLGEACERDGRGDLKTQDWRLLISWSTPGAPGFCHVSGHSVDGWRPTISVGPFGESTRTEVAG

SEQ ID NO: 1022073 - protein, 45 aa, Homo sapiens
FDWWLQEQWEVNSQEAGQRFPVDPDGPRRLLGQWLVGKVRQGPQR

SEQ ID NO: 1022074 - protein, 281 aa, Homo sapiens
FGPEKWIAACAAWNVRVKKAVGCADSPPLETLSFLVMKRLSEVVEFDPWSCRTKMPWPSEMEDVRLCMEEEEEDVATEDGLGSMNPSEWGGLARMDGPLTIAEVTFCIALSICVFVVSLDPKINTLCMLTGGEDDKAFVWLCSAMAELLFECAGHKDSVTCAGFSHDSTLVATGDMSGLLKVWQVDTKEEVWSFDSGRPGVDGVASSGTCPVGWAQLTGNTLDVEMSRMVTGRTYRVPTAQTLVAESSLMGKRAVVGYDRWDHQDLGTCMQGRPSQCTDTG

SEQ ID NO: 1022075 - protein, 264 aa, Homo sapiens
GQSTNTFISKRSKCSRGKRGAPPSPQRLSSAPSQGAGQQGTRGPQGWQAGCGIQTKVIRCPGSIDRARHCEPPHYSLQEPPWNVGAGVKPRDYTGLLVPQKKPDTFGPLENQFSGAGANYHIVAWSSWRLQDVSCPLGLLERRAPGTFLAVSREWLTFTFFFLHQIPPFIRAVPEAGGKGQDSPAGLRARSIGGTPIHSPSLSPNPPRYAAEMYSAETRGPWAVLTGTWICTHKKVMSRGHRGGVAGGWRLGMGRPWLPVAAVS

SEQ ID NO: 1022076 - protein, 317 aa, Homo sapiens
VLASGYSHSVCVFSPDGLAGCVWSRFLPQSVWWLFVPRAPALGPGICAGVRCVARCAQITLRGPRRRISCPGMSPSSAQLSGPVYVACGLPIGPLSLLGFVMPLGDLGASGFRPCWEGTKGASAACGVCMPDGNRFLLQDARKDAELPVAGISGSSGYAPVVPWVEEVTPHRRACYFDSGPDRAVPKVNGSTDAAGCSSVWGHRTGLAIDGKAGAPVEFFWPHERTAPHGVSLHPSLPFLATLPPVTRVFPEAPTRKWGRRKRTWAFPCSPPRHRPHLEMSASASGGVGGPQTPRIPDDHQGEKGQGGTEGGVGELI

SEQ ID NO: 1022077 - protein, 96 aa, Homo sapiens
MTGSCGSQAKPNGKKPAAEERKAYLEAWAHQGQDHRLPDSRSWWCCPDEIDLNEWLASNTTTFFHHINLQYSTISEFCTGEPCQTMAVCNTTVLLV

SEQ ID NO: 1022078 - protein, 47 aa, Homo sapiens
DKLFSCYTSHIHTFPCLPVDIFTVLCSSEYPNFLAASVSFSSIFLQE

SEQ ID NO: 1022079 - protein, 89 aa, Homo sapiens
MLCISLCLDNKEVNHKYHYNGRRIGESKKLNVGTLIEITTEEFQSNCCQLSCQGSSFNSGAHVFPGLNGEHKTEQHQFQGILTMGSSSS

SEQ ID NO: 1022080 - protein, 270 aa, Homo sapiens
GSGARSDLYPPCSFALQLVDGLATMPWSVLLCSAEPQARVPAWAAGGPDMTPPLNDDASVLPPMPEKCDQWWLNALWLDDGLCDEMTLYYLGMFIKEEAHPAPTWTSSLKSILNSGLPNRDQTDDQVTIDSALATQKYSVAVKCATITPDEARVEEFKLEKIVSTQSQLELFRNSPVGVTCLYREAPSSCKNIARPISPGWYPKPITIGEAPAHGRTSTRPQDFGGGQDGTFKSGLHRKKIASGVMGVGCVKLSLERGEGIWISQRGVIY

SEQ ID NO: 1022081 - protein, 148 aa, Homo sapiens
MQGYICVYVCGFFRKVNCGFEIYFKYCVETLDKCVENVCELDCDFPCKTKGSQIFCAEMVMGGMVRGDKYDEMCYTKLVTKISGKIWGWLSTELQTVCITGEEFDLRRIQKFYLAASIKGQLALLINVKGPPVIGGEIKYTGVSKRGG

SEQ ID NO: 1022082 - protein, 117 aa, Homo sapiens
RAQDMELITNVTEYEKLAKEKLPKMVYDYYASGAEDQWTLMENREAFSKILFRPRILMDVSHIDMATKRLGYNITAHIESALSPVQKRAHPDGELATEKSNPLCENNRDIVLRVYFQ

SEQ ID NO: 1022083 - protein, 128 aa, Homo sapiens
CRDSSESRYCNMLLEDLRCNLDHFLENVHSPLLLEMPAHFFDATGIPLRPWPFSNVHGNHFVQCAETAVTVSSDMALPCSVVLLFPPGSLWTRSRMAYLPMSSLFLTSKAMFRSAVATEHNTRSLSIT

SEQ ID NO: 1022084 - protein, 226 aa, Homo sapiens
MRDEDYEGDMEEEVRGGTKRVCSGPGGMSMVQLGQHGLCVGGGGRWRNDLDYYLGDMEEEDLRGEDEEDEEEVLEEVEEEDLDPVSPLTHGSSALERCFTLSLSAVLELFARLEMSRPNLQLANMVQVIRQDCIPIPLVAAEPEVEAIQGICPKPPYEALKALTVEVDEEAHSDVVDRRIQEPQRATALDDHMEAGRSKSHTRTKLQGSSVEDTEADNWRTDAERM

SEQ ID NO: 1022085 - protein, 171 aa, Homo sapiens
MALYTAGIGLEGGTPKKTDTQTAPPSRAGRAAFWGLVNTGWGGAEEPDRRLRPGAWRGQRQPRRPPRSPEAPVGVASQVGGRRGLSASHSFQGPWRRKPRAAPKAGGGCTVGELCRYFSWHSGAHLAGWCVSGLRTRAPGEVTVAREILGVEHSHEKAEIWAAGEKGGMVQ

SEQ ID NO: 1022086 - protein, 198 aa, Homo sapiens
TSPQANLSAFPRGAALLLRLRLLLCSATGFLLLSSQPARRAAPEMETLSPGVADKVMMNPGYDLDFILCIPNHYAEDFGKGCLFLTGPNYGPGLNVCARDVMKDDGRPYYISSPSDVLKGGYKVLLLDLLDYIKAAGIDRYVIDPVPMTVTLDLDLKSYGNGPVNQRDSNKYSVADDLSSFNVEENVLIVEDILDTGI

SEQ ID NO: 1022087 - protein, 313 aa, Homo sapiens
AERAGSCVLLGLSCLSRFCPRALHPGPGARWRSPRSHRADWSCCPGPRSAWCSSRGAIPASAAMTDSPLRGDSSSAVAAETDERLAPGRGTVRLGSVAWPFRWDAADHLLLPLRTWFLGPRKLAGWALREGWHAPGGVLLAAWLAGDCVGLGGLLGCFMANQCRFVTGLRVRRAAHRSAQLYRTPLLRELTPRSPRPLWRRLHGRPGHASALMAGLAGRLRKGRGEDPRQEELQSILLIGERQRLEQIVHIMFRALRVQHNPSEQKANKKGMKIHDGPEANVEIVMASTTFSWAAPITGPPSIPSWTYSFNPR

SEQ ID NO: 1022088 - protein, 54 aa, Homo sapiens
SPSDCRRSLLLHHTERSKSADDGLNTFRTSLLELTKQICSFLQTAPEQFPIRSK

SEQ ID NO: 1022089 - protein, 57 aa, Homo sapiens
VLRQDLFYQGNSQTVREWLNVAITRTLHQAEESLLELTKQICSFLQTAPEQFPIRSK

SEQ ID NO: 1022090 - protein, 142 aa, Homo sapiens
RPAMTVILETIYDATLDAEEIVICFAVELVLDCHPTRTWRRGARSGFFVLVDIIAFTWGRGDDDLDGLCLGGVLDFTLGGEDPEQLCLEGVLDFKSGSGDDSEQLRLCGVTDCSLAWGLVMDPVPRWCARLARLRMTGDELE

SEQ ID NO: 1022091 - protein, 58 aa, Homo sapiens
RGVEAGTVYLAEKPALDSYHLCHSKGHVWNDDFVAANLAELRGAVGYPRPPHLYRHNL

SEQ ID NO: 1022092 - protein, 158 aa, Homo sapiens
GFFSVFWHVCGPVCSSAFLEDLERTDGSAERPYFMSSTLKKILNKTNKKAAEVRDRAASALPRVSTEVVQCSHGVASMYARARCSRAYTSVEAHLKSYHVPLCTRPHVARSQQFLDVERSGASPSYAKGRCGVFMAAHPDCEKQVKTHWGLLMSGMAA

SEQ ID NO: 1022093 - protein, 215 aa, Homo sapiens
MGWRELACVRESHSVVWACKVRGGTAPSPSGAEGHIMSDTKSRGSGSRQGVEAVQRCGMPSVFSPRGCTRETRVNLLCALMEWYQSDRLDYLVYKSERVHNWEEDLGGHEPFTGLNKHRVGLLSEVYRNDVFKTPRVVPGAESLFEWRRRTGLKEACEARFCLRVLATSLVAAERYCHATSALSGIMVPGVRKEWLTAGGWMCPSNVIVFHFWQG

SEQ ID NO: 1022094 - protein, 169 aa, Homo sapiens
MKFWPKPALAVAHTFFTEPVGNKVCTFSKKKKQQNDSKKDKRKRRKNKKEGGARQIKDNPQEGEPTILQQTANFVRKGGRQKGGAIYKRAATARVIKHRRGGGENTATRDTYGEQDQHTGGGTKWEEQPPTQEYKPPRGKHNTRQMHGAQTTATYLVRRKKAHTDYEQL

SEQ ID NO: 1022095 - protein, 136 aa, Homo sapiens
GEITALWAGRGQELPSGFWSPACGELTPAAVNNADPRGSNSESSLWCASGICDSLLYSHGRHTRDQVTSETMSLSPSQGRHGIPGSGNSSCLLVTPGRQRPPLGRSDGQLASGRPRGKPKTKGANEKSLHWSPAYR

SEQ ID NO: 1022096 - protein, 367 aa, Homo sapiens
MFLVNSFLKGGGGGGGGGGGLGGGLGNVLGGLISGAWGRRRLAAGGGGGGGGGWWRWNGHAHPRRSHQRHQRGTGRARGTDSVMPPCCTRQTITSESSWGLDGDVREGRGEFRDDRRFVPMRGHVTMTMAGPDAEQERQLRPFSSEYSVDASQRDPDLKTDGFGIDTCRSMVAVMDSDTTGKLGFEEFKYLWKQASKGGRPLYKQFDTDRSGTICSSELPGAFEAAGFHLNEHLYNNDHPMLLRMKSGNMDFDKLHQLVGPGLDDHVPVPFKSLEKDGTGQIQVNIQEWLQADYVFLNWSPRPAPHRLAIGVTWSLGLSQGRSCLQSHLLWGLLTHKLLFLLSTCYPSFSNIQGPNCALPWKFPPGL

SEQ ID NO: 1022097 - protein, 137 aa, Homo sapiens
MSILYNNDHPMLLRMKSGNMDFDKLHQLVGPGLDDHVPVPFKSLEKDGTGQIQVNIQEWLQADYVFLNWGPRPAPHRLAIGVTWSLGLSQGRSCLQSHLLWGLLTHKLLFLLSTCYPSFSNIQGPNCALPWKFPPGL

SEQ ID NO: 1022098 - protein, 123 aa, Homo sapiens
MFLVNSFLKGGGGGGGGGGGLGGGLGNVLGGLISGAWGRRRLAAGGGGGGGGGWWRWNGHAHPRRSHQRHQRGGCAVQRLEPPPPRTHYSNIEANESEEVRQVPETLLPSWLEMTWRSAPQNS

SEQ ID NO: 1022099 - protein, 72 aa, Homo sapiens
NEYKREKLKEKKLTPITYPPGSTHAKGDVVLVKYLECSALTQRGLKTVFDEAIRAVLCPPPVKKRKRKCLLL

SEQ ID NO: 1022100 - protein, 160 aa, Homo sapiens
MDFYQTTEGVPGSPAVSYALKTYFSMGITRPPEGEQGTSNYTFFSLDHKEISGKNSFKNSYSSASMCVTPNVSAFSSVMGELAQCRRLSVRVEKKPPTQKPVDPQTLTNNTDDSQQACKMAYFDCHFGSFSQKANTVTQPGNFPAFQPLECERVIGMSGS

SEQ ID NO: 1022101 - protein, 273 aa, Homo sapiens
MAVMAPRTLVLLLSGALALTQTWAGSHSMRYFYTSVSRPGRGEPRFIAVGYVDDTQFVRVLNRRTPLSQRMEPRAPWIEQEGPEYWDRNTRNVKAHSQTDRESLRIALRYYNQSEDGSHTIQRMYGCDVWGLDGRFLRGYQQDAYDGKDYIALNEDLRSWTAADMAAQITQRKWETAHEAEQWRAYLEGGCVEWLRRYMENGKETLAAHGRPQDAYDLTTLSLTMRPPLRVLGPLSFYHCGRITLDPGSGMGRTKTQDPGARWRPGLQEIGTF

SEQ ID NO: 1022102 - protein, 69 aa, Homo sapiens
PICAVRNADPNSMVNVMYTAPLDDDGYMNGRVMSVTSHLKWLLHEKVDTRGQSTKATGHHYWIDLHKYL

SEQ ID NO: 1022103 - protein, 276 aa, Homo sapiens
GIWVLQPPPEQENVQYAGLDFEAILLQPGSPPDKTQVPMVVMPTGGPDSSFVTERGCCSQHMSLQDGTLSVLLVNLYVAYHGLWAGQGSLSTPRSNVGAPRMVKDVQVLQWNRCVEEHFDASHVVPYGWFPWLAFICRDHVDRSCRPRDLARACVAPEARDQAYASMIGLHVSIPDWCVVEAWVSFAAVTALSDLSVWAEMLENIAASDTASGEDTTVTDVGPGRTVVCPSKQGMEYYRALKNRNVPVRLLLYPEATHALSEVEGGVRQLHECCAL

SEQ ID NO: 1022104 - protein, 236 aa, Homo sapiens
RSSSLLSQRSAAARPSSFPDMANLERTFIAIKPDGCSAAGGRDHQALRAEGIPASVAMKVPPWPLKNTLKQHYIDPEETGPFFPGLGECYMKLRAVLWPWSGKGLNVVKTMARVMLGETQSSRFKSQATIRWGLRAFSFGREQSIPWQLIHVQRVLNKEITPMVKRLKNVVDYKVWVLNDVGSYDLQKVAHNRQSPFSKALVCPLDKSSSIPFDLRGNRIDHSFYRAYLQIKLWEA

SEQ ID NO: 1022105 - protein, 303 aa, Homo sapiens
WLWTKPIARDFLHQPPFGETRFSLLSDSAFDCWAPVVAGGGVPAAAGVTRPHLEAFLCLAEARVEQLRREAGRIEAREIQQRVVRVYCCVTVGQYLTPLILTLNCTLLLKNAGKAIPGAWAPLLYYPPTHPQPRAAPIGSGEDEVQQYCSADFRGPGWPAYSPLPPWRPGLPHLVDGCLPAGRQPFRPLLPPELGRLLAACRPSWGPEVCSWGSGTLACPLCLRPRVPHCKVGPDSPAFPSPQCLTRGPPWTPSFCLSTVSPGPSSMSGPQAHCLRSVCARFEWRRVMLAVFLNQIKEHPPIF

SEQ ID NO: 1022106 - protein, 289 aa, Homo sapiens
MAPSRNGMVLKPHFHNGLACWLLWPLWFNHAWPCNDPADCNVPWQCQWLRLHLPLRPAVVVPSWPICAAAPLVLCTTLNGARLAAASALEELMGGLAFTNELVCPDTSGDFLCDPEECWNKSTDVPCMANVQLAEVSTDPKLILFPSECPRDPKKGRQVLACKNLKLATQLTWTGHALSGHVYTERSKARVNLLDGIAARTSPQPSLRSPTWPGDNDRVFGHTGAHTYTNGTAAANTDVFDPRTNDTAPFPRDPGMSTTTSQNNVEKLQYRESGTKRVYRLCTRRISVP

SEQ ID NO: 1022107 - protein, 128 aa, Homo sapiens
MEKSGHEIPHSRGWPRNSFPLSQGDISRERHAQSPGEMTLVGENPGRLRMPHMEIVAHKHSCGEKICGNPRATNSENWHHKLGHLSHKFEPPTLLLWRLFTLRDHHLSLENEATGEKPLTKRIVVNHR

SEQ ID NO: 1022108 - protein, 48 aa, Homo sapiens
IVQKITFIVQKITSTLKVQVSAVVVAVPVQFNVIQVGCMCNDISVLER

SEQ ID NO: 1022109 - protein, 74 aa, Homo sapiens
DLMHHSDVKQAIYLSLSCLAFSTIRESFIIIIWNSHLNDVQVFNTFMQSINTWVMNLFIQGGLFEEVLSFNTPV

SEQ ID NO: 1022110 - protein, 191 aa, Homo sapiens
AGSGSSSGQGKMGQSQSGGHGPGGGKKDDKDKKQATYEPPVPTRAGEKRSKTNQEGPDAASKLPLVTTHHSVPVSKFTASSEQELNKTYLLMDAKEHSIHEHPRNNMKPIQTEKAKQAGHRSKVDDLRGTPMSVGTLEEIIDDNHAIVSTSVGSEHYVSILSFVDKDLLEPGCIGSMIKHKVHAVIGVLMG

SEQ ID NO: 1022111 - protein, 258 aa, Homo sapiens
RPRLQSCRAGSLRAVCVRAAGAQLSQRTAHPFGAGRQGPCGRQAGSPGGTGTPEPNGGGGGKIDNTVEITPTSNGQRRDRSRRCSVPHCEPAVQACCGELLSADGGTGRLLGCATRLGQEGLVGWAVPPGPISSLEALIAQVGALGGCSSCELGLCCLPVLFVALGMASDPIFTLAAPAAIADYGGLPRLMPLCWEQLSHMPGGVSAFASCCPSSQLPDSRVATSTDPIVQTVSPLPYFNHCLKGLGPKLAYLVLNGR

SEQ ID NO: 1022112 - protein, 135 aa, Homo sapiens
MGLRACTKALTCLSGYYHLPTAYFGIYDPAKGMLPDPKHTHIVISLDDRPDCHCCCRVDFLSHVTLFAPALMIPSRAPKEPDIMYTRHRLTAGGRLPRDEGGQAFFRVPGPMFSEALGGAFVLVLYDENPKKYHH

SEQ ID NO: 1022113 - protein, 301 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQGDVHARVKYNLNSLSHDTATGLIQYALDQGVNVTQVFVDTVGMPETYQARLQQSFPGIEVTVKAKADALYPVVSAASICAKVAEDQAVKKWQFVEKLQDLDTDYGSGYPMIPDKSVVEGARWSPVFGFPQLGGSAGHGQTILEKEAEDVNG

SEQ ID NO: 1022114 - protein, 251 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSHMIQPLGLYSYALDQGVNVTQVFVDTVGMPETYQARLQQSFPGIEVTVKAKADALYPVVSAASICAKVAVDQAVKKWQFVEKLQDLDTDYGSGYPMIPDKSVVEGARWSPVFGFPQLGGSVGHGQTILEKEAEDVY

SEQ ID NO: 1022115 - protein, 252 aa, Homo sapiens
MDLSELERDNTGRCRLSSPVPAVCRKEPCVLGVDEAGRGPVLGPMVYAICYCPLPRLADLEALKVADSKTLLESERERLFAKMEDTDFVGWALDVLSPNLISTSMLGRVKYNLNSLSHDTATGLIQYALDQGVNVTQVFVDTVGMPETYQGDVHAGHGIGDKVSGSECDWDGWWLVLPASVPGWPGPGVKKWQFVEKLQDLDTDYGSGYPMIPDKSVVEGARWSPVFGFPQLGGSVGHGQTILEKEAEDVNG

SEQ ID NO: 1022116 - protein, 89 aa, Homo sapiens
RGSKDPKTAHTGTPGFASSITTTKTTSHSTPSFTSSIATSNTTSSSTPGFTSSIATTETTSRSTPGFTSSIVTTETTSPHTPGFTSSGR

SEQ ID NO: 1022117 - protein, 72 aa, Homo sapiens
GAVIIIFCHLLGKLQVLLFSLTPFLCRLQVLCCTILGGNLMALYRHVVGYTRQKEMRCVEGYLGALAVEYDV

SEQ ID NO: 1022118 - protein, 161 aa, Homo sapiens
MALLTAFSSSVAVTDKDTFELSTFLDSSKAPKYERNELPEQRGAGGGLDVPLSTRPGMGAEESLGLLDDSPWRVAKHLQTSWVLQRQRLRRAPPNGWRVDGCVSPSNNSKEDAFSGTDGCGDTWIEGVRLMDALSGIDDLETMPDDFLTTLDDTLCISLPP

SEQ ID NO: 1022119 - protein, 86 aa, Homo sapiens
QTVEPQATGQSRLGSHDCGGGDSVGSLAHGLTWQEVPLALELRQTDGRGYFGGHKEKTKEGLRSLQPLAPPTRAGTRSHTTRYRAR

SEQ ID NO: 1022120 - protein, 150 aa, Homo sapiens
RAAGTLPIFWKRIWLAGGATKVESLLLLFVSLWQRFCGTGTLKIAAMAENGDNEKMAALEAKICHQIEYYLWRLQFATEQVLYKEQIKLDEGWVPCGDNDKNSTRLNRLTTDFNVIVWKHLSNIQGQNIMEISEDKTKHQKVSKQTPYLK

SEQ ID NO: 1022121 - protein, 320 aa, Homo sapiens
RRLRSEGLVGPRADHQVFGLVGSYFSRLAIGDVAPVITCRVVFRERGHAAVPSYKTGSWDTCIANLRRKVARLWSPDDLAEGFQVDEFGAQWADCGRRRCKGSATVLRAPVLQLRSLPLSCAYENRLKYPVHVELENERPGRAVEIGYVQMMNWDRTGRKMDWAWEQCGSKDAMNAAIRAGPFKAQASMSPKKAPPGPAKEAKDMSVSRGVLVAVGTHDRDPSGDSHPWLQWFATEGERSWAKQQEEDSEEEEEDLDGDDWEDIDSDEELECEDTEAMDDVVEQDAEEEEAEEGPPLGAIPITDCLLFPSFQLADEDVAQ

SEQ ID NO: 1022122 - protein, 301 aa, Homo sapiens
RRLRSEGLVGPRADHQVFGLVGSYFSRLAIGDVAPVITCRVVFRERDMQRCPAITTGSWDTCIAILRRKVARLWSPDDLAEGFQETSSVRSGPLRQEEMRRARPPTAPFVRLTPITTSGVYVLEKKAVQAVNWKVEMNDNFEGLGVGACVGARSAMNAAIRAGPFKAQASMSPKKAPPGPAKEAKDMSVCRGVLVAVGPMSETRVEIGTPGSSGLQQQVKKLAKQQEEDSEEEEEDLDGDDWEDIDSDEELECEDTEAMDDVVEQDAEEEEAEEGPPLGAIPITDCLLFPSFQLADEDVAQ

SEQ ID NO: 1022123 - protein, 244 aa, Homo sapiens
FPALVLTVVGVGLSVGSCAFYLAVFGFSWLLAPPFLPCLQLGSVRSRGKLGFFLSPEEFNTNMDIRPIHTIYITIMNDKINKGRMEEILYMPCFLSWSCGGHGGLKTMKMRGQALVIFKELAHPQMPVRQLQGFPFYGKPMRIQYAKTDSDIISKMRGTLCDKDTDTERKKTKCGTRTGKQKKKLAGNSKFSNTQGNSNQISGPDYLQYILFLNTYRRDNGTLFPGGNQARSRSTLGRGLAWVA

SEQ ID NO: 1022124 - protein, 189 aa, Homo sapiens
HASRRLMETHLPCWEIQCPEQVVGGIYGVGNRKRGAVFEESQVAGTPMFVVKAYLPVATSRLWLHRCTVRSNYVCGMALPPAVVFMMQLARSCPCRSPFDNSYSAPVQVVAETRHERKGLKEGIPALDKLTLDKIVWRPSCKRAAAPGDSQSPAAPRPRILRRHLETVPTQRRSPERYSGGRVRAITQA

SEQ ID NO: 1022125 - protein, 74 aa, Homo sapiens
AAIVVYDITNEESFCKSKKFARFKELQQAASPNIVIAFIGKQGRPSTIKEQQISQEAQSYADDNSSHLFMETIR

SEQ ID NO: 1022126 - protein, 234 aa, Homo sapiens
GRRRPGRRLGHSNGSAVSRGTRADSRRRRRLRPPSSPGLRLSLLRAASPSPCPLPLALLLQKISNYTCTMLFENKEYVDLLMKQWNKLLGATNKEPLVMFGTTSKEQHGMTRFSDIYALCVAYPEPLGERLYTETKIFWENSCSGICHKKKFGVRKNKYLVMYSLGTGEEYKQGLQDLYGPANNRLSQQHQDYYNNDIILTRRRTLQYGYVVVDMNEPFMEEETSMDMWGNVVD

SEQ ID NO: 1022127 - protein, 150 aa, Homo sapiens
MTGPTWGRAPGYLLFPPPHSRPQERPLRASADPNSRGYDPKNRKSPLHTVLAARADLSCLVPSPQRGCPQRDLLCHQQGAYGQRFQTGGPAPMSWSLPMPTLEEPTERMEAPTVGVARRRRRSKGGLVVGGGGSSTEMLYAIGNLLGSPL

SEQ ID NO: 1022128 - protein, 199 aa, Homo sapiens
VPSKFSDAAFFAPRVLATPSSLLARCTPMGSLGGLCPQASEIRIRCRRCLLLKRLDLRYICCSPGVTGQRPQERPLRASADPNSRGYDPKNRKSPLHTVLAARADLSCLVPSPQRGCPQRDLLCHQQGAYGQRFQTGGPAPMSWSLPMPTLEEPTERMEAPTVGVARRRRRSKGGLVVGGGGSSTEMLYAIGNLLGSPL

SEQ ID NO: 1022129 - protein, 67 aa, Homo sapiens
ESRGHEDDVTNTKHEISEMNRMIQRLRAEIDNVKKQCANLQNAIADREQCGDVLALNIMPGNKAGAS

SEQ ID NO: 1022130 - protein, 253 aa, Homo sapiens
SKNYRLIYTRKQTREQEAAEDKTSLQAPVHSNVRGHLCEEENLVKFEQAASQDVPNISPDVNNSSKFFQVCNDEYAGELSPSVQYFPSFTCDSLEWLPFFGMRFHRSPDRAPTYTCRRSSQILSPKWLLIFGLEDKSSLVQTQRGQHNLLNHIHKTQCMYKGDTMSTEIFEKENTRELVAISFSSLFNLSTSKSVAAGSILVVDINSSPSEDNWLHGAQELDNRPFAIGNDDLELFFSDWMTGSQEQMTAESV

SEQ ID NO: 1022131 - protein, 182 aa, Homo sapiens
TASGGDYWRILNPGEYRVTAHAEGYTPSAKTCNVDYDIGATQCNFILARSNWKRIREIMAMNGNRPIHHRPIAPYDPPTATPAASDAYNNRLAASGTDPACGAFNATNNLGPQHLGLPTLPCPWTTLEALTIEALGAFIPANQPLAWEGSPEDFETYTEGGDRSFGNRGKPRGLGTKVGPGF

SEQ ID NO: 1022132 - protein, 70 aa, Homo sapiens
RHPPVVDITPSAQQRPNDPPWGGAHNNAEKERERTPLHKVAVPPHNIIRCLYLRLDDKPHHRYKNTGGKN

SEQ ID NO: 1022133 - protein, 70 aa, Homo sapiens
SPKVIFKISTEFLPVLRLCPESKLFVPVTTVSPVHLIHGHVLRRWFKGENPHNSREKLRETPARGEEIEK

SEQ ID NO: 1022134 - protein, 271 aa, Homo sapiens
QENWSHPALEGSAPLLEDAAHLFQDVTEALVLGRTAGQGELKLVEVGVHLAPGFLEPQEVRGTLVELHQQHHLVKDVIGQEAVLVGLHIHGDAIVTGPLLGRRHHPERRELGLGAWVARLVRGAEQGEAGLEAFLELCSRAGSPSVLLMFSSSMAAAVSAFPSRLRQGKALSVSFWLLTFQRPPRPTTSLRVRGLKFSRSTWLETATLNGWDLLAAKDVTSTRVWGFLAKRLPSMLRTGTRILLFTRPGVVASGWAGSEGLFPSCLRLLFS

SEQ ID NO: 1022135 - protein, 131 aa, Homo sapiens
MMAACRVILLEYLLPARRHRGGGPAATTSLPPLPRPRSLHPSLPPTSSRGGLVHRDTMSDSEEESQDRQAEESSCWVTGTIREDLLNYVFCSRTLLETTVQNKLYGLDFLYEKDNIGQENLECYRFKILAI

SEQ ID NO: 1022136 - protein, 312 aa, Homo sapiens
VIRELLSNQEKRDAFVFAIKNHYWYQMYIDDLPIWGIVGEADENGEDYYLWTYKKLEIGFNGNRMLYLINSVHRKGDPWFQILKIQMSYSSQTWQQSACALLTHRIRQISCIRPFFNHRPSLVFNFQLLHAWCIFLVGSSFHAFPLQNPITPQASCSVTSQEAATGCYGQQTSRDDSWLATGAWHMSFQTIKSHPCILFPSLMALGLSPLSPVSLHPFITGRTPTRHNLIYLSGDSHGSQPQPLTRHYARPPPPVHLLIPRRNSDSQNHRSRPRSTHTSLGHPHPTQAALACLPPIHPSSPPTTPPATPPPP

SEQ ID NO: 1022137 - protein, 144 aa, Homo sapiens
MKMVYIQCGVLVLGDLHIPHRVHQFCQLNSNNSWCLGKHSAHPLHQEYLGTKESDDYLKTLAGECPSVRGDFDAESEIIQRQKVVTVGTVSKCGLIPCTIKVIPWGDMASFSPVAERHFDVDISYLADTHTKFEAFEHENKFYH

SEQ ID NO: 1022138 - protein, 89 aa, Homo sapiens
SLRKRAATVVVTERSLVTGWLGTDGVLVLGDLHIPHRVHQFCQLNSNNSWCLGKHSAHPLHQEYLGTKESDDYLKTLAGECPSVRGDFE

SEQ ID NO: 1022139 - protein, 129 aa, Homo sapiens
SSAAWSRGKHLAVTEEPPRGDRVSITAKLLQQKKNVGKVLIVDWDIHHGNGTQQAFYNDPSVLYISVNSYDNGNFFPGSGAPEEVGGGPGVGYNVNVAWTGGVDPPIGDVEYLTAFRDSGDAHCPQVLT

SEQ ID NO: 1022140 - protein, 105 aa, Homo sapiens
IIKTHWAWGPDDGKSILELSCSHLEGQLQQAFYNDPSVLYISVNSYDNGNFFPGSGAPEEVGGGPGVGYNVNVAWTGGVDPPIGDVEYLTAFRDSGDAHCPQVLN

SEQ ID NO: 1022141 - protein, 169 aa, Homo sapiens
RASVPLPGSPGPSALNAEMFIENPHVPRASVPDGFLSELTPAAGPRPTRQAPPSTSRCTWSRTQLMAFGGSQRAVLRSASLHSIGQIGGAQNRSYSQLLCGLLAERLRISPDTVVYINYYDMNAANVGWNNSTFAYEPPGPPLSALAPPGNPPPPVFEAPPPPPSGGEK

SEQ ID NO: 1022142 - protein, 166 aa, Homo sapiens
HDHSSRGLAFVSGAVQGCCRGTDSFDFYKNGFLNLALLFLLGSLDPLAAPRHQYYIPRVDIVGIALRYKGLQPNGEEMTLTQFLDYFETEHKLEITLLSQGVSTLYSSFMPAAQLKERLDHQMTRDCDPVSKRKLGRHVRALVLELCSLRRDGEDSRFPMSDTPLR

SEQ ID NO: 1022143 - protein, 263 aa, Homo sapiens
MWTPECHPSLELVEPIKKYDVPGKSDVYCEVCEFLVKDSDLLIDKQLIDKDILVRFGHNVSRRLSKSLSEECQRCVDASGRHPSCSILPDRRSRACIWCASIAVASDSCTRLTALTVHVTQPKDGGFCEVCKKLVGYLDRNLEKNSTKQEILAALEEGCSFLPDPYQKQCDQFVAEYEPVLIEILVEVMDPSLRVLENWSLPLGHKPLLGTEKCIWGPSYWCQNTRDSSQWQMMSSIANAMCGTRRRNIPSGETQHWFFYLCV

SEQ ID NO: 1022144 - protein, 441 aa, Homo sapiens
RIASGRPEELWEAVVGAAERFARTGTELVLLTAAPPPPPRPPCTYTAHGRRALAEATRRYLHNIALAHKAATARPPAPPPTPQPPNPTPNPPRPTLAKKDNEEDDKPTKTKTSGEQLGINDNGLFLMDEDATLQNLPPFYKSNPENTNNGSLNETPAGPPTCSMPPTSTLPTQQYAKSLPVSVPVWGFKEKRTEALGHQMRRMGRPLRPTWTASRPSMRALVLREAECHPGVFWGPAERVRGLNHSATFQKLQVGQILKSTGGMRPWCRAPPRSHCYAAAPTSRGLLKSEADSGNSASLPFFPTSQMYLSRPLSSSSVQSLSMSHDRAVAEGNGDLSRCTRFGVCQSLIRLADWSPVLVDGIRPQLRFVQPYDGSNSFVCPALATQGFCSRRHWLHPLVGWTSSFGGVGSTPVKGFDQASTLVPCGFPEFPPHGPASGGCR

SEQ ID NO: 1022145 - protein, 132 aa, Homo sapiens
AEPGLFLALARLQEGHPSPSLFHLLLREGKMSESSSKSSQPLASKQEKDGTEKAGPGLGRAKQPSEGAQTEGANNPKRLSGPTKREAENKGAAKTRKTTTTPGKDNQGADPKNCEKEEEEGISQESIASEEQ

SEQ ID NO: 1022146 - protein, 147 aa, Homo sapiens
AEPGLFLALARLQEGHPSPSLFHLLLREGKMSESSSKSSQPLASKQEKDGTEKAGPGLGRAKPASAVSPGATRACVGESRQKEPSEGANNPKRLSGPTKREAENKGAAKTRKTTTTPGKDNQGADPKNCEKEEEEGISQESIASEEQ

SEQ ID NO: 1022147 - protein, 64 aa, Homo sapiens
MKTGYDGQFLHSELLSGLLVAMQPLHLILALLPTCSGLVNRRMQSVSVVIPDTWLSPFTTLKSI

SEQ ID NO: 1022148 - protein, 289 aa, Homo sapiens
MGPWGEPELLVWRPECGSFRASSACGAGGEVGGPGAAAGAHPPLQPGAHLCAAAWPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVGGWLWILFSCMTPLGIGLGAALAESAGPLHQLAQSVLEGMAAGTFLYITF

SEQ ID NO: 1022149 - protein, 213 aa, Homo sapiens
MVHKQEEESCVYEEGAAFFVGRSPYYILGEKKRVVGYIQTREGRTRGGEKRAIKEGRQTTGRRSGQHHQTPRGREKTQREGRQQTTGTSNGQIQKQNEESERNKKENEESKNEQRDREVNNNNRHKKIAADAETRRELRVLRASNANRPTILTTGREPTIIKNNTRGSLLHQTAHATHHQTTVSTPHNHQRRNTTTHANTNPHQHTPHPTADQ

SEQ ID NO: 1022150 - protein, 76 aa, Homo sapiens
WTPDYTRYRRYTVGKAPSVRWFLLGRDCDSPARQCMWLPQHPAPEAPGGQQLPLAPSSPQKLRRRHSASTEAPLWE

SEQ ID NO: 1022151 - protein, 254 aa, Homo sapiens
RQRVRAEPLPPPCSQQYRTAGVWPRPPCVPPSDYVSDRIPHSGCGSTEPRAGSKTREKEKMKEAKDARYTNGHLFTTISVSGMTMCYACNKSITAKEALICPTCNVTIHNRCTRHPRQLYQGQAEATESGLLKNNTDLQSVSLRSKTTIRERPSSANLPLRQLPAVPPGLPPWQSSLSLAKSVPTHQHLLGHIQLMSLPCGLRRILSTVHRSLKMPEPTLSGHSLIDEAQGIYSELLSDLDTDDKDLPLILGLV

SEQ ID NO: 1022152 - protein, 384 aa, Homo sapiens
QGKITFLETPPIGKIWFRAYKAPSSLAIRVFLQWVPWNGFLLLQGLEKRARAKLESVGGQLDILRVQFFSKSPAGFCLATSKELAGGVEPPVFLGPHHTAPYSFDKSLWVHLPPIGAQEPPERELVALVRDEVNKSSGEAIGLLESSLAVSFEIRGKPLGQIFIKFSLVGSHKGGEGSAFYGPGPGPQRRLTRAGCHAPITGHLGQASGGLGGQFLGVPTMGDPFGSLGPWSPRLTSEQSHPWRKHWCSPGTWRARDSRGPKPSLGQSGPVTPGIYNKGGRLRGQETGRIGVWACTGEWGDTQGGKAFTRGLGTPTQQSGDTDKGRPEEMATTIKPAGPHGSSTQDHARRTGAPPRPTGGLGSPHVLARHNDSRGVAHHARSTA

SEQ ID NO: 1022153 - protein, 321 aa, Homo sapiens
AGFCAPSSSEKPPVFLHLALLYLQAGSPEIPAPNPPCTLGPALLPPERTFCSYSEHTLTSAEGAGQRSAGRRRQAPRGDLGSPAGSIMKFQYKEDHPFEYRNKGQAKRSGRKYPDRVPACMSEKAPTSPGVLIVDKEEEPELPSAPYCGQSILIRKRIHLRPEDALILLVKQPTIPSQQCITWGQLYEDQIMRKNIPCHVAYRMTRVYCDTEGLHPSRGSTMTARRRGVDADRRNTVAPTAGDHGGDLKNRPTHANYTWPRHSGIPALDKDQTVNDSKPPKQNNGQRKSKNSGQNKHTRHRHASTTPKTHHHNTRTLFLLS

SEQ ID NO: 1022154 - protein, 254 aa, Homo sapiens
GWVLQVLGLGTLPGDSAWRAIPRVARALSPPAGVDAVGAARVARAGSRRRDHGDWDEASRLPALPPREDAARVARFVTHVSDWGALATISTLEAVRGPAFADVLSLSDGPPGAGSGVPYFYLSPLQLSVSNLQENPYATLDHDFGTDQLSARNMDFNHKVPFVVHNNCSQELLPKVNEHQKWILEKHSLFIRHPEMKSWPSSHKLVLCLELNIHQYLGPGPNFGGTKNCDNRRILYMAQFSEEDCGEFNTYEVS

SEQ ID NO: 1022155 - protein, 130 aa, Homo sapiens
MREFNSGTSQSSGGDETQLPLSLWARFMPGASVDRGHAPGLPKLEKAARLRSEGQNSTVSPTESRWEQGRWLPRLCGRIRFLAVEVACTPQLVLPVSNDWSFLLLSLHLPPSPSPALLLQGSEEMESSYR

SEQ ID NO: 1022156 - protein, 81 aa, Homo sapiens
ARACDQKPAVGLHTRLFTRWKQDGGFGLGLAVFCSRYWNLHLDPAAPTARKQLDKEQVRKAVDALLTHCKSRKNNYGCAFE

SEQ ID NO: 1022157 - protein, 227 aa, Homo sapiens
RGAELEWELTGADDGRVLWHACLRGHGDVGAEPGAGADGRWPALGPRNPALLPTILLLSEPEKDCTMNGDSRAAVVTSHTPDTAPHKAEDFDRVDEKKPEYLRERNMAPDLRQDFNMMEQKKRVSMILQSPAFCERNWNQVIQEQFTKGQEAHRPIGITARLPDSYDHECTKMSTQAAPQGGDGCLKTMSLGMVTPVNDLRGSDSIAYDRTDEQVITACKVGSGLID

SEQ ID NO: 1022158 - protein, 252 aa, Homo sapiens
RKSRLTVALAAREAGESGSPVAAGGLVSMVARLVNHQLLHPMASVWRPRWQSRLGTHRPEPGARHPALPAMVNDLSQYLPYCGHQEVGQVLAGRARMLLLQFWRVLFCNHPPFALGVMSFLYGSFYVFLYGRQSATSDPVHFILQDQTVDSSNNLTLLLPVYANVSLTNGWTLIGWLMYGTGVSVLPLELELPESPVNQDLGMFLVTISCYTRGGRIISTSSRSVMLHYRSDLLQMLDTLVFSRPPAGTELI

SEQ ID NO: 1022159 - protein, 168 aa, Homo sapiens
MECACSSGGENNEHPGMATQVTVFDLRFCVPNKEVMPERGIHTLEHLIGVVLVRNHLNGNGVEIIDYLANGLPRPVFILSLMVRQMSSVLLMPGKRGHWIDVLTVQVSESESRQLTVYQCGTYPDALACRKRRLWQRSILDRDVRINSKRKNWACRQEKLRGTALSSQ

SEQ ID NO: 1022160 - protein, 76 aa, Homo sapiens
PRVGPAPLRALSMSCSMAIPCHSSSNVVVEPSGLLELNNFTSQQLDDDETAMEQDIDSSTEDGTEPSPSQSAVERS

SEQ ID NO: 1022161 - protein, 476 aa, Homo sapiens
AQKGHMLSRLLIGRGRTRRCGVGRCCSALDRRHSAIRPLCAVSRREHSDSSRRQRVRGHRPQRPSSWPAERDAASASATAAAAPPPSLSRRVARGPSKPWSEDYWDRCACGETGGARRSRELIPGRLPMRRPRRAPRALRLLARPRRSPWDRMKKIKRQLSMTLSSAPEIVHEDLKMGSDGESDQASATSSDEVQSPVRDINKRLSLPADIRLPEGYLEKLTLNSPHLLTSPSAAASVVSAYLRLGLGNRGRSIIYCVQHAGADEPMYAVLALDKGKDVNAHSTSLVGDSRRSDWNMKRGTLHRIREVSLLKDLKHANIVTLHDIIHTEKSLTLVFEYLDKDLKQYLDDCGNIINMHKVKLFLFQLLRGWLLHRQKVLHRDLKAQNLLINERGELQLVDFGLARAKSIPTKTYSNECDLGYRPLKSAWVQGLLPSDAMWGLGCSLRDATRLFGHEGQGTPRLDPGMRVARHIHRDA

SEQ ID NO: 1022162 - protein, 491 aa, Homo sapiens
AQKGHMLSRLLIGRGRTRRCGVGRCCSALDRRHSAIRPLCAVSRREHSDSSRRQRVRGHRPQRPSSWPAERDAASASATAAAAPPPSLSRRVARGPSKPWSEDYWDRCACGETGGARRSRELIPGRLPMRRPRRAPRALRLLARPRRSPWDRMKKIKRQLSMTLSSAPEIVHEDLKMGSDGESDQASATSSDEVQSPVRDAYAQHPPRKDSPLRTFNKRLSLPADIRLPEGYLEKLTLNSPHLLTSPSAAASVVSAYLRLGLGNRGRSIIYCVQHAGADEPMYAVLALDKGKDVNAHSTSLVGDSRRSDWNMKGGTLHRIREVSLLKDLKHANIVTLHDIIHTEKSLTLVFEYLDKDLKQYLDDCGNIINMHKVKLFLFQLLRGWLLHRQKVLHRDLKAQNLLINERGELQLVDFGLARAKSIPTKTYSNECDLGYRPLKSAWVQGLLPSDAMWGLGCSLRDATRLFGHEGQGTPRLDPGMRVARHIHRDA

SEQ ID NO: 1022163 - protein, 82 aa, Homo sapiens
RVLPSAGAGSLCVCPLALCSVLRLPTALLRSTMALLHSGRLSSRGIAADLPPRASSASWSLPGASLLAGPSVEDGDLARSHI

SEQ ID NO: 1022164 - protein, 118 aa, Homo sapiens
EIDYVNRYRVQSPSYGKTSGERTDLTLYTAQNRITPNVNRRPKITLQKKIKITPIFIFKKVPALELQKLEKPKDVPPLERGRQQRVAVLAFKAELKRSRHSSLEFLCFRIFPLYCCHV

SEQ ID NO: 1022165 - protein, 177 aa, Homo sapiens
MIRCGLACERCRWILPLLLLSAIAFDIIALAGRGWLQSSDHGQTSSLWVGNAPQEGVRHGSYEEGCQSLMEYAWGKAAAAMLFCGFIILVICFILSFFALCGPQMLVFLRVIGGLLGHWLLVFQIIVPGNLPLLKYTQTFNLHCQTVLSTYIYNLGTYRLLRWRRPRIILNRLVHFY

SEQ ID NO: 1022166 - protein, 114 aa, Homo sapiens
VDVRTPPMNARSVVCMDLHDESSSPGSPQSQMCSEYQVHLIDLVQIGAFIRPVVASTAGRRSPRGVSVMTITTQPLSHTFCPKVSHGGGQRSLGGDVRGVPRVVIHDGPSVDVV

SEQ ID NO: 1022167 - protein, 312 aa, Homo sapiens
ESFIYPSMCWIRDSLVRYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSEQRQGLPYSSGSTSSSAHLGSHSPSCPCDEAEMRPRRTLPVAPEPGPDPGQSAADFGKPNDHGEMGRCHGGRTPGLGFEWAGDYSALTQLHGTQKCAAMLPRVLSPHLCPPSWKAWSLPYNPWPASCWGAGLDLEVWATLILCPAWEQKGPMACSRGPRGPGTRAEPRGPGKGRDTSKPGEPANTQPLA

SEQ ID NO: 1022168 - protein, 52 aa, Homo sapiens
YSDYVEDDDDDEEEDSEEEAMETTPAKGKKAAKVVPVKPRTWLMDEIRDPLS

SEQ ID NO: 1022169 - protein, 152 aa, Homo sapiens
GSARRALARLVLAWCRWLVSATCVGTADRKMSSGNAKIGHPAPNFKATAVMPDGQFKDISLSDYIRNNMCVFFFYPLDFTLCVPHGRSLLSVIGQKNFKKLNCQGDWCFCGFSLLSSSMGQYTYRIQGGLGPMNYSFGIKTRSAPLLRIMGS

SEQ ID NO: 1022170 - protein, 258 aa, Homo sapiens
GCSRPPRSPASLAARPSSVLPGQPASQPGGAGGGEQAVPMPEPGPRMNGFSLGELCWLFCCPPCPSRIAAKLAFLPPEPTYTVLAPEQRAAGASAPAPATAAAAAAQPAPQQPEEGAGAGPGACSLHLSERADWQYSQRASLATPSQALSSRLTNWAHGGNNTASACHASVRCSAPPASLHACLSLARANAPTLAPRMLQPYNCALAPPANQTCKQSSLTHYGGAQLGAKPLRAKLRRTDARAGRRLRTRMALSSREH

SEQ ID NO: 1022171 - protein, 256 aa, Homo sapiens
GCSRPPRSPASLAARPSSVLPGQPASQPGGAGGGEQAVPMPEPGPRMNGFSLGELCWLFCCPPCPSRIAAKLAFLPPEPTYTVLAPEQRAAGYRSEPEEGAGAGPGACSLHLSERADWQYSQRASLATPSQALSSRLTNWAHGGNNTASACHASVRCSAPPARYTPASLSHGTAVDLGQMCSSTLASVPINCNIFSYDYSGYGVSSGSLREELYADIDAALARRCDTRYGVSPRTLSSMVRALGLSPGKIWLRGND

SEQ ID NO: 1022172 - protein, 178 aa, Homo sapiens
MPTLSRTNHPRWTQSARDSPNPSFAATLRVPRPHAYQLVMPKPRRSAPFHLISGLHNQTHTAPPPTDVNDCLVSELESSHHPTTHDRIRSTSTTPPPAMPPPLPLSAPTSHPTPSLPTTPVTNNHPATPPTPLSIELSVHTMHHLMTSHPIITPHRSAHPTPALHTSHATDSPPRSTS

SEQ ID NO: 1022173 - protein, 74 aa, Homo sapiens
AGLRAAVSLRRSRMRPAAVAPASAGAAAAEAAAEAAATAAPPPDEMRLGPGASGADADPRGGGVGKCFVSRPTI

SEQ ID NO: 1022174 - protein, 257 aa, Homo sapiens
EVKKRGEGKGGPEPGREKGGAAHQPAVSPQNRLSIQAPGVTQLQRQWQPYILSAKWHGMTDRTRGPRTGGPQSLTTAAWPSPMAFNDLLKQVGGVGRFQLIQVTMVVAPLLLMASHNTLQNFTAAIPAHHCRPPANANLSKDGGLEAWLPLDKQGRPESCLRFPFPHNGTEANGTGVTEPCLDGWVYDNMHLPFTIVTEWNLVCSHRAFRQLAQSLFMVGVLLEAMMVGYLADRLGRRKGGDPELPGNSCAGNLCSL

SEQ ID NO: 1022175 - protein, 76 aa, Homo sapiens
SREFGMQERKKRGWYPGSSRCNFREVLVCLVRELRGPGCVKVVLLPTCPVVPAPVWTATLPFFHPRVGSTTVEICF

SEQ ID NO: 1022176 - protein, 269 aa, Homo sapiens
VGLTIGARESQGQGPKRKLLGSLALQEEEEEAAWPVPLSQPPEDELDRLTKKLVHDMNPPPSGEFGQCGGCGEDVVGDGAGVVALDRFHVGCFVCSTCRAPVRGQNFYVERRYCEGCYVTLKCATCSQPILDRICGLWGRPTTLAPAVTAASNGIPSHPVECYEATSPLHLKEFSPGKFVRPKMLTFAVGPHKCLSPRSRRRVRIVALESKFSHLAVTSARKCGLLLSSEGECQGCYLLDGHFLCKGLLRLAASTGGFQPPSPLTAEFS

SEQ ID NO: 1022177 - protein, 43 aa, Homo sapiens
SLRGRTLKITITGYEPLTVAMSTVSSLNGEPEQGVAMEAVGQN

SEQ ID NO: 1022178 - protein, 164 aa, Homo sapiens
PDFIYQLYSEEGHSVFDSGRTCWVTSSTGGAPSPFDRNFGTQISARAMEWIPAKLTGGPEAEEKNLPPDDSICVLGISQRNVIFQPVAELKKPTDFEHHGFPKDPWWLQLRPLMEILAQYKATLCRCRNSRPRWDTVHALEVSEPTSRLHVPAAPVELSLFVTP

SEQ ID NO: 1022179 - protein, 102 aa, Homo sapiens
VPQNFARSEVHIAHVHCILLDNHLNTEGTWKRTDCGHLGAKGPKALKGTAYCHLSLPIALICGDIGGGSHGRRLLMAVEGAGSQMHFFCHVAYFEKTIRKDA

SEQ ID NO: 1022180 - protein, 103 aa, Homo sapiens
GLCCRLLGAALGDQSRVEMSYIPGQPVTAVVQRVEIHTGYEAVAQMKPGGLRVHSHSPEGVLASPRVWPSYGFRPRYEAHLISAALRIVICLFCLWVHTCVFF

SEQ ID NO: 1022181 - protein, 156 aa, Homo sapiens
GLCCRLLGAALGDQSRVEMSYIPGQPVTAVVQRVEIHKLRQGENLILGFQHCDVWTFGPGTLSQNPFLLKNKTDKGILIVTRVSEGGPAEIAGLQIWRPRSCQVNRLGTMNHWSHRNQGPGKRFTKRSEEVVRLLVTGKSLQKAVQQVHAGPKQSA

SEQ ID NO: 1022182 - protein, 283 aa, Homo sapiens
MIWGFNLFRRSFCFGGRAEGNVHILEFKKNTSTFTKINQHKIKEEKAEQTKLFLRYFNLKHPWCFLHYKSPILKNPQTHYNISFMHFTTNILHCVSAIRIIPSYGGVPTERRQRRAPGGVGLAPAEGLPGAPPPWGQETLHRHEYTERGTEARTGCTDNLHTKRTMHTDKTSSDDVWYTTDAQHTQRHRNRRRQTQRTQRKSATSEQRRDRQDDVNRRSNDDTRTPSDCNARENGQPGRTKPRTGEDEESESGTKPSRDTKNQSESSSERGKREAARADRRPR

SEQ ID NO: 1022183 - protein, 100 aa, Homo sapiens
CPRRSESAKKEVVAEVVLAPQVVAEAAKTAKRKRESESESDETPPAAPQLVKKEKKKSKKDKKAKAGLESGAEPGDGDSDTTKKKKKKKKAKDVELVSEY

SEQ ID NO: 1022184 - protein, 345 aa, Homo sapiens
MALPLGLLPAAAQGFPVPLSSAGLPEPRAACWSQYSLVACWLEEGELPNVRGGKPCAAAGRVRTWPCAAGAPGPSGHVNPRWLDALWAGTERVCDAGSFLLRAWRRVARGLAVRPTLRGPPGLIARCAGLSYRRRRRGLTPSYEASPFSNVWGRPLAACTLFGTHGLDPRVTPMSSFLHRFPFKSLGYISDSTGGRFQKRPQHLVEHSPALPPFYTRSPCKSWSCAPFRFPRAGHGAGRVPALLRCARCRPCAVCAPFLPGLLWRRSRLPPLPGSATRPPAPACPPSFPSCTAPPGLDVLPFGIRAFSVGPFLHRCGPLTSLQPYNATRRAQFRHARTDNPPGGP

SEQ ID NO: 1022185 - protein, 192 aa, Homo sapiens
PNSGGNDSPLPSPRALLPFPYVSASLSDAKRARRTAEGRSRGTLLGQALPLGLLPAAAQGFPVPLSSAGLPEPRAACWSQYSLVACWLEEGELPNGRGGKPCAAAGRKNPANFHPVKRGPGLRKRGPGMRAPAMGPGSSGGNAKGPPTRGGSGRSRRRELTTRGHEVALWINTITHLMAGKARSGHRGIQER

SEQ ID NO: 1022186 - protein, 256 aa, Homo sapiens
VLVQNFIKGSLEEQHPELQKYSCQGDPCDMLVGTWRGAVAGGFVAFPPFVSLKVGGWVGRYLILGSHKAHGGSGRGFYRANSLPVGAPRAASDSFTLCIAQNTLCSVSNNVWRNSKVLNDSELNQGSSGVVDSLKAIQQTLRDYSPSVLREFPDTKTSQPGAPLSMDEPEHTIAGPSGQKALLESWYRRDSAGAKGTQTSRGHLFSIKLYMALWKAKPLLELQQSVPESAGLLTKTHLCSGGTIRIWTGGCNRTSV

SEQ ID NO: 1022187 - protein, 150 aa, Homo sapiens
MISTRRSTYNHLSRWLTDARNLTNPNTVIILIGNKADLEAQRDVTYEEAKQLLKKMAYWFLEVSAKTGENVEDAFLEAAKKIYPEPFRHGELGSVMLREIWCDKTNLQPRTGGRLTSEPPPQERNGCALLGDLFAVAPHLTFAPLSVGTT

SEQ ID NO: 1022188 - protein, 116 aa, Homo sapiens
KNLNMTLNGAPASLVALEDDARRTRRDTRMHNIEYIDVEYAGSAYAGQVLFHVTQSSEIVMHVKTHTVGISLIFQPGTVPPFELIWEEIIQDDWKKGDVILSETWSWELRRREGLD

SEQ ID NO: 1022189 - protein, 315 aa, Homo sapiens
NTSSAGPVGGRIQVWHAEQRGMLKDSAMLEYLKIAQDLEMYGINYFEIKNKKGTDLGLELMPLDLDIYEKDDKLTPKIGFPWSEIRNISFHDKKFCHLAHLTQKAPDFVFYAPRLRINKRILQLCMGNPELYMRRRKPDTIEVQQMKAQAREEKHPEAAGAATAGNREEEERDRWREKKEQMLREKEELMLRLQDYEEKTKRAEKELSEQMEGPPTGGKRGGEPRREAEVWEATMVRLRARENSRDGADRLRAGRGGCEAGEDTGRMTWWGRGSPKTRSKVDTGEEPELGAEDDWVEPAPPLIRTRRKRKGYKNK

SEQ ID NO: 1022190 - protein, 463 aa, Homo sapiens
GRAHAPGKPGCFWAGLQTPRARVTVSFPVRHDEWMEMPWNQGLELAVAVSLMLLWDACSVVPPPPAAAFSVLPWLMVQCALLVAGGSAACLSCAGVGAASGCQLGAAEPREAECVAVAAGDGDDDDSRACAQPLPCRRPAFSSLPYVPECGSTASFPAARLSSRPLGAGEPYSQRQVVLTLYPKGGNSWLSSSLLLVGTMSLKLQASNVTNKNDPKSINSRVFIGNLNTALVKKSDVETIFSKYGRVAGLSVHKGYAFVQYSNERHARAAVLGENGRVLAGKTLDIKHGLESLRHDRPKGLKRAASAIYSGYIFDYDYYRDDFYEEGSSTTGGVVSPVADGHVGPCEATRVTVPWIGVSKVTVTVKLFDLSTGVITRSGESSSTQRELQHQRGDQIGSNMMRVNGGQIAGPKGIRMQKKGGGGPREGVCGRGKVSVGGRAPPKIGGGRNAKKGARRREGRQEA

SEQ ID NO: 1022191 - protein, 258 aa, Homo sapiens
ALITALNQPGYQLGLFSSDGFTSPLYRQALLSDFSMPSVRTQSDEQTATQGINWLGRYAQEDNRWFSWVSFNGTNIDDSNQQAFARKYSRAAGNVDDQINRVLNALRDSGKLDNTVVIITAGRGIPLSEEEETFDWSQGHLQVPLRDSLARHAGAAYLNALTDHTRSDDDADGKACYIVRNTCPANIRKVQDQCKTSTTTLPGVPQRKNEYAGEYPPRTRRGTEPIAETTALDTYVVERVTDEKHRNDGMHCMTHAKR

SEQ ID NO: 1022192 - protein, 86 aa, Homo sapiens
SSDPSATRTEAARSGYLVQEILGTVIQLVLVGAFVAGTRSFILPQSLGMLIEFGREVKVRHVHHTQNAFHSELHLGGGQVPGGHLF

SEQ ID NO: 1022193 - protein, 114 aa, Homo sapiens
MPKAPKGKSAGREKKVIHPYSRKAAQITREAHKQEKKDHIDRMKRPCVSTLLVKNCNGFKIILIPKKRDIQRKMLCELIERDSRHSKCSNLKTFREWDFDLKKLPNINMTKNLR

SEQ ID NO: 1022194 - protein, 242 aa, Homo sapiens
MVGLSGHFCGVPLPAGDPTGLRIPVQILAQDLYTGSGSFKRTPSNVADLTSLRAPLDIPIPDPPPKDDEMDTDIARRRKKSLSVEFLPGNEKVLSQLALGKPRSLELLQEEIALLVIYTGGPTTLNPPRVEDGNDFGVAIPEKVLERVYALKHPKWELSQTNPFPSTSQERGDAVAQASPGRLIVMDYPGPWCMSDDEAAYGELTGPGAGPEAPSYAELYHIISSNLEEIVNPKGEEKPSMY

SEQ ID NO: 1022195 - protein, 99 aa, Homo sapiens
MFNPEESELDLDYGNRYKNVKLPDYERLIDVFLREPFVRSDELREAWRIFTPLLHQIELEKKPIPYIYGSRGPTEADELMKRVGFQYEGTYKWVNPNKF

SEQ ID NO: 1022196 - protein, 161 aa, Homo sapiens
MGVALTLSFCFYPATSAHTHVRCQEYNVYLLPSRGSESRLSEEGIFLLAKGLHMSCGGEISSPPEVIQDIFNVPSCAHINTDMTLLPEVGNPYSRITQNDPGYLSNKKRPYSMKLTNVYKQENNQENGFPTVPGRNDKGLYGGSSYVDFLVLCPHGDLSAA

SEQ ID NO: 1022197 - protein, 112 aa, Homo sapiens
SAIWAIASWSSPPPLSPWSSCKSARMSQAEFEKAAEEVRHLKTKPSDEEMLFIYGHYKQATVGDINTERPGMLDFTGKAKWDAWNELKGTSKENPMKAYINKVEELKKKYGI

SEQ ID NO: 1022198 - protein, 408 aa, Homo sapiens
RSADLLFNVRECLCCNTHGEGHFLAPSAKYLQTLGRLLHSQIDRTSLNSFRINEHHHVQVSECKTSTTMCDGFLHRHALLLLVVRVRHRLVHCAWREQLSEQQHPWSPHPASRSSRSADDAGHAAGPETVSQTTTGRHRVQEYVAITLSTDSVPSRLVAIPKRSVADLQEGLQTGPARAGQQLACEMRHLDQYALGWTVSYHVQLRGHTESIHEQGTGVHTPYMASKIQIEGSLVLMGHGRSVEAGTGAHAIPRGLRMPQRRKEGQPDYTIGRSVVRLRCTLASRTAHGTRQRSMVTDSQRKRRARKTYMEHRMKGQTHKTMPKGNNPRHYRNTHVKQTRKKDRQGPRERQHTADRGHQEKTIEEERQNNQSRQKDPDPRQGENKDRTKRVQTKQKPWMEKIQQTTAP

SEQ ID NO: 1022199 - protein, 88 aa, Homo sapiens
SLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 1022200 - protein, 88 aa, Homo sapiens; identical to SEQ ID NO: 1022199

SEQ ID NO: 1022201 - protein, 76 aa, Homo sapiens
EDYFTQAMEVKAFAETHIKGFTLNDAANSRLIITQVRRDYLKEAVTTLKTVLDQQQTPSRLAVTRVIQAVAMKGDV

SEQ ID NO: 1022202 - protein, 315 aa, Homo sapiens
GKVNIDVGGAEQERKSRLFLYEASRQFHTNKACFGAAGAKESELGAMRVTIRVFLFGAYDWFLWVHLLPGRPSDASSGPAELDSNWNWFQLRCMQVVRECQCEGFVVANMDAQPSDANTKYNMPESAQMYREKIRQLGSAGLARHGTDLWIDNMSSAVPNHSPEKKDSDFFTEDTQAPAWDAPATEPSGHPAAMTRLQQSSGLATCLEHGTSQTCLEQQPKPSLELKSSSLARRSQQQLRKGWVPRTALGAQKVSSKSFQWRMEREGSGGHETVREAGRQAMPRRQAEELHGRLHGDWANRGSQWTKKEEQSYNR

SEQ ID NO: 1022203 - protein, 424 aa, Homo sapiens
MHRLQVVLGHLAGRPESSSALQAAPCSARFPQASASDVVVVHGRRTPIGRASRGGFKNTTPDELLSAVLTAVLQDVRLKPEQLGDISVGNVLEPGAGAVMARIAQFLSGIPETVPLSTVNRQCSSGLQAVANIAGGIRNGSYDIGMACGVESMSLSGMGNPGNISSRLLESEKARDCLTPMGMTSENVAERFGISRQKQDDFALASQQKAASAQSRGCFRAEIVPVTTTVLDDKGDKKTITVSQDEGVRPSTTMQGLAKLKPAFKDGGSTTAGNSSQVSDGAAAVLLARRSKAEELGLPILGVLRSYAVVGVPPDVMGIGPAYAIPAALQKAGLTVNDIDIFEINEAFASQAVYCVEKLGIPAEKVNPLGGAIALGHPLGCTGARQVVTLLNELKRRGRRAYGVVSMCIGTGMGAAAVFEYPGN

SEQ ID NO: 1022204 - protein, 255 aa, Homo sapiens
SGFLPTLRLALASVLERPLPVNQARVFRDLEGRADLLDLGPGSLSDGLSLAAPELGCPSKEAIGHPTMQLHGNDSQRLAFKFRHGVSSCRLTPRATAGAYSCLPEGGMKVIDDQPYTVLGTQWLVGAGDVQLLGNGCVGSATVDISVQLRRDKGDAVSVASVPPSCLPTWCISTQGNGACRMGTMICGWDKRGPGLYYVDSEGNRMSGATYLCGSGSVYAYGVMDRGYSYDLEVEQAYERAVEPFNKALQRCYQK

SEQ ID NO: 1022205 - protein, 166 aa, Homo sapiens
SWDWVSGVVPTMHLTIAEELVKATTVGQMGCASSWSVMYITGAGLYAARIPEGFFPGKFDIWFQSHQIFHVLVVAAAFVHFYGVSNLQEFRYGLEGGCTDDTLSLSLPTCGVAARNFPGALEILLAEVRGQSLSGLFLEETLENQYPTSFEPIFTPMGNTIPFPFS

SEQ ID NO: 1022206 - protein, 103 aa, Homo sapiens
SAPTLFKDHGVYGYSEGEEWAGVVSAQGARSIATECSSLTVFWSVSTVLTEARNWSREACTAGVNSAGRRGDQGSPAGSEVRSVKLDRVHPRHVRVQVDSGRT

SEQ ID NO: 1022207 - protein, 157 aa, Homo sapiens
MQAVIFCNTKNERWYWADGDKLTGSQLQLYPPCMETCPQKERESIMKEFRSGRLAGVLYFYEKSGPGGWMSLRCPSSVTYESPVYIPTGELVTHITPRIVETHGRYGRKGVAINFVKNDDIRITHETIEQYYSTSEFECKKSDERLLILSESSRSVG

SEQ ID NO: 1022208 - protein, 45 aa, Homo sapiens
RTASTPTPPQTGGGLEPQANGETPQVAVIVRPDDRSQGAIIADRP

SEQ ID NO: 1022209 - protein, 367 aa, Homo sapiens
MSKWDLIVVAPIHLRKRSKIQVTRWMQSHPDAGPLLHHTPLSHVTVDEHFSPGSHPSHIPSDVNSKQGMSRHPPAPDIPYVINPLSPRWCRTDHPTSWLARSACISHTRVDSVQAYPSSLSVDTSMSRFSHHMIPGPPGPQQLASLIQHIVTPQVKQEHPHTDSAPNATCTASSMQPAATGSSEPKKTSTFKQASECFSCSSHAPEHESECRCMSDSKRHVQLSTRFLAEGGMPSPVKSTLKYSCNSSHGNAKHSSQYASIYPRLCLHAATLWYAKRKRQERENYGILHPGEQTTLISNVASQGIRHPRNSSGDATLVTNPDWLKGHARLNQRKPGLQYNPVRPERTANQYSKKRNTRHMKGQTQKP

SEQ ID NO: 1022210 - protein, 284 aa, Homo sapiens
LFSHRNRLFFIQKKTKKQNKTKHQQQQARRNIFKRLLRARLTVTRGLRQSRVHTRSAMFKPIASTSKPARPPAPGEGQREKQRVYHSSVHIDVSSLNNTTGGSPICMCGWFGQKYRYIYMIKYSNYRRAPRAAKCPSAKVLPAPPRAGARARARALPGVSAPAGRGTRAGAALAVAGGGERGLGQLLEQVPQGAELARHLLHLLLQPLVLGRELQELVLRLQVAHLGLVAALAHGDVLPLVLAVLVHLLGLALLRLRPAYRRVGGAWLHGAPRAGRLDEETGEL

SEQ ID NO: 1022211 - protein, 306 aa, Homo sapiens
KETTGQNLLHGWVKQKGGGIFSIVERLLKKGYEVIYLTEPVDEYCIQALPEVDGKRFQNVAKEGVTRSDESEKTKEHVGKQAEKEFEPLLNWMKDKALKDQDYEKAVVSQRLTESPCALVASQYGWSGNLERIMKAQAYQTGKDISTNYYASQKKTFEINPRHPLIRDMLRRIKEDEDDKTVMDLAVVKLEREHFGQDIFYQTTEAYGRIAIETNCFGLSLNKDPEAQVEEEPEEEPEDNSERGSKTQSQDEGEGDGAGTKRKAGNARDLEKVTEFTSEDRGRRELKALENGGVHPLRGKGGPGRQ

SEQ ID NO: 1022212 - protein, 110 aa, Homo sapiens
MQAIFLVTLSVFLHVLHSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 1022213 - protein, 249 aa, Homo sapiens
NSYSSCTHSSRNGNFRNAYERKNCRLYTTTQRTQRVGPYGLLQAFADAIEVFTQRAPKTRHIYHHPLHHRPDLSSHHRSSTMNPHLPPYPIPLVNLKPRPPINTSHTLELAVLLNTSDQGEHQDIKNKTLIESPETQSATDNLHMKSHLDHHYYYPTLNNKMDSTYTYSSPSSPHKNHRLIYYLSITDRSGQKYEKYRPDIADRHKTQPRFRNLPNEGCPTLVSWTYNNRIRRRTTSTVYLHRLELHTT

SEQ ID NO: 1022214 - protein, 153 aa, Homo sapiens
KVAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTNPAGRHSQTAELFCCCSHDGQQHSEEVCRDESTTTRFDQGDWMPK

SEQ ID NO: 1022215 - protein, 122 aa, Homo sapiens
HVVVIGAAFVVEPLGEYVSVRPARVLFTYDVLRFPQRGFLAPVADVRKFDSCVSVLQGPPQSCSRRYPPGGLPALCITRAHLPWVLTADTCGEILWLVSAPGPPWWIPDVWKWKRTGRVRFP

SEQ ID NO: 1022216 - protein, 46 aa, Homo sapiens
GPHMRWNKGTILKASAEYIKWLQKEQHRARELEHRQRKLEQANRRL

SEQ ID NO: 1022217 - protein, 67 aa, Homo sapiens
TMVLSFFSEKKADYQAVDDEIEANLEEFDISEDDIDDGFRRLLAQLAGRGWENLVPCELETHPEEGF

SEQ ID NO: 1022218 - protein, 205 aa, Homo sapiens
KHKSYGKPCPDKIDRNKTDKHGDLSSEMAHTMLNPKTTLYEAESRKRSLVAQRDLEEPDHEIKNDKSSTPLLKDTYRIGRAWWCTLVVPVIKGAETGGSLQPMSLMAAVSCDLRHYTPAWMTGRNLSQKHQKTKTWSPGVMVAQTHMTDVLRGSEACPLTWGSGPGEIWGTCCPICDALKDRGIIPSQEAPEQGTVRCSGFCEAQ

SEQ ID NO: 1022219 - protein, 73 aa, Homo sapiens
SPLSKRLAHQGVGKRGGRHRDKLASGIIKEGLCRSGSLQLHAADAPRGRPLDEAEEQQASLSSRLGRNAHRLS

SEQ ID NO: 1022220 - protein, 130 aa, Homo sapiens
GVSTNHSQLRAWETRPVWERPRGLCSGTPLCRGSGGAVRSPRPGRPPAHPPQPVHRHVVSDRGNLAAVLQQWVSWWKLASWAQPDPPLVPASWSARWKSAWATGPFPDTCCFQAREAFHGLRSLLPSRGR

SEQ ID NO: 1022221 - protein, 108 aa, Homo sapiens
MVFISLFLFFSFFIWFCTPGGPGVSQSVPGSVFSVFAFRFLGERWPNTLAIWNYSKPGFSNVLSRLSGPQGLSAHLRPHEVLDYRPGHPCPAHIIPVEWNFATTTPLL

SEQ ID NO: 1022222 - protein, 108 aa, Homo sapiens; identical to SEQ ID NO: 1022221

SEQ ID NO: 1022223 - protein, 72 aa, Homo sapiens
VIAVESDHTAVRHHSVPAIFYPYLVAPHYSYSCFIFEILHEKEMNGFEWNCPLEHDYLFPWTNIFLPLLFLA

SEQ ID NO: 1022224 - protein, 114 aa, Homo sapiens
TSNPFAHRDRVNAGTPQSGLRTMGRGLLKGRERSQAKRETHEPKRGKYNRMAQDPREGDNRMGVGGAMKHGRIPHGSGARNFHLLGGGAAEAYEANPGVTATMRGSKMGSDMRT

SEQ ID NO: 1022225 - protein, 117 aa, Homo sapiens
MNRLFGKAKPKAPPPSLTDCIGTVDSRAESIDKKISRLDAELVKYKDQIKKMREGPAKNMVKQKALRVFTSQKRMYEQQRDNLAQQSFNMEQANYTIQSLKDTKTTVDAMKLGVQGN

SEQ ID NO: 1022226 - protein, 126 aa, Homo sapiens
MNRLFGKAKPKAPPPSLTDCIGTVDSRAESIDKKISRLDAELVKYKDQIKKMREGPAKNMVKQKALRVFKAKEDFLSSGFCHTWYEQQRDNLAQQSFNMEQANYTIQSLKDTKTTVDAMKLGVQGN

SEQ ID NO: 1022227 - protein, 101 aa, Homo sapiens
LRGADGILRAHKHHGHLAGVAEAAKTHEVVVHRLETDFILQAEHKHHWIHPGSKLELRGASFILDQQQVTLAIHHNFLFKPPPFRGLLLDISPRQKTGHQG

SEQ ID NO: 1022228 - protein, 257 aa, Homo sapiens
HASPGRGDGCPGRLLSPGVLVRTGHTVLTWGITLVLFLHDTELRQWEEQGELLLPLTFLLLVLGSLLLYSLCRLMDPGYVNVLAPSLRRELTEEQTAMVPPASLFVRCRYCLVLLPLMGSVHCRGVPPLLSCRYDTTVAWMENCVGERNTHSLWVLPVGCSWVVRFCGACDLWHVVRAPGSSRPWGLWLRCQRGSCDGTFLLLSLFSLVAQLLLGSDLYLVARNHHLGFTLKRMANSAGPTLDGLTNCHFWVPGRDL

SEQ ID NO: 1022229 - protein, 391 aa, Homo sapiens
AVTGVCRLFGLRRRVCLRLCFFGGTSSGVPGRACSLLVRVGGHPFSGGHMGVHRCGVPSLFGKARVWGTTPLVRRPSGPVPPAWELSLHSGILAFVFTPGGPSLVVRDPFAAHKGPTLCPVLGHCPNGKSPVASPGPLVFGPREDLPCFPPFRYPPLESPRGHPLESLSEFGTAESRLGGPKWEAREAPRCVDLRLTIFPLFPLGLVQPTPGFLTNGQHIYQPPEDALMIHQRGNSSPFLRFLEGVPPMFAQMSLVLPEIGVTHTLLPLQYPHSYLIHRVTKQESLALGLLENRSYHPSPHLPVKGPGPSLADPILPFVAAAPCGLLPTHQLLLLLLQPPAKVEAQEESGGIRTRIWDLVSLTNPPQKPTHLAHVLFAKPGNKGLLSFKSP

SEQ ID NO: 1022230 - protein, 248 aa, Homo sapiens
MWPLWRLVSLLALSQALPFEQKGFWDFTLDDGPFMMNDEEASGADTSSVLDPDSVTPTYSAMCPFGCHCHLRVVQCSDLGLKSVPKKISPDTTLLDLQNNDISELRKDDFKGLQHLYALVLVNNKISKIHEKAFSPLRKLQKLYISKNHLVEIPPKPTQLLVELRIHDNRIRKGAQGERSEGLRNMNRIETGREPEGFETGAFDGLKLLRISALTGIPKLPETLNEHLDKKAIEEDLLRYSLYKLGLH

SEQ ID NO: 1022231 - protein, 67 aa, Homo sapiens
LTGWPFEDANRVLTTPTCTNMPQGHPACPPHTLEDVLKDPLMMGNLFIVPRKKKRISLLPVIGSSER

SEQ ID NO: 1022232 - protein, 169 aa, Homo sapiens
ELLDLLSCVESLRGVRLNAQEVSREWKQLSRILKFIFLPSELTTGLVAWRGILKWPGFETGDETPALGVGFYTIIEETDSEGLQTQGVLTTRHYDERLEINDSEEVASNLYIPTPKNQGLSFVLPIFLSKAMADNSSDECDRGTHNKEKKKTSQDDTSRGALVKNADDR

SEQ ID NO: 1022233 - protein, 271 aa, Homo sapiens
MYTMENISVTLADLFFAGTETTSTTLRYGLLILMKYPEIEEKLHEEIDRVIGPSRAPAVRDRMNMPYMDAVVHEIQRFINLVPSNLPHEATRDTVFRGYVIPKGTVVIPTLDSLLFDNYEFPDPETFKPEHFLNENGKFKYSDYFKAFSAGKRVCVGEGLARMEAVSALSAILQHFNLKSLVDPKDIDLSPVTIGLAVSHANLNSVSFLVHETCAIIIPLQNDCLKKLPSGLVRRLQWVKSTRMLFRSPEFTYQQHMGAHTICIENRLALK

SEQ ID NO: 1022234 - protein, 378 aa, Homo sapiens
ANYIALNEDLNTWTAADMAAQITRRKWEQAGAAEHYKAYLEGECVEWLHRYLKNGNADAAAHRFRQKAHVTHHPRSRGEVTLRCWALGFYPADITLNLAKLDMGEELTQGPLDALCENQGLAGDGTFQKWASVVVPLGKGAELHIAVCTMRGCLSPLTLRWEPPPSTDSYMVIVAVLGVLGAMAIIGAVVAKDEEQGETQVEPGGDYALAPGSRALKCLSEDCKARRQLAWNWYWSDRRMCPGLSWYIQKPQFPLHKHCLMSLGSWVRGEKRWSTKTCPDTQGTHTVMPLVPSKATLGPATPGADCGMFERVATKWAATHRGQNRRGGGTNQRQRPQERRPARALPSMCPITGQKLTINKAETLSCFLLFFSSFSCTE

SEQ ID NO: 1022235 - protein, 42 aa, Homo sapiens
SRNAACCGTLPKLVVEFARAGLTEPVLIRLDVDTKLNEQRST

SEQ ID NO: 1022236 - protein, 136 aa, Homo sapiens
GGEKRKLRLGTRPGFDAQDGCSIVRRGMLLARKWFFLSSLLQVKDTCFLQGYVDSHKVGSQEKEEHYCLADLASLMDKTFERKLPVSSLTISRLIDNISSREEIDHAEYYLYKFRHSPNCVVPEKLDYATPWIRQV

SEQ ID NO: 1022237 - protein, 107 aa, Homo sapiens
MLLHSAARDAPGAVKDTCFLQGYVDSHKVGSQEKEEHYCLADLASLMDKTFERKLPVSSLTISRLIDNISSREEIDHAEYYLYKFRHSPNCVVPEKLDYATPWIRQV

SEQ ID NO: 1022238 - protein, 186 aa, Homo sapiens
MDMKSNTGHGLFLGRQPSFSVRSMPGTPALAICQPHNPGPPMGTPTEDPSGALFLCLFLSPQSFLVLSWAISRLPSLFLLSGLCPQKPQTLHLAPNLKAKRLTFFCNTSWPQYKLENGAQWPENSTSNSSIGGDLDNSMGTWHWAVDPLSGLHHTSQRVQGASPFFSVYPLQGGHVWTPFPHKGFE

SEQ ID NO: 1022239 - protein, 190 aa, Homo sapiens
MAHQTGIHATEELKEFFAKARAGSVRLIKVVIEDEQLVLGCHRRQPVGRLGSGLLHRAVLALLDAQPALATWSNGLEFKRNWLQGLSEIGFFPSAWSALINFPPVGGLGRMAGTAGPRWGHRCKKEFARWPHHRIELFGDCEGMTLFCWVPNTLFVLCGTCPADLAERELQQIRINEVKTEISVESKHQT

SEQ ID NO: 1022240 - protein, 347 aa, Homo sapiens
MAHQTGIHATEELKEFFAKARAGSVRLIKVVIEDEQLVLGCHRRQPVGRLGSGLLHRAVLALLDAQQPPPTLLYRLDSQNASGPLATGLFLALARLTNLPPCAPASTACTARPTPPAPPAAQQRTPGALAPPTPARSLHRAQLADTASHPPPPRPARLPTTPPLSPPLLPATLPPAPATPSPPATKTQALTATHSRPLHPHGRPDPARTPPRSRPTPHTPQNPLAKPAHRPIHPPCPRPERPHTRQPPTHNPPTATPQRGPHLPPPTTRTRLPPPASPPPNPTLKPTGRTTTPQAPQAHRQRPQALTTYPDRRPPHERAGPQTTPPPPPTEPSPTTPIHRRRHLPCR

SEQ ID NO: 1022241 - protein, 292 aa, Homo sapiens
AERDYRPPRRRRRELSLRRVCLGGADRSALRRPVRPQPPPRRGGDGLARAQRRSGRGLGPPSQRVRRSSAGRWVGAGRRAPGSDGPSRAAAPLRRRLGDMQEHWGLPCCWCWTHGWSWAGPAALLDLCAIFACLDLASCNKVLCWTVGNLAPAQTGVLVACLRKPSFYLVQLNCGANIYTHWCWALAGAFLGACVPNVTIALVVKLGKDGLAGEAHIAWPALHPLQAPCSITSLCATKVGMRCVRPGSSPWTCVGVCLVNTLGALPIIHCTLACMPGCAGAWWATCVVGFAG

SEQ ID NO: 1022242 - protein, 108 aa, Homo sapiens
RRGTTGHRGAAAASCPCGASALAEPTAVRSGVRCVPSLRPGAGATDSRVRSCRSGRGLGPPSQRVRRSSAGRWVGAGRRAPGSDGPSRAAAPLRRRLGDMQEKGMKER

SEQ ID NO: 1022243 - protein, 66 aa, Homo sapiens
MPVKHVNNNGVGNKCDLTTKSSSDYNNQRQEFADSLEFRFGNQCKNATTVEQSFMTTGREIKSDWS

SEQ ID NO: 1022244 - protein, 102 aa, Homo sapiens
MALAPSSCHYIAHYRHQPQGPEGKPGLSHCYLRGPGHSARLWGREGMRPSGMRQTGPGPQFSLLHIGTNAGHRCEWEWECFAKLGSATHAAALAVAVGSSVP

SEQ ID NO: 1022245 - protein, 69 aa, Homo sapiens
KRTWGMYNFSPFLVKKRQRKATWAERNTGVHQAPRPRLTSSATPRYWVTSLHSELQTWPERSQLPHVRW

SEQ ID NO: 1022246 - protein, 102 aa, Homo sapiens
MSLLACRCACSWSRGPGATRLGLFCVSTPQPRHTFYAGPRLSASASSKELLMKLRRKTVLLLCKLQESSGDLWRWTSNSAEIWLHKEAQKGRCWQLKTAIAP

SEQ ID NO: 1022247 - protein, 1056 aa, Homo sapiens
MDDKASVGKISVSSDSVSTLNSEDFVLVSRQGDETPSTNNGSDDEKTGLKIVGNGSEQQLQKELADVLMDPPMDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLESESERERRKTTASPSVRLPQSGSQSSVIPSPPEDDEEEDNDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNVVHLP

SEQ ID NO: 1022248 - protein, 997 aa, Homo sapiens
MDDQPGEKELVKRSQLDGEGDGPLSNQLSASSTINPVPLVGLQKPEMSLPVKPGQGDSEASSPFTPVADEDSVVFSKLTYLGCASVNAPRSEVEALRMMSILRSQCQISLDVTLSVPNVSEGIVRLLDPQTNTEIANYPIYKILFCVRGHDGTPESDCFAFTESHYNAELFRIHVFRCEIQEAVSRILYSFATAFRRSAKQTPLSATAAPQTPDSDIFTFSVSLEIKEDDGKGYFSAVPKDKDRQCFKLRQGIDKKIVIYVQQTTNKELAIERCFGLLLSPGKDVRNSDMHLLDLESMGKSSDGKSYVITGSWNPKSPHFQVVNEETPKDKVLFMTTAVDLVITEVQEPVRFLLETKVRVCSPNERLFWPFSKRSTTENFFLKLKQIKQRERKNNTDTLYEVVCLESESERERRKTTASPSVRLPQSGSQSSVIPSPPEDDEEEDNDEPLLSGSGDVSKECAEKILETWGELLSKWHLNLNVRPKQLSSLVRNGVPEALRGEVWQLLAGCHNNDHLVEKYRILITKESPQDSAITRDINRTFPAHDYFKDTGGDGQDSLYKICKAYSVYDEEIGYCQGQSFLAAVLLLHMPEEQAFSVLVKIMFDYGLRELFKQNFEDLHCKFYQLERLMQEYIPDLYNHFLDISLEAHMYASQWFLTLFTAKFPLYMVFHIIDLLLCEGISVIFNVALGLLKTSKDDLLLTDFEGALKFFRVQLPKRYRSEENAKKLMELACNMKISQKKLKKYEKEYHTMREQQAQQEDPIERFERENRRLQEANMRLEQENDDLAHELVTSKIALRKDLDNAEEKADALNKELLMTKQKLIDAEEEKRRLEEESAQLKEMCRRELDKAESEIKKNSSIIGDYKQICSQLSERLEKQQTANKVEIEKIRQKVDDCERCREFFNKEGRVKGISSTKEVLDEDTDEEKETLKNQLREMELELAQTKLQLVEAECKIQDLEHHLGLALNEVQAAKKTWFNRTLSSIKTATGVQGKETC

SEQ ID NO: 1022249 - protein, 219 aa, Homo sapiens
MEYLSAFNPNGLLRSVSTVSSELSRRVWNSAPPPQRPFRVCDHKRTVRKGLTAASLQELLDKVLETLLLRGVLTLVLEEDGTAVDSEDFFQLLEDDTCLMVLEQGQSWSPKSGMLSYGLGREKPKHSKDIARITFDVYKQNPRDLFGSLNVKATFYGLYSMSCDFQGVGPKRVLRELLRWTSSLLQGLGHMLLGISSTLRHVVEGADRWQWHGQRHLHS

SEQ ID NO: 1022250 - protein, 133 aa, Homo sapiens
PPGVVAEEERAPMAVLLETTLGDVVIDLYTEEGPRACSAIFLQTVQNTQYYTLCALIHNATEAHFHPYQQWRSYSALAVEENRIFGNCMVIRQAFVRQKKSRELSTRRTASVHGELMAVINMDLSFLSPQEKI

SEQ ID NO: 1022251 - protein, 202 aa, Homo sapiens
QASRRAVRSPSSSAQPAACGGVRRRQASASSSVSRCGRRSSLHPPPRPPLASLLPLPELRRCPGHARTLLQEQRKTPRWAAEPTFRLAAPDPASRPAACGTQGARLSLPGGLGPASSCRLRARNPAFAFGTLQAEKIWLRRLTQTPGAHAVYTQDGGFYGNPRTNMELCSGVLPKNILQKAANSGKNEPNGDTLGGATVLPQ

SEQ ID NO: 1022252 - protein, 156 aa, Homo sapiens
QASRRAVRSPSSSAQPAACGGVRRRQASASSSVSRCGRRSSLHPPPRPPLASLLPLPELRRCPGHARTLLQEQRKTPRWAAEPTFRLAAPDPASRPAACGTQGARLSLPGGLGPASSCRLRARNPAFAFGTLQGPEKEPLKVNSTPLAKRELQSGK

SEQ ID NO: 1022253 - protein, 697 aa, Homo sapiens
GTRAGRSDVLPVAGGEVRALQEGGCGDKMKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 1022254 - protein, 669 aa, Homo sapiens
MKIFVGNVDGADTTPEELAALFAPYGTVMSCAVMKQFAFVHMRENAGALRAIEALHGHELRPGRALVVEMSRPRPLNTWKIFVGNVSAACTSQELRSLFERRGRVIECDVVKDYAFVHMEKEADAKAAIAQLNGKEVKGKRINVELSTKGQKKGPGLAVQSGDKTKKPGAGDTAFPGTGGFSATFDYQQAFGNSTGGFDGQARQPTPPFFGRDRSPLRRSPPRASYVAPLTAQPATYRAQPSVSLGAAYRAQPSASLGVGYRTQPMTAQAASYRAQPSVSLGAPYRGQLASPSSQSAAASSLGPYGGAQPSASALSSYGGQAAAASSLNSYGAQGSSLASYGNQPSSYGAQAASSYGVRAAASSYNTQGAASSLGSYGAQAASYGAQSAASSLAYGAQAASYNAQPSASYNAQSAPYAAQQAASYSSQPAAYVAQPATAAAYASQPAAYAAQATTPMAGSYGAQPVVQTQLNSYGAQASMGLSGSYGAQSAAAATGSYGAAAAYGAQPSATLAAPYRTQSSASLAASYAAQQHPQAAASYRGQPGNAYDGAGQPSAAYLSMSQGAVANANSTPPPYERTRLSPPRASYDDPYKKAVAMSKRYGSDRRLAELSDYRRLSESQLSFRRSPTKSSLDYRRLPDAHSDYARYSGSYNDYLRAAQMHSGYQRRM

SEQ ID NO: 1022255 - protein, 179 aa, Homo sapiens
MFVKTVDALTHSWTFPWVPFSTNVASDVLSIGTIGTYSVDLLLCSRMIAYIPFCLVQPPYGECLRCPLTDVLAFPMHLACLSLALVVVWGGCSPVSRHLVSGTVPVILGVRATRSPLSRSLSEHFPSIPSCQFLWSMWLSPASLMPLLVALVEDACPGMSQHHVAREPHCQPLLDLFPT

SEQ ID NO: 1022256 - protein, 179 aa, Homo sapiens; identical to SEQ ID NO: 1022255

SEQ ID NO: 1022257 - protein, 207 aa, Homo sapiens
MLSLLIALKQKKPWNSTCDALTFECKCSFLAALAGGVPCCLLAIAAELHKTRRASETVRDRSWGRGVQHASGLSRPGRSTCPWNKADYLHTLERGRTRMGALTDSRQGRKLTKTHRYRDYQSGLRTYGTRDSGERQARAVEAHHVTVKGNTKHTGSRAPRQVTRKGAPVQAAGRATPLDRTPGRLEGATKREREGREHVTRRKCEAP

SEQ ID NO: 1022258 - protein, 321 aa, Homo sapiens
MRVKCSPGGPVETLSPETVSGGLTGSARHPVTSTLPVLEVTTAPLPLPFSHLFTRSHRHALLPLRKTGLTLRIESLHHGELEQLNAELGLEPETTPKPPDAPPLGPDHPCSGTVQTKKLRPWQSHEPAVEEGAARTVGASLARSELDSSFANTLGWGNCVGKLAVDGSYSTPLALTALDCCPGHGAVPCAIGQASQMRKLIYHDALEECEQALGEVFTTRLALGSPDTSSYTRSHYAQRLIGLAPTKPHIIRTAAPRRRTQGAQASTTQARPGPHGDAARRENHTHCTPHGQAPAPADKEGGPTPRGPSHHQTPADKAGPV

SEQ ID NO: 1022259 - protein, 375 aa, Homo sapiens
MWAFSELPMPLLINLIVSLLEICRPQVTLIPGLPGATSLACSAICRSVTINKTSTDSMIPRIPGSDSAVLYIHYHPSSAFIPFPFLNCFVTGAVYRHSPNHDFVALISVPSLPSACTDLPEAFADDVLNLRWRHKLLQYLQLTSTYLSSWSISPNLGHHDIDGAPRPSDRSLGPASRTCGILCTIVSTWGAWPVFLEPLPITVSISNALNSAYKRGQTTHPLHDNNQETFNLAKLTTHITQTTNLSTHHTYYIPTTLHTPYSICHNTKLKSRLADALRMLQTLLGCRSRRSRLIEEGEKKAKHIAECSDVTNRQAESRMLIRARKNNTSAALAARRRCSSENQIYPHTTIHNITTPAMHEESSLRLCRFLLVVAQ

SEQ ID NO: 1022260 - protein, 236 aa, Homo sapiens
MPELDGGCPARRGLRTNGSALHLRALGMLLALPGPWARVAALEDSVGSSSVTVVLLLLLAPTAGHWPSTGLAPASAVTQGATTTLARLGAALWGRTRRLASGPGPPGLLACRPGAEAGVHRQMTLSDKEDEQGHRAMTTSRDGGLEGLTLGECASSNVERRSKPKKQSSPVRGLRKARRQVTLGGATWSFGSPGPASAGGSAEALLSDLHAFAGSAALGYSARHLGASASMSRDCR

SEQ ID NO: 1022261 - protein, 102 aa, Homo sapiens
MMRGVECSRSVSLSLLCSYILALVLVVSFLISPPCVYYFCFRLCSFLPIRSVCFVPRALPVCVLSVLDLSVPRPCIMIFIGLFLPRPYSGIPRCRGKLGELY

SEQ ID NO: 1022262 - protein, 145 aa, Homo sapiens
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNSLPARSGPQTRSSTTGRSPSLTT

SEQ ID NO: 1022263 - protein, 84 aa, Homo sapiens
CVSRWHRVVSEGHTLENCCYQSKSAGVCRLLGVHLHLLWAQSACVVLSPERSYILEQRPGDLQGSSHYFANPRSPPVQGTPVSL

SEQ ID NO: 1022264 - protein, 168 aa, Homo sapiens
MEQEQIIFKYLFFKGSEIKLSILCGHEGERTLLIKRPEVVSTMASTLYFSVKIICTVSRTSHCCSMSSQQQKQPCIPPPQLQQQQVKQPSSLHLRNLCIPKTKEPCHPKVPEPCHPKLPEPCQPKFQSHEPKVLEPCPSIVTPAPAQQKDEQKYVVTAMPLGSRHQML

SEQ ID NO: 1022265 - protein, 93 aa, Homo sapiens
MSRHSRCEQRSSYEAILQANRQPGNLYNPTQTPRPTNTYFGSDIHDPRVVNKDGYQECHSLSQTCLFDYRVPVLVILTHLHPLFVEKLALFWN

SEQ ID NO: 1022266 - protein, 73 aa, Homo sapiens
IRGLKLGAIAEMRKIAASRNFSFCIAHRAKPIYVALLATRLQVIGVHHAFGDLLVILTHLHPLFVEKLALFWN

SEQ ID NO: 1022267 - protein, 313 aa, Homo sapiens
GGVTVWAASWGGRGRPAARRRPRGLAATMGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHKGAPGPLGALHKALKKEALRAGKREKSLVAQLAAAQFELQMTALGYQKKFTEYSARLESLSRWRWPRRPAAQGEETKRLILSARDPGSWDSYYWWRPSVDNYDGYSVKNLCIIVEV

SEQ ID NO: 1022268 - protein, 297 aa, Homo sapiens
MCAQRVTDTPEVKWQKVLYERQPFPDNYVDQRFLEELRKNIYARKYQYWAVVFESSVVIQQLCSVCVFVVIWWYMDEGLLAPQWLFGTGLASSLVGYVLFDLIDGGDGRKKSGRTRWADLKSTLVFITFTYGFSPVLKTLTESVSTDTIYAMAVFMLLGHLIFFDYGANAAIVSSTLSLNMAIFASVCLASRLPRSLHAFIMVTFAIQIFALWPMLQKKLKAYTPRSYVGVTLLFAFSAFGGLLSISAVGAILFALLLFSISCLCPYYLIHLQLFKENIHGPWDEAEIKEDLSRFLS

SEQ ID NO: 1022269 - protein, 83 aa, Homo sapiens
AYQESTLRAVRLGAVQRVLFVSNHAIKRSVSQCCPNTPVPCPLPLLKEEAASSWAPVLACPAHICIWGDPTRCRRCMAMQCLC

SEQ ID NO: 1022270 - protein, 154 aa, Homo sapiens
SPATSGHRPHPGAGRFRPESESASKPHASQNVRRGRRSVGAAACPCSRTDSNKSVSTSTSHICVNAEACGCAGLARLHSVQTHGLMHAHARAHTHTPNYLRDGESRCGLASRAVTHAQGAGRLRKAVSFFFFPSFSSLYRFHLMGKTTGRALKG

SEQ ID NO: 1022271 - protein, 210 aa, Homo sapiens
MAWPGGTLLLDALGSGGAAEPHVSRRWAAGSPKTGRSWQQTHSGPLTLGGAGDALRPVDQEWLKGTRCCRRSNDGYTIALHWLITYDTRDAAALTGSPASAGGIKGHSHGMRRQQSGWDPEAEETIGDKANRGHERLGGAINVIRGDGDHKTNTVRRTHWQFECTARGYTRATQARLNGGRFGRMRALGESEASRTGTVTDDPVGNSVRP

SEQ ID NO: 1022272 - protein, 399 aa, Homo sapiens
GADDFVCRSSGGLRTRGDPQEIDPLRTPELLQLVTTLLPLDTYVPFLHKLAHCHDECAQRCVMPACSLAAAPCDSQGFALSVGAVCVVPRCASRAPRALCGLCGQFPCGPHRNHSNGLCLQTWPITRGASCKQPGALASRNLNVADGRGGQGARAGQGQLIATAPYPRAQPGDGSVARRLERCCLLSWLSQSLRPTRDWETRRSQRRARNHAIELSRGAPWQPAWHDPAVSNHGTIAGTHFCHAVMAMSPAWVGRDTWHGRALRGLRCRGTATYSIARRGSSGTAAHATPGTHRAGDPADALPSKPDCRLLDQTNPCDTGAPPTALLAQHLARGRTPSARVPCVENTPTVNGHPRPPTGPHTQTRAPGQDRLLSTTYDHTLNQPRHAPSTPNDKTAEPH

SEQ ID NO: 1022273 - protein, 369 aa, Homo sapiens
GADDFVCRSSGGLRTRGDPQEIDPLRTPELLQLVTTLLPLERHIFPFFTRSAAGQHERLEGGAGLALALPPGLPGFALQGAGGGGRLAGILRRGWLWANCPGTPSCQTFARAMLAKSGPVDLLGILERYARTRSRPENSSEVMDEAVMWSGKEGHSTGHAYPGGPRRGRTVGRGTRSDAGHPDVAWSLGPMGALSCWREGRTQGGGGPMQMKRRGGALGCLLGRTLLLRHSWDRLACRICWPSVSVGIASLLGVGAGYPGRAGGLGGTCGVRGGYTLIAHVAVRGRWPPSRSKCAWSLGGPGVTMAGAGWNREGLGSTGGGVWAAYFSQYSGQGPEKPGRSGVGGSRSHWDGVTKGYKGGHGQTGAKPT

SEQ ID NO: 1022274 - protein, 415 aa, Homo sapiens
EREREVAARSARRPEAVARIPPLRRGATTLGVTTPAVSWGDAPSGGGVPCVGEPEGLPPPAKKGLGSLRRGFLPEDPDGAGSSWDPTHCVKSKPWKREAAAAALGRLRYCCEPWLRVEGCVVDRFREGRTEHQYPSSRAEACHVTQGTKSKSRRTAPGAGQGTEGQRDASVARDYCVLLGQRVSTRLLDVTCYVEQGPGEAPGAGLHRSLVHRKRGDDDHTIARPPTHLDPSRPRGMKERRTATIKGAVGGDPAKDHPLIGLALQQGTRRADRMRLRGEIHESIVESARTGGHSVDNHRDLLGERGQGTPWGEDLVRRVPHEGGTPNGGPGGTQEGSTGKKRGGAGGVTPPYGGPNNEKSSDQGRWAQTRTGSDNGEHSYGTVGEPRAPRQVDTIGEGDGRETTERGIATRSKNR

SEQ ID NO: 1022275 - protein, 330 aa, Homo sapiens
EREREVAARSARRPEAVARIPPLRRGATTLGVTTPAVSWGDAPSGGGVPCVGEPEGLPPPAKKGLGSLRRGFLPEDPDGAGSSWDPTHCVKSKPWKREAAAAALGRLRYCCEPWLRVRGLLLSFEGSEEPMTHACLGLTTRVTQWSTVPAVKALGTAKVESSTPVIAVDNAVSLSGTEGPGCNSRQHRAREAPCGWLPVACTPMLGVPPSSPTHGPAPACRSGAAKACGGPQGPLFGGGQGPWPSWLVGSRALGLSVKLSTGSVTGHGCLAALWPVQSTPTWPCQCRGEGLRGYRHGHKRALRAVTARPGPVSSEPGRGALVARGLEGGI

SEQ ID NO: 1022276 - protein, 493 aa, Homo sapiens
MADSKPLRTLDGDPVAVEALLQDVFGIVVDEAILKGTSASEKVCEWKEPEELKQLLDLELQSQGESREQILERCRTVIHYSVKTGHPRFFNQLFSGLDPHALAGRIITESLNTSQYTYEIAPVFVLMEEEVLKKLRALVGWNSGDGVFCPGGSISNMYAMNLARFQRYPDCKQRGLRALPPLALFTSKECHYSITKGAAFLGLGTDSVRVVKADERGRMIPEDLERQIILAEAEGSVPFLVSATSGTTVLGAFDPLDAIADVCQRHGLWFHVDAAWGGSVLLSRTHRHLLDGIQRADSVAWNPHKLLAAGLQCSALLLRDTSNLLKRCHGSQASYLFQQDKFYDVALDTGDKVVQCGRRVDCLKLWLMWKAQGGQGLERRIDQAFALTRYLVEEIKKREGFELVMEPEFVNVCFWFVPPSLRGKKESPDYSQRLSQVAPVLKERMVKKGTMMIGYQPHGTRANFFRMVVANPILAQADIDFLLGELELLGQDL

SEQ ID NO: 1022277 - protein, 472 aa, Homo sapiens
MATKCTKCGPGYSTPLEAMKGPREEIVYLPCIYRNTGTEAPDYLATVDVDPKSPQYSQVIHRLPMPYLKDELHHSGWNTCSSCFGDSTKSRNKLILPGLISSRIYVVDVGSEPRAPKLHKVIEASEIQAKCNVSSLHTSHCLASGEVMVSTLGDLQGNGKGSFVLLDGETFEVKGTWEKPGDAAPMGYDFWYQPRHNVMVSTEWAAPNVFKDGFNPADVEAGLYGSRIFVWDWQRHEIIQTLQMTDGLIPLEIRFLHDPSATQGFVGCALSSNIQRFYKNAEGTWSVEKVIQVPSKKVKGWMLPEMPGLITDILLSLDDRFLYFSNWLHGDIRQYDISNPQKPRLAGQIFLGGSIVRGGSVQVLEDQELTCQPEPLVVKGKRIPGGPQMIQLSLDGKRLYATTSLYSAWDKQFYPDLIREGSMMLQIDVDTVNGGLKLNPNFLVDFGKEPLGPALAHELRYPGGDCSSDIWI

SEQ ID NO: 1022278 - protein, 74 aa, Homo sapiens
MPAWSPEEACLLFKSGMGAVGCECSGAAVENTSCLIERVLETEDGTQPGQPAPGLYRIARCTFLLMGNGVFGHV

SEQ ID NO: 1022279 - protein, 206 aa, Homo sapiens
MEEEEEGGTTDADGSQVQSQGGPTRVVTGHCRAKDPNRDPAQASSQTLNGSSVRTVPATVRPWHNVPHGPVPRIETSFSARYSFCVTVFHPRMSVQAKSHKAQLNAYEASEHARERVTLPVVAPGATVRHKDQDVDPLVFMNGCLMTRKCTSTNTGTHKCKPTDDYVVEPCHSALQHTKGQPDMEPNRELTQTRDRSMRRDHVEHN

SEQ ID NO: 1022280 - protein, 228 aa, Homo sapiens
MLVDYARSRARGVLSARPRPGPPPMHHRGRPRGVTPGLRWLSRDPKPLPCRARAKPVPDLDRLCCPKLELSRRLSPSCSGGKPRGGGPFCGLVTAGSGAAGLGLVAPGAPASSPGPFEIGGISLRENRNLASVTLPKGAEGIAAGTSGPGPSQGRRLRWGQKQAPPISLEKLDRLLAIRINLRLGIASSQGSSRGEGCRGSFPGAWAVSGATQVPAACRLQNFAIIWW

SEQ ID NO: 1022281 - protein, 299 aa, Homo sapiens
TQCLSPALQPQPQCLKATSQREHVAFSNSRADFLRAPSPSLSDEAEEPCLGSLPSSEDGLESSAGVDSPYAPTAGSALPTLADAQQHNTVVRQDATDELPAPVRWHNTKGWSSLPYSTPLCQTTSGQETEKAGSLVADCALRIFLAKLIVLQHTVGSTIRRFPSFSGNHFLFSGLQKAGKASSTSFGYAPAAWELTADLSGSPPDAGGTLEWSPKLAAPPVPFGQPCLVRGSPISLILIEAPRFYDCACRRVNTLGITLSWGTPRDPVNVDTTWPFFGPDYLYSFLQGGYTAVSTSLAL

SEQ ID NO: 1022282 - protein, 281 aa, Homo sapiens
REKPLRLGRGLVYRTRGQADDSLKNLHLELTESCLDMMARYVFSNFTAVPKRSPVGEFLLAGGRTKTWLVGNKLVSVTTSVGTGTRSLLGLDSGELHVRPGVRRSQPRGACVDSTIGGCRAKLVVPGWAARCPAGGPVDRVRSMSVGAMVFEFGALDVPGLPVPVELWLLLQDHWTAPVARNLRRPQLAPGFLCRRRLNPGGLCAPADPGLGGDPGPGGATWEDQLVLMSLENPLSPFSSDNQTNIAPAGSLSKALMAVERFKGGTGTQALLPVTCRCRQA

SEQ ID NO: 1022283 - protein, 53 aa, Homo sapiens
MTALTETALTETALTETALTETALTETALTETALTETALTETAQTALTETALT

SEQ ID NO: 1022284 - protein, 99 aa, Homo sapiens
DPPIHPSILPSFFHPPTHPSLHSPSIHPSEDQLPSHLSTSVCPTLLHKHEEWPWDPRDRSYRDRSYRDRSYRDRSYRDRSYRDRSYRDRSYRDRSDRSY

SEQ ID NO: 1022285 - protein, 183 aa, Homo sapiens
MVKEWKCRNQPPFKKKKIQKADKSWEYGKGPMMTPTRGSLGLEGWGVSGLRTSISISPGHRLWPDPLSSAPFWVPLPQLPPGTGALPFHLLLVSQPSPGAVGPAHEPWHPAWGGEVPGQSPRNSGGAMGLLAKHLADWPCPVWASSGWLLVRDGLTPSSSRVTQQGWGGCGTLELEDSGEAGL

SEQ ID NO: 1022286 - protein, 177 aa, Homo sapiens
MPRTLVHFWVMSLCMDAECSYCSWYYALSAMLIAGCIQQLHRVTAGPRRSGADGIRGLSLNADRYALTGAVEARAPPQQKNGRAHGDGDAGNRKRRRQVKEPRPWVHRVQGKAGRADNGGRTEETYGQAMELKGTEDNGPMTQTQRLARGLYLAGPQSQEAGETKVRTSTEHRHTQW

SEQ ID NO: 1022287 - protein, 68 aa, Homo sapiens
MQKDVNNGECFRADHLLKAHLQKLMSDKKSSVEKKSEMESVVAQLDNYGQQELADLFVNYNVKSPITG

SEQ ID NO: 1022288 - protein, 151 aa, Homo sapiens
PPPHRISRREPAPPAPIVGGNKGRSGPLPPVPLGIAPSPTRPRGPPAPGRGGSSKHIPLQLLTSGPLAPLHPWSCWATNCINSGNNGNYSQAPGELDQPSPNSPPALVPAGAWAPRWGSGSAFGIKSGREFQLNKDPGGPRRGQELEATTQ

SEQ ID NO: 1022289 - protein, 342 aa, Homo sapiens
MAKPGCAPIRSPIKAWTGSACCGPGWSDDSSRRFDAGTGFRLVGLSDSSSVAILIGDTFESSTTLTMNGPDPYLTSCEDMVDRYKLTLLVGRYVAMVWEGLNVVKTGRVMLWGDQSSRFKVQGTIRGDVSCIQVGRKHHSWHVHSVKSADAEISLWFKPEELVDYKSVLMTRVYEEEVDTTAVSFSIGVVESLDTALHSIDLEATGLIILFIDALIGTTNSVLDSREQDLTQGASPFKRYHYERNPNIIGYHRVSCYQMCHNSTPYSKAPRPWPRRYHPVSDLVTQRMHGKNFESGTLISSGRTICAQTTPRNIKHYKNTYPSDAGYTGYTLTTNISIITSD

SEQ ID NO: 1022290 - protein, 99 aa, Homo sapiens
CWVLSGVVFAGLVKYMNSGRYVAMVWEGLNVVKTGRVMLWGDQSSRFKVQGTIRGDVSCIQVGRKHHSWHVHSVKSADAEISLWFKPEELVDYKSCAHD

SEQ ID NO: 1022291 - protein, 177 aa, Homo sapiens
MAAMASLGALALLLLSSLSRCSAEACLEPPDQPLSYYTTSDAVISTETLFHMWEISLTFKNRVQNMALYARLSVENNSLSLWGQDVGRYHGVLAAWTTRAPTQCTYEVSEFFDEESYSPPHGRLRVNNEDISIIPPLFDRSSVDHRGTCETGPGCPLTCAGCACIGLVIYYLAFRCE

SEQ ID NO: 1022292 - protein, 306 aa, Homo sapiens
GLRCARRTSEAAGSGAGPPGPLQWPQRQQLGPPPRPADRRTQEVGPGVTPPPGRPAAMNLQRGEPYPSSDHRAVVVQRTVTTLTEDPHPMAIKVFPKRGGPHRPPGHHRRALRGPPYAGGLFRSETPCCGKDFPRFPTPRANFLTKYLPTPELVGRQIGEICVKRGSRGDWHRPEPGAIRPLYWLNPSMCLFVSTLNPEFCTQRGRRAACSLENLRGVLQARGPSASQIIHGGPPGGPAAGPEAGVPASGISFSTTWARGPEEAGGSTWRNLVERKRVGADKRESGAGGEWAVLFPDAVFCSLNCF

SEQ ID NO: 1022293 - protein, 218 aa, Homo sapiens
MWPPSGAVRNLALVLARSQRARTCSGVERVSYTQGQSPEPRTREYFYYVDHQGQLFLDDSKMKNFITCFKDLQFLVTFFSRLRPNHSGRYEASFPFLSLCGRERNFLRCEDRPVVFTHLLASDSESPRLSYCGGGEALAIPFEPARLLPLAANGRLYHPAPERAGGVGLVRSALAFELSACFEYGPSSPTVPSHVHWQGRRIALTMDLAPLLPAAPPP

SEQ ID NO: 1022294 - protein, 145 aa, Homo sapiens
MLSVRHRLGADGGDGAPGVLKPGNPLPPGVDLHDAEHRARLVCSKHEGDGIARHTKVWTLRTKSLRTEAFQSPVPRVRRHNTHTVNTHNMRPDGLPRGVHIRGAGFRIHGRAIRDTLTGPEQKTQARLVGHLDAQYARYRLGALG

SEQ ID NO: 1022295 - protein, 35 aa, Homo sapiens
MAFRSRYLNIEILSTTYNDLVNGGTVAPMDLLLIT

SEQ ID NO: 1022296 - protein, 207 aa, Homo sapiens
RPRMETPPQPCGKRARPKECRKTRQAARQTPSKKMSTEQGDASHHELRGNAFYNNNAYFALDAYNKGCRAARSYEAVAAAAASVYNYAEQTLSQLPQVQKTAMASHLTSTSLDPYDRHLLPTSGAAAHQVLLQQQLLLLLQLPLHITGGIGAPCFALQPQSPLLERATVTGMRVSCPKLQQPRGILCTTWPGMEREQYADRARNSAF

SEQ ID NO: 1022297 - protein, 257 aa, Homo sapiens
MSRSSGPVMLRGPWLPALCSFSCCCSRARLSPAAPPGRGREPTSRARPGPGRASSCLQEQLMGGGVPSPSVYWTASSACQVCGPMTCDGGTRSAMPPGPLGLAPSSVGPSGYLDLLTTWYCSFNRLAALEWDCRISKQFYMEQLDEARSGRCSSSATRAWSSSMKRRSCTQAAWRSLCHTLERRAPEWPQGLSLHGLSYCISGTLQDMEKALESMPLGWGEGVSRREGLQEDPGVLPLQPHDKVKSQGGDIINEVES

SEQ ID NO: 1022298 - protein, 357 aa, Homo sapiens
MSRSSGPVMLRGPWLPALCSFSCCCSRARLSPAAPPGRGREPTSRARPGPGRASSCLQEQLMGGGVPSPSVYWTASSACQVCGPMTCDGGTRSAMPPGPLGLAPSSVGPSGYLDLLTTWYCSFKDCCPRVGLQNLQATLTGLEWDLNVRLKLAQNLCVPGSLVLRNSEGLLRDAPCQEKALALSSTDWSGTGKELRVATDAGGRTLYSGNGADELTVVSRDVNRHVPLSSPQICGTLYKDMEQLDEARSGRCSSSATRAWSSSMKRRSCTQAAWRSLCHTLERRAPEWPQGLSLHGLSYCISGTLQDMEKALESMPLGWGEGVSRREGLQEDPGVLPLQPHDKVKSQGGDIINEVES

SEQ ID NO: 1022299 - protein, 254 aa, Homo sapiens
RKGGSWRPEEGVGAGEDGGSEAGTASWRCPVARRESSEKPNAEDMTSKDYYFDSYAHFGIHEEMLKDEVGTLTYRNSMFHNRHLFNGTRVVCLDVGSGHRHPLHCFAAKARGPAKVNRDRVFQYISRLMRVERSLKGPNKVRPRGVTIIKADTGWQGRWEASQLAEVCGPSSSASGWATCLFYESMLNTVLYARDKWLAPDGLIFPERATLYVTAIEDRQYKDYKIHWWENVYGFDMSCIKIVAIKEPYVDVVD

SEQ ID NO: 1022300 - protein, 228 aa, Homo sapiens
MAAKVFESIGKFGLALAVAGGVVNSALYNVDAGHRAVIFDRFRGVQGHCGRGRDSFFSSPWGYQKTNYLWIARVSTCNGAQSSHVVAKIYRNVNITLRHPLPAVSPASFLASSPASERTMMSVCCRPSQLRSSSHVVARFDAGELITQRELVSRQVSDDLTERAGTFGLILDDVSLTHLTFGKEFTEAVEAKQVAQQEAERARLWWKRLSNRQRRPSSLLRATPRQLS

SEQ ID NO: 1022301 - protein, 115 aa, Homo sapiens
MERHGRQLGRREQDRTTDSSNCLLEQTGRQLEEEPMYLLGSRTPLDSILAAAVLQVSKMGGRCLYFIFLRWGGIGNREQMCKTRWEGQSVRKEQAVAAGVGEQSPSPRGKSPDGR

SEQ ID NO: 1022302 - protein, 69 aa, Homo sapiens
DPRFAMAMSSGGSGGGVPEQEDSVLFRRGTGQSDDSDIWDDTALIKAYDKAVASFKHALKNGDICESFG

SEQ ID NO: 1022303 - protein, 316 aa, Homo sapiens
MLGPEGGEGFVVKLRGLPWSCSVEDVQNFLSDCTIHDGAAGVHFIYTREGRQSGEAFVELGSEDDVKMALKKDRESMGHRYIEVFKSHRTENGLGVEAQWSQQCRQGQQMASCRLRGLPFGCTKEEMCSSSQGGNCGTTGSTLPVDPERQRLQGKRRAVSLARKKAEKALGKHKERIGAPGTICGLFKTQQAGQQVITQIPSLKFMSWSKRARAPNDRGRGLPVGYHGAFGEARARAVKGNEACAYMHEGYGGYEGKLQVPSGWLRVQQPDWSGGDLNGLLGMVWTPGLRRQYSHLVGTTKGIGPLRSAAKDREDI

SEQ ID NO: 1022304 - protein, 313 aa, Homo sapiens
GVCEGRRCLFLPFNSGLNPAGTLWNYGNNILQEKVTLPKPGAQYSQDLNKEEQTKLSTSDFLTTFRNFQACWPQHSGTPPPTRNNIIIVIILHIYIYPYTKLSNVITTNVQEHLHPVPKTHVAPDSQLLDQKAPASLARPHQSSIIIQHRQCTEHRFLASSNTETLTSPCHSSAFPATPQQHCWLQPKATRVTTHLITVPSKLPQDPYYHHRLITLAVKSYRNGYHLSADLQWQTYQCNARKGNCKRRSQELPEYCTFTGIIAAFVYELAQHSHMFRQPFIIRELGHTLVEVRTCRHQLRGYHPTPRGQSAYT

SEQ ID NO: 1022305 - protein, 135 aa, Homo sapiens
MIVSEKGLHSLIFEAESELQMQGLMHVSPRIEQEKPPFTVQLDVLAKEHNKSTNVLSTNHRANKEFQREIQLKLECQISAIPPPKLLLEKEHHSEHRYNSSTDRISLYQDNTGRVTLLIKDVNKKDAGVVYCVSS

SEQ ID NO: 1022306 - protein, 49 aa, Homo sapiens
MSTRRTAKASLHGGCLQFPSDCYGICPNTNNLVIAHSDQQVFEYSIPDK

SEQ ID NO: 1022307 - protein, 38 aa, Homo sapiens
MVNDGVEDLRCKYISLIYTNYEAGQDDYLKALPGQLKP

SEQ ID NO: 1022308 - protein, 408 aa, Homo sapiens
CESSNTRLVEAGVNREGLVVLSRLLAARGGRRFLGHLLAWPVRRLRASLLRSRFAGREEGLGRPVPSPSEPQVCAADPSQGEMSADAACRGLPLPLALLPGEGSERLRLPPARGEGQVGPVHPAWWSPARRPRRRRLLAGDRLVEVNGENVEKETQPAGGEAASAAALNAVRLRGGRPLRRTEQLQKLGCPGPRGAACAPRKRRGRPKPAGRRRGCMGGMATKIEASRGPTRATRSSGELRPRALYHEEGAPVAMASICTATMSNASAISSWSVDPDSPAEASGAPVAQDRIVEVNGVCIGGESRWGTVVSASGWRVTRTKLVVVDRETDEFFQNMQSDPTLQEHLIGPCLFLHQMRRYSKENEEVNALRGGLAEAQAKPCNIGFMTQESFIPDGPKRHQCLVTLLDR

SEQ ID NO: 1022309 - protein, 186 aa, Homo sapiens
MEPPRGPPVSGAEPSRAVGTVKVYLPNKQRTVVTVREGMSVYDSLDKALKVRGLNQDCCVVYRLIKGRKTVTAWDTAIAPLDGEELIVEVLEDVPLTMHNFVRKTFFSLAFCDFCLKFLFHGFRCQTCGYKFHQHCSSKVPTVCVDMSTNRRQFYHSIQDLSGGSRQQEAPSNLSVNELLTPQGPR

SEQ ID NO: 1022310 - protein, 143 aa, Homo sapiens
MTDLKVKRRLLAGDVKNQGSTNCTKETQLPSSSHKNALPNKLSLQSACPSSDELNKGGRSASYGPFYLEYSLLAEFTLVVKQKLPGVYVQPSYRSALMWLEYYSYGMDFTKMAVFKVYQLYIPDNYPDGDCPRWVFDIPVFTR

SEQ ID NO: 1022311 - protein, 143 aa, Homo sapiens
MTDLKVKRRLLAGDVKNQGSTNCTKETQLPSSSHKNALPNKLSLQSACPSSDELNKWGRSASYGPFYLEYSLLAEFTLVVKQKLPGVYVQPSYRSALMWLEYYSYGMDFTKMAVFKVYQLYIPDNYPDGDCPRWVFDIPVFTR

SEQ ID NO: 1022312 - protein, 132 aa, Homo sapiens
MRARYEAACLPLPSLTGGHGGHPMQHNPNGPPHPLDAATTTTDEPGPPPSWAPWPSSNDQYLGKYCLWALGVYRLHQGKGMMPPPPMGMMPPPPPPPSGQPPPYPSDALCLMGITVGGASANASVQQQYGFQ

SEQ ID NO: 1022313 - protein, 285 aa, Homo sapiens
MLFFFFFGKRFGLFVSPVGVAGDDLNSQLTGEPPASRDIPGLSLRGSGDYKHPTEAQLILGFRVETGFHHVGQASLELMTSSDPPIRSPKVRGITGMSQRRRAPKVLLNRKPRDGRMLTELLLNVCGGNVCHVRGSVSLAYYKGIRATRGWGVARGENPSCCDLSDPACRLCAPVAMFDALKFLICRGGNDTHSTGVGSFTVGRSSHNTHTHTKKNKRAPLNIRGTIATFCNGHKEILKTAPRNIAGTARLGTLLVSGTPTPEKSWPLAFCDTSYPLCAPASLHT

SEQ ID NO: 1022314 - protein, 123 aa, Homo sapiens
PRGRMTVSNVSVPGLCLQNARGLRGNLSEGVLIFSATFRSPQGMRFLLKPADLALVLYHAGTGLLNSLLDTVPVRSSVDELDGIDYSLMKDPVAFTSNLDMDFRGAFFSLTERDWSLPNRAVE

SEQ ID NO: 1022315 - protein, 113 aa, Homo sapiens
TWEKSSFSLLFYKLHILILSCGNICQLTPGSQNLMPRSRLVGPSQACAPHAPLCATPALESELSCGALGPLGFLSMSCSLMASSELFLLLPSVTPPTLSVWAWDRTRLHIPPV

SEQ ID NO: 1022316 - protein, 223 aa, Homo sapiens
MKFEVATNSIKAEEIVVNHKREPVSSLFCNLEEKFSSKDRSGGGPRWETQIIIKRFLGTVFQPYSLDQECNYLQIKMPTDHEEPCGPSHKSFCLNGGLCYVIPTIPSPFVGALKTIQELVVKRFFSQAPASKLKVTCLKLCGMAVLVTLIIGAFYFLCREKATFRRSQFKASIDITWVEKRQYQWPTTVMNNTEETSSGTNIIVFILPKAENGDTTKSKNYTI

SEQ ID NO: 1022317 - protein, 216 aa, Homo sapiens
LPSVGVSCGGGGAGGRAGVRRDRLDAQRRAAREPMELLAPGAPGARGRGWASHRNRHGDLWLRGSLGLWAYGTPAELGGLGGTLETLPFKRGGLAIDPGGRRDYAFGGVVGSIIPTRCPGNVRDAATHDAYTLARSDNAPVAGRRSERGEAPPGRRRGPRDNWTAGGEQGRRANGGNDRHGHLEGTWLGTTYLDGPRNYGPRDHEHADREEVADED

SEQ ID NO: 1022318 - protein, 246 aa, Homo sapiens
LPSVGVSCGGGGAGGRAGVRRDRLDAQRRAAREPMELLAPVWPGVEARPVAAAQHEMGCRLSEHVLPVVLRVPTVPRAHRCQCLPFLAVGGRPYFPWCLVARCRGTGGGRGRPHWESPESLTQGAPGALGELHRDGRVPDFQIQPSASLDTHRESSPTRESPAANRGLRALYVPLACLVASVQRSCFSHGNAVDLGQMSSFYIGLGSRIQCNIFSYRILRLRCSSGRPSERNLYADIDAAGRPAHQ

SEQ ID NO: 1022319 - protein, 47 aa, Homo sapiens
VTGGRSSPIMYILATNGVIHYIDELLIPDSAKTLFELAAESDVSTAC

SEQ ID NO: 1022320 - protein, 301 aa, Homo sapiens
LNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNSM

SEQ ID NO: 1022321 - protein, 215 aa, Homo sapiens
MASGTASRSEDEESLAGQKRASSQALGTIPKRRSSSRFIKRKKFDDELVESSLAKSSTRAKGASGVEQGAVRGVKPSSSEKKKVSKAPSISCATQPRPQTPTKSVKKNTTTFSEPGALGTQRTGSSCVADQRPDSVHLGVKFSCRFTLREVQERWLPLRSCSSPLACQAMAAAQYCHPRPCFSAEEQLLEQSGDRPASPPCETFQDLLHRHPDAF

SEQ ID NO: 1022322 - protein, 201 aa, Homo sapiens
NSQRLDFMYTEIISKPSKREMKSFRLGEGVQALGLKYTVEVMDIIDEKIYKSDLVSCKPGRVTPGSSLCSLALDCDCAWILPLRLHLCAFPARLVSGSGGFKATRFHFFLVGGALLDRGGGVRRLSDADWRASFVLSPSDVVHGCLYDSLSIISVEGLASSHCGLVLDVSRRAMREGADMPLYHRIVQVVGRFAPQVEHVK

SEQ ID NO: 1022323 - protein, 361 aa, Homo sapiens
WALRRHLCVLDAAIRLDNAYGLCDFPATPPAEEQQGLVSAQLLWRTRAPSTPEAIEQIKQIKKDLKKYSKIFDSRRIALELSSIKSSEECNLVRMYEARIHAWKISGEYRKDGPYGSLYSWMPEQHERLELRGGVDTDKLRQQRWTYWCTEETGLSFFVDCRDSLIPLVCTHGVTWEHLWGRTPPAVPALSYRTPECEPRFLCCGAAVCAVGAEVRPAGSRVTPGSSLCSLALDCDCAWILPLRLHLCAFPARLVSGSGGFKATRFHFFLVGGALLDRGGGVRRLSDADWRASFVLSPSDVVHGCLYDSLSIISVEGLASSHCGLVLDVSRRAMREGADMPLYHRIVQVVGRFAPQVEHVK

SEQ ID NO: 1022324 - protein, 305 aa, Homo sapiens
AAAVASGGAGRTDRRTEGARGARPPGPAMEGASFGAGLLQGPPWTPVSFSAAAPDPAPGRVLGVLHRRLRGPSSNEGYVNTDSGPELRCVFNGRRGRLPLLAFALGLGAFLRLQPPSLLLDVRFPANAGAGTTTPPRPKLGILALYPSHVPEGSRPSRSVIVGASRRSTLSLLSTGCKQPSLSVCKPRPRLRGHLLRSQKGVPLSGGPGPAHGGWPGTEGTVPVARHTACPSTSARPCQERTIMGARAQAIKDTHGTCTPQMAVCTLDAAAHTVRPPAPTQHSQGNTRHTRKRRTIAPRSRRTAS

SEQ ID NO: 1022325 - protein, 315 aa, Homo sapiens
QRQRPRAGRPDGQADRRRQGRASARAAMEGASFGAGLLQGPPWTPVSFCAAAPDPAPGRVLGVLHRRLRAPSSNEGYVNTDSGPELSLRVHRETLGACRFWRSRWASEPSFACAAFLLLDVRFQSDQQRPRLAGRAVLLDLGFSGLWSFLWFGGFCFLTNQWQLTVPMGRSRIAWPGDACVVACHRLQQFFSILSWVALTVYRPCSRFRLGTDMSLVRPPKQLEHRGEPGLSRVSGGQRRGGHRRLPEARLHRDLGHSPKGFTKVPAYLAAGSAQTSGSKGNPTSKAQGLRNSLWAFSSNARDQSEVAALAIRGQ

SEQ ID NO: 1022326 - protein, 247 aa, Homo sapiens
VVPAGRNIRFSPVNLPESLGDDAYNDGCTPEIQVVKATQKGFRCMVPKPMTAMIGGQPLGGADYVEVDVPDLVTNVLAVDTTDRATGQCPLSHRIAADWRHKMTSCTLIYVAGDVMTMRRRLGAAAVAVALVECGFRVCEFPEQRVTTDGKYRLVTMKYRMTMPVEHCSKFINPSSELTTAPDHRLRGYSWSRCARGPGQTRSGSSLTPNGDPDVSLEHGYWCLDSDPGLSTPRGFRSSAGCVPIFS

SEQ ID NO: 1022327 - protein, 337 aa, Homo sapiens
GLERCLLHFALQLLQLQPDRERAKRLQQLAERWRRPPQDTTRYPLLPAGSPWKTTDRLDARPMCIPPSYADLGKAASSIIFNNRHLVSGLVQHWHVKTKVLPVAVEFATSRFHLNTRHWYKYLGTLETKYKWCEYGLTFTDTRGPTDNKSGNQNIAIEEPDYVNGLEHLTLDTTFVTKHRNQTRGKHQVLLTKRGSGYYHTLSKCPGSAHPHHCLWNPGEVANETHSQGHISDECTGLALAVPPATEPQDPQADNPQSDAHKAKLTVYGQPSRPNPVKHAWPDPQPLATPPSVHPGLDNSNLRELNTRVDQPTSLGEQTPWDQLSEPPLGLCAHSLA

SEQ ID NO: 1022328 - protein, 132 aa, Homo sapiens
MIKVLFNIIEHLKINNMMCAFLVVGVTLEKCVSQGTHIKSNKFLPPNKLVLVQPVPITCVGLSTCSYNRNSVGLGGIGCVGVPCGEAGWLFSYSEVTSVFSGRVLNGPSKCVHPGEDLTFLYPCGYTPIGGQ

SEQ ID NO: 1022329 - protein, 160 aa, Homo sapiens
AAAVRQDLAQLMNSSGSHKDLAGKYRQILEKAIQLSGAEQLEALKAFVEALVTENVSLVISRQIAELSFLHNIFLTLPDSSRPQEDLISFNLGKEDPSPSSSLLIYDVSRFAFHYKTAFLAFYTTEETESNALGRQDALPKVLRGEFLLEDRDNKTRYNW

SEQ ID NO: 1022330 - protein, 118 aa, Homo sapiens
MALLEDQRTGLSAPPRCPPPAPRPLPRHPTGPTPARAASHSPRYPRSRFPDPNRHPRAPSLTATPPTSPPRPPTPTAAPPAPLPLLVRDLTAASHPLPPTPPPPPPPPHPPPPPPPPP

SEQ ID NO: 1022331 - protein, 118 aa, Homo sapiens; identical to SEQ ID NO: 1022330

SEQ ID NO: 1022332 - protein, 265 aa, Homo sapiens
RDIGNVKKAVHDLGIDYPVAIDNGYSIWRAFGNEYWPAHYFVDAQGRIRHHHFGEGEYAQSERAIQSLLAEAGHPEALNVPLGLAGAPAKGALAAADAADVRSPETYVGYARAEDFTSPGGVVRDAAHRYDAPARPDLNDWGLAGTWQVGAERATLAAPAGRIVYRFHARDCTSCSAAGENGQPVRFRVTLDGAGPAPRTVPTSMRKGYGTVTGQACTSSSGSRAIGDARSDRVSIGVDAYAFTSGERGPVIGPAHRIEEKRTIP

SEQ ID NO: 1022333 - protein, 170 aa, Homo sapiens
MLSPVPAAVHAGPLCPDVMTPARVDPSPATDSAACPLLTPVPVPPYVNAWPSPVCLQPVFLRRLLFVSILALQALGLVLRYRHKLLSYQSVFLFLCLFLGLPADLSSSPSTFKDLRGGRFCSGPFGLLACIYCFPVCLQFFTRHADELCYFTQNSLKKVPVLSPFSRGGN

SEQ ID NO: 1022334 - protein, 257 aa, Homo sapiens
AERDARRPPRVRRRAVSPDEARVVPACAGAPPGPDVMTPARVDPSPATDSAACPLLTPVPVPPYVNAWPSPVCLQPVFLLRLLFVSIYVQALGLVLRYRHKLLSYQSVFLFLCLFLGLPADLSSSPSTFKDLRGGRFCSGPFGLLACIYCFPVCLQFFTRHADELCYFTQVIFKAKSKYSPELLKYRLPLYLASLFISLVSLLVNLNLLLVLGKDRKLGTRKVIVSVRVAINDTLFVAGVPVLSLHPVSTKFSKDVL

SEQ ID NO: 1022335 - protein, 108 aa, Homo sapiens
AGITTVSHYAQPDLSFFMTLRNIWQNSPSLQIWKLRLEDKISCQRSQNNIKTAYFPHQIIWATSEEQTCNVSQYHKPNQPPTGRRTNLANLSSYHMLFKKRKLAKNLF

SEQ ID NO: 1022336 - protein, 289 aa, Homo sapiens
MDVRRPYSARVASPFRVGEINHAVAAVVEHLQNFFALFEAAAQAHTDKDAGVFGIGKTVVELGDRTPAKQLAEFEEAAFFFRNGHRQQRFTLFAQFAAFCDVAQAVEVHVGTGKNMRQPFAANVVQGDIFYYIPARRQRARGFRHRRTSSNKSFIAAQIASLSTVMMSSENTPGINGRFRHRMRVNRYAFRNKPYAREINPDDNEFKRHDFQGTGGVFRLLQEITLIWRDQDSMISTGKARSQTAADDWDKYAVPDGVLLEIQGQVPAGDPIRCRRGPSDPVVDINAMV

SEQ ID NO: 1022337 - protein, 465 aa, Homo sapiens
WGFVSPSCSRRRRACRPSASSSGAIFGPGVSGGAGASAADVAAACGGVPELLLSDCELSAPVRFMRFSAVVGVDLRRLGTALRIVTDCSNGRTQRDLELPGEFALYEKLVTYFNVISMSLSLFHSEHQESQDTTFGNDRVMTAIFPRVKVEHAKDILDQKINEVSSSDDKDAFYVADLGDILKKHLRWLKALPRVSPFYAVKCNDSKAIVKTLAATGTGFDCASKTEIQLVQSLGVPPERIIYANPCKQVSQIKYAANNGVQMMTFDQCKLQLNEKLPRATIPKQQLVLRDAHCMIPKQAVRLQCGTFRATLQNQQAPLGNGRNSSSTHRCGWMSASMIGRGCTDPETFVQESLNARLCFLDMGAEVGIQTCLCLISDDAHSPGLCRNVENYNIWHKTTPGIHHTQAVEQNQQDETNMRVQQQKKEPRAIPQIDKRITTTTHTKARQGITEKRTRKHTIQPKQPL

SEQ ID NO: 1022338 - protein, 315 aa, Homo sapiens
GATQVYPRRLSMTLIPDLHMRHGSILACAEVLTPRTKLQPKRTGPSRTIWTSRQLQGPEADSPAGSMIVSYSRGLGGQAHEDNASVCFNGKVVTCQERPLRGDTVIDGWAMADKDTLRHLHLISSHSRQQMKDAAVSALAALCSEYYMKEPGEADPAIQEELITQYLAELRNPEEMTRCGFSLAWAPSRLLLKGRLQQVLTGLRAVTHTSPRGRKFAESQEKTVEMPLRGFASTVGVKARAQTEGCVREDGPQITVAAGCWDVYTRIEGGGGLGRRRLNVGGCNFWRTRMQANLGLVVAAEFVVPGLAVGPRPKY

SEQ ID NO: 1022339 - protein, 307 aa, Homo sapiens
MTLSGGRRWWHEARTVDVPGGTYSPMTLSSGQPRKERSAVTELTVGQGWPGIMPEPKRLYLAESTLFVWELESSYIREAYPEFRSPSHLGSMTNLEKYASSPTPGVPAFDDQSIVEGDTIAEAFFALDHGNSSPGQVQSRSSSVTEHSCAVRGGRRGYILRCYTQNIDTLERIAGLEQEDLVEAHGTFYTSHCVSASCRHEYPLSWMKEKIFSEVTPKCEDCQSLVKPDIVILVRASQGGSSPVCSQTSCKVGSFPGQWVPSWQVAAFASSSEGTSLTLLVIKGRQLAVDLPGGIGREVTASKAPRV

SEQ ID NO: 1022340 - protein, 129 aa, Homo sapiens
MSAGSCTTWFCCSILAVELGQCSYHCLFPSQSPGFWAKLHAVTRPFGLLQAVLQGCFHAELGLQLNLQVLHGELARGELALEALHQLACWWPPRGSSSSVYGEEPISSASLRFYSGIFSYCSRISFRMR

SEQ ID NO: 1022341 - protein, 381 aa, Homo sapiens
VEEPYEAPDGQLQLGPRHQHSSSGASQEEQNDLGLGDLPSDEEEIINSSDEDDVSSESSKGEPDPLEDKQDEDNGMKSKVHHIAKEIMSSEKVFVDVLKLLHIDFRDAVAHASRQLGKPVIEDRILNQILYYLPQLYELNRDLLKELEERMLHWTEQQRIADIFVKKGPYLKMYSTYIKEFDKNIALLDEQCKKNPGLLLCREFEMSPRCANLALKNYLVKAVRKIPQYTVLLTDYLKNLIEDAGDYRDTQDALAVVVEVANHANDTMKQGDNLSEIMQIQYSLNGHHEIVHAWSGFSQRRNPDEAVSESDATSNVFLFNDDLLYTTPVQSGMYKLNQCSHWLDMHGQKTTQEAYQNDSQIEQCPTSFILSASSANRKGEW

SEQ ID NO: 1022342 - protein, 295 aa, Homo sapiens
AGVSRGRVRVCGALLAPPAPLGCQRSGAPPGPFPTGTPPEPPGELRQVGGKKVGRGLPASAAPRQRPKVGAAGAATLLPPSSPAGPAVAGGNPQGLGSGAPDDLAANLEGALLHRSHLSWGRPGAAEAQAEAGLAGWPWGELSGRGTEPGCPCDCGVLGKRKLQRYCLMSVKGCFNDFHIDFERHFRIGTMFSGVGRLFGMIPPKLHNLELYEEWVLSGKQSDIFLGDRVERCQRIELKQGYTFFIPSGLDPCQSTPPVDSKGVRRKHPDTGFNVPMQVRIYEIEDRTAGEKPNL

SEQ ID NO: 1022343 - protein, 244 aa, Homo sapiens
ADELDGEIDLRSCTDVTEYAVQRNYGFQIHTKDAVYTLSAMTSGIRRNWIEALRKTVRPTSAPDVTKLSDSNKENALHSYSYPEGPPEGRGACGRALRSISRGGPRKADGQRQAWSYVERLAADPELSPQWARDPSPALRERLDKQEELGAGAGPGAPEELVATWFEAIMTRAGPKRVPDWLKGGRCRGLGVPPLTEDQQNRLSEEIEKKWQELEKLPLRENKRVPSLPCQPKPGDGRGPPSEA

SEQ ID NO: 1022344 - protein, 419 aa, Homo sapiens
AARVESRTVPDMGLEDEQHDAYRIRSILQEAGKREQEEFSGSPNNSERRMRATWQNCVQARERLELCDERVSSRSHTEEDCTEELFDFLHARDHCVAHKLFKHTCTPNCVDLIHPSLHTIWASEYFLHGFGCTIRHLISVTCKFTMNLMALGLQAGSFYANFANDSTRKINQVLMDSAHNHNRYKPRTNPHSAPYNAPRHCRQNTQAHGYTRAPQAPTTSVTPPEHPRPLHGLTPNARPNKSQERRPHRTLTTTHPTITIRDNKDTNRAHTTGDKKGKTRGATRPPEPLTANPRAADAQPSPHTDSRGLHNTPRIHTPTPTMATLEEKQRAGQQRRKSGKGPHARPEEHEHQGRLAARGRHKSRRAQRRNGHPEREECEESEGKNEQGETANQSTTLREKQEEEQGNTACGPAQEQKAG

SEQ ID NO: 1022345 - protein, 423 aa, Homo sapiens
MIPSKEKFYEVHVNFTVTQIRNKWYIRIRSILQEAGKREQEEFSGSPNNSERRMRATWQNCVQARERLELCDERVSSRSHTEEDCTEELFDFLHARDHCVAHKLFKHTCTPNCVDLIHPSLHTIWASEYFLHGFGCTIRHLISVTCKFTMNLMALGLQAGSFYANFANDSTRKINQVLMDSAHNHNRYKPRTNPHSAPYNAPRHCRQNTQAHGYTRAPQAPTTSVTPPEHPRPLHGLTPNARPNKSQERRPHRTLTTTHPTITIRDNKDPNRAHTTGDKKGKTRGATRPPEPLTANPRAADAQPSPHTDSRGLHNTPRIHTPTPTMATLEEKQRAGQQRRKSGKGPHARPEEHEHQGRLAARGRHKSRRAQRRNGHPEREECEESEGKNEQGETANQSTTLREKQEEEQGNTACGPAQEQKAG

SEQ ID NO: 1022346 - protein, 76 aa, Homo sapiens
SYDPIPVSVDSVINPLLPDSRTDQGRRSASAVKYFPAMMLVDPKQGSVRPLSYGFISQDDLAKQFLNVSEDFKPNF

SEQ ID NO: 1022347 - protein, 134 aa, Homo sapiens
ALCVAYSGQCYISHAQTGRSANRGDCSQACRLPYTLKDDQGRVVSYEKHLLSMKDNDQTANLGALIDAGVRSFKIEGRYKDMSYVKNITAHYRQMLDAIIEERGDLARASSGRTEHFFVPSTEKTFHRGSTDYL

SEQ ID NO: 1022348 - protein, 69 aa, Homo sapiens
PGVLPLFQHPEEERAGSSLQERGGAAGPKAQPLCSQDPLILTLSCMVGPLCSSLPVASRLFSVHLVSSL

SEQ ID NO: 1022349 - protein, 145 aa, Homo sapiens
HASPRVAGSSSSDSEGSSLPVQPEVALKRVPSPSPAPKEAVREGRPPEAKPQPNGRGALDSFQFQLLLFIFTSILTSSSVILDLPPSFLVTIFFLLIFLTPTSLFHHTLPHWLKPGPSGPLRQNLQAPKKRTPLDETEVRCMYLH

SEQ ID NO: 1022350 - protein, 245 aa, Homo sapiens
HASPRVAGSSSSDSEGSSLPVQPEVALKRVPSPSPAPKEAVREGRPPEAKPQPNGRGALDSFQFQLLLFIFTSILTSSSVILDLPPSFLVTIFFLLIFLTPRRSSITPFHLAKALDPQAMDPKGCKPLQKPARTMESGGPDSTPGTPIDYPQGPSYGPVSYSPDGAFGPNTTGTPKHHQPNGETQARSKTKTRWKAAEVHREARAQTVGGTSTHPTQDKKAEGEAQQTIEHIEDTRRTNDELQGN

SEQ ID NO: 1022351 - protein, 127 aa, Homo sapiens [sequence omitted]

SEQ ID NO: 1022352 - protein, 299 aa, Homo sapiens
LNTSPLALPSRSPSYRERRVKGAMSKISEAVKRARAAFSSGRTRPLQFRIQQLEALQRLIQEQEQELVGALAADLHKNEWNAYYEEVVYVLEEIEYMIQKLPEWAADEPVEKTPQTQQDELYIHSEPLGVVLVIGTWNYPFNLTIQPMVGRHRVLVEQQLVLEAPRELSENMASLLATIIPQYLDDGICTQYSLGGVPETTVLLMDEVRPYLYTGSTGLGKIIHDRLRAKATDPVTLELGREESLLRGQRIVDLEWLAEARLGGHFMNPGGPGLVLCPRILSSVDPRFRKPQLGEPPGS

SEQ ID NO: 1022353 - protein, 202 aa, Homo sapiens
MRFELGKAVPSRVSIKMLGPGAYVRGRVSYVADIAHSKEVKDVACQTTDEARDDRRRGDAIRRLTLVPLRRYQPDPGSADPEINGLKRVKALRTEIKPKNAGNGMSHYAYNSADITTGCQSRRRQPQRSLYTDKGTQAPRADKPANPGPHDRAAQGKQNPTRIADGKSRHKSRHIDSAHATDIPSDALAPPRGTHSQTRKRV

SEQ ID NO: 1022354 - protein, 114 aa, Homo sapiens
IPFVDRSRRIWPPPYRSYAHPSAYCMPPVIRPLVLLVAIFHKYSGREGDKHTLSNEGAEGSLLQKELTIGSKLQDAEIARLIGRLGPEQGPGSVNFQEYVTFLGALALIYNEAL

SEQ ID NO: 1022355 - protein, 73 aa, Homo sapiens
GRLGAPSRADALRVPPFFRASPLAAARERGRDGDEIAKAQVARLCGDTILGKIIRKEIPAKIILEDDRVPCFP

SEQ ID NO: 1022356 - protein, 76 aa, Homo sapiens
SYNSSGIISSRVIFINTQNKFDHPVDPVSMCLGDLPDLKPEDMEQQFHKDKMTTIPSQDLYVALSASAVIAIKCLK

SEQ ID NO: 1022357 - protein, 331 aa, Homo sapiens
IPESPEQTHLYCLQLCLVTIDTPGGACSCLQPAPVTITATMMQLRPETQQPTLTDQTTRPTLPNNTTSHSPHSHHILNTRPTTQLLQSHHTLTTTYTYHTHPYSSQLIIHTPRITLLPITPPSDTTGYTISNPKIHNSLLSTGLGYLLHNLVAPPLNLGTLIDLMTLTPPSYSSSLASRDQMRLSTRTSRAPMDAALGSRAPLKLREDRYKKVIDRAANPRPLRAHRLTSTSRPAHESELTFDSYRPHRHNDPVEGASGDTTTHHRTNTNYKTSLISLLTHSYTLPNHYPHLTTQHPTLTPPHPPTTYIYTISYTLHSYNHYHYTTAAIRI

SEQ ID NO: 1022358 - protein, 329 aa, Homo sapiens
SPAPSPPPPAPGRALLCPRIGALVPEAPLGNRNPEKVTLGGGARGLPCGDGEAAPRSPAPRRAPSRAMGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLEPGPVLGSVGCCPEGFSHHPGATAEAASEPCCREILRSSATCWGSVAAFGSWASRIPPLSRILPGENISLHHLLAGLLSALGGLLYASAIVATDRTLSPAAATLVPDSSGVRTGLAIFS

SEQ ID NO: 1022359 - protein, 308 aa, Homo sapiens
SPAPSPPPPAPGRALLCPRIGALVPEAPLGNRNPEKVTLGGGARGLPCGDGEAAPRSPAPRRAPSRAMGEAPSPAPALWDWDYLDRCFARHRVCISFGLWICASSCWIAAHALLLYLRCAQKPRQDQSALCAACCLLTSLCDTVGALLARQLTIQSVDPNSSLIQIGKPERGRGGGSSGPVCLPLALPLEPGPVLGSVGCCPEGFSHHPGATAEAASEPCCREILRSSATCWGSVAAFGSWASRIPPLSRILPGENISLHHLLARLLSALGGLLYASAIVATDRTLSPAAATLVPDSSGVRTGLAIFS

SEQ ID NO: 1022360 - protein, 42 aa, Homo sapiens
PVKQLKEFEGKTLVSVTKEGLELPEDECVWFWWGENRSCCNW

SEQ ID NO: 1022361 - protein, 183 aa, Homo sapiens
MDWGSFRLCMKKRDIKAWKTKKKHLLMWCVLRSRTCVVLFIPPCAKQMKSEVCYTNSSWERSYAVWEWVTKSEAYFIGLHSDQFLVAFKEVGRKPPPFGDVSVIALELLNSGYEFDEGFLIFNKFRSVISYKTEESPIFFLNTVAVLTSMSIYDDIDVDVLPKLPRIPIWPNIIYYSLKESHH

SEQ ID NO: 1022362 - protein, 252 aa, Homo sapiens
MKAENRCRRRPPHGPERHEAWVPDSARSRIQTARSTAEDTTMDAAELTPNARRHPHSEHGPRTRGSQQPPTELLTGSRKGQQHDPAPPQAGQPATSKTHDAMARTQGTKRQQRTREPSKPKMTVAPPAPRGTRPTQKPDIDPSKHPAKRTPAHNHSTQRKAGARTEDRPHRTRTTPSNSTAHTRDKEKRDTASPPDQQTEDTATQPRQTSQTTKTQQEHTNKGPRSDRTQQPGQARAGERAPEQNNLHVSQK

SEQ ID NO: 1022363 - protein, 285 aa, Homo sapiens
DAAQLQDGVAHGGLDEHGEVAARVDRDDDLAHRHAEHVLIERLVGQALEVALHRLLAHEVDDELEAHLAAHRRLAKDGLDVEQADAAHFEQVEQQLGAAALDGGLRDAEEVHRVVGDEAVAARDQLQAELALAQARFAGQQHAQAQDVHEHAVAGRAVGEQLGQVAAHHVDDMAGGFGRAEQRDLGAVAHGHQARRRHGVVGADQHRRLQRDDARDAAVLDLRALLAEVGDLAGAEDLPPVGVVLVRVAEQVGGPGLRRRAVKGRRGGGTPRGPGVKPGAGGKGG

SEQ ID NO: 1022364 - protein, 151 aa, Homo sapiens
MSALGAVIALLLWGQLFAVDSGNDVTDIADDWLAEAPRDCTLVYVEPSVAHYPVVIELHTNLGAQNTSRMELYTLNRWEAVDEITAVGDKTFLNCESHVTVGDCPCISGHTPECKSGSVGRTPGIAEVGEHFPGKARMVSQSYSHAQGANC

SEQ ID NO: 1022365 - protein, 412 aa, Homo sapiens
GSSRGKTNQDECPGSCHCPPALGTDFLQWTQAMMSRISADDWLAEAPRDCTLVYVEPSVRSSASSSEWLNREQLFLQSMDTSDHTFTIPHTCSEHTPTMSPSSTVPGGHHHSNQFIEQIKHALPKDNMTQKLTQRASTPLTTTYTRTPTMPPSTYTNPKQPLHRPGTANKSGVPHRHEAETHTASTLQNTHQLQHGEGQTHSAQSSPPTALQHARDTHGDHGTHSTDTNTHTDPTSTIANTTHQQQPPTHTHTTQPHPPPDHTQRAPSTPPHPTRTHSSAGGPRKSKKPAPTTRDTHRNRRAAKSGSETNDQTRKTAGDLTPESVRHTQTLGHERPKTQQETTARNRDPTNDTGSKDNNKKRKDKDERRNKQDQQAEDNDYTHGNSTRDTTDGASTPNDKNTDETRQTDDDK

SEQ ID NO: 1022366 - protein, 118 aa, Homo sapiens
GPGAHKEVGGAAPFLGVDFSSLDMSLCVVLYVASSLFLMVMYFFFRAEVQAVEGQAPPPGRVSARVLPATAEAPLEAALPRATCSFNIYDQGFYKHAGLVSHRMAPFGFKVLVLQTLF

SEQ ID NO: 1022367 - protein, 288 aa, Homo sapiens
MSLGIMVTRWAGIAHRWVSLKKANQNGPHLGLLGKDTDSCAPRGKRRIVVYKSSQSNFLGHQKRVERERWRNSESFQVDFVIKRSNFSAEAPTVTEAVLTNEVSLHPFQLAGAHSGEGLLVRQWLSVGVLSPPVRFGGAVWVGNEPGVTEDLLDLPPVLPCGGELGERKAGLGGGKREEESRVKTSEKCIIKGVKRHPQRGDRTPFEGENTTHGAHMGSDPPQRRLLRQGDPARQQNTRTEQYDAPRITTKREVEPRTYATKESGNNWAKRNTRRPEEPARNRDSAQM

SEQ ID NO: 1022368 - protein, 122 aa, Homo sapiens
MGTKFPGPVHICVSWESSSGIAECEDQWDTCGEKRVCDKGYLWKLSPDCPGAGTGSYGGKLIGGSLVGEIGDCTCGLCAARKKIFLSAYQGTHLLHYLDWRVRHELKAWTTNLGGEEVDQRR

SEQ ID NO: 1022369 - protein, 142 aa, Homo sapiens
MSTINWGKDSNKFKPFHIDLFARSIPGPVHICVSWESSSGIAECEDQWDTCGEKRVCDKGYLWKLSPDCPGAGTGSYGGKLIGGSLVGEIGDCTCGLCAARKKIFLSAYQGTHLLHYLDWRVRHELKAWTTNLGGEEVDQRR

SEQ ID NO: 1022370 - protein, 175 aa, Homo sapiens
PRGFWRGAERRRAQLAGRPRSGGAARLPPAPLPLGRQPLRGGDRDIPWGTGGPAPDLWDRQSSKAPRGDVTAEEAARTLPPTKDNGPGEWPREKHWRLITAKGEGESPTVNGTDEEPGPPGDAIEHSTPHSQAAEAKGEDPPPKEDTPKGSTDRTFLISKHSLYNIEPALSFNET

SEQ ID NO: 1022371 - protein, 189 aa, Homo sapiens
TRILARSGAAAGAASGSAAERRCSSASPGTPPPRAPDPRTITTDRPTPTVLSHCGRRARGGSKRPPKRPPSWDRQSSKAPRGDVTAEEAARTHSPDEGTTEQENGHVKSNGDLSPKGEGESPTVNGTDEEPGPPGDAIEHSTPHSQAAEAKGEDPPPKEDTPKGSTERTFLMSKHSLYNIEPALSFNET

SEQ ID NO: 1022372 - protein, 375 aa, Homo sapiens
GRAAAEGVRGCCAPGSRVSPPERVEEAQAVLGALPLPFPPCVLSRPISALLCLSDARLSRPGFGDRESHVSAQAAELQLVPINASRATIVSPEIQQQFSNLSHPQGSLELHDHGIVDMPEYIAVSSYDIELPKTASLDKQPEDTWYMSQIARSCLIRLPVRYIPCEHGLVWTLECARPHKMLSEAATYEMTTHRVRTPTFRTMNLADWFTCIRVSLTVSNVHDTLVTSVITVLQTLTVSILLQLRSSNEKLLDQRYNNGRYRKRRHLNSAVSPLESFDGKRQILCKMVQDELCIVDSIDNQSILVIKNWYTTCNYIDVHIVLNNSLITSNFDLRPSPDTTKQGGQPAKDTPRDHRGTHTPNGHQHADGSTRTHQN

SEQ ID NO: 1022373 - protein, 101 aa, Homo sapiens
GRAAAEGVRGCCAPGSRVSPPERVEEAQAVLGALPLPFPPCVLSRPSLRMHSVVVLSDHSTCTLAPGIMLLRVTSQNNSSLQPEQMPTKATAGTESKTTRT

SEQ ID NO: 1022374 - protein, 216 aa, Homo sapiens
HTPAGQDISEVCNATDGSLPPHLHNLPLSNLAIPGSHDSFSYWVDEKSPVGPDQTQAIKRLARISLVKKLMKKWSVTQNLTFREQLEAGIRYFDLRVSSKPGDADQEIYFIHGLFGIKVWDGLMEMDSFLTQHPQEIIFLDFNHFYAMDETHHKCLVLRIQEAFVNKLCPACSVERFDAANSVGEELPGSYFLPLSLLQAVPLPVARKEDPAPGQH

SEQ ID NO: 1022375 - protein, 106 aa, Homo sapiens
RRRRKPFRENSNKLSCCDRGEQDGGAEGEPLGEDPTGLPPLLLLTMALAGGSGTASAEAFDSVLGDTASCHRACQLTYPLQTYPKEEELYRMSERLQAVFNLSVGG

SEQ ID NO: 1022376 - protein, 111 aa, Homo sapiens
PFPELSFFGPRIAHHVVIGGDCGPGRLCPKVLQSTWASTSAGNLPLSLPLASPDDVPRRPIAQWGWNCLRATPCGYICQSLGANWTSPGLTQFYPGLPLGLPLRLSIARFY

SEQ ID NO: 1022377 - protein, 104 aa, Homo sapiens
MRVVLARNLMLHLFMELQWVGELVSQSMGNFEWLQKSVFWLCQKMNRTVPDVGGGYSCHDSRKNWVLLAYSDSGLKGRDVLQSTNSLTTFVDSWKSRPCRGSIG

SEQ ID NO: 1022378 - protein, 176 aa, Homo sapiens
NKFKNSSTFSPPPRAIYNQSKEGLLALGGQKALGVVIFFVLFISVLEGPGGRWGAKAEKRQKGRKGWSGGSEMWGRGVAGPGGGGLVMSPLPHQFLVVLKIHPPGSESGPGNSFWSWRFRFPSHRFFRAAVAWVSGPRVGRLLFPIQVGCLPGPPGCREQMPPGPSRSQTAAPARC

SEQ ID NO: 1022379 - protein, 386 aa, Homo sapiens
NKFKNSSTFSPPPRAIYNQSKEGLWLWGEDEKVELFSNLLKKNNIKGGNTHNKTNNKRNKKKKKTHKKKNTKKREKKKTTHKQKKKRAATAIPTPTDTETANTQSNRHNTAPHNTEEGNKQEDKQPPNNNNTRHKGAKTNKTKRQNKRDQPTRQKGEPDNEKRTPLTHENQTTRQKNNKKTNKQQAKSNDKQKQNTTRDEDAKRKKREAEQEKKDKERKEDAEQERATANREKPSTRQAEKPRKKEKKPRTVKNRKPNEKEEKKKEKKNKKHKRKKARRQRRNKRQRTDNKNKAQEEEREPRKRKESKKEKDKRSKKDGNEGEKKRHQRTRREKQETNGARREDGRRHRNEKKIKKRAKEEKTERTRTTEKQEEKRKGTRERHKKK

SEQ ID NO: 1022380 - protein, 69 aa, Homo sapiens
MDPDCWNDNQCIAVTEEMAYRLGRRSTDTINAWKQVDYISALERMTYLFSTLTSSSDDIFSRMFFLYFG

SEQ ID NO: 1022381 - protein, 69 aa, Homo sapiens; identical to SEQ ID NO: 1022380

SEQ ID NO: 1022382 - protein, 69 aa, Homo sapiens; identical to SEQ ID NO: 1022380

SEQ ID NO: 1022383 - protein, 69 aa, Homo sapiens; identical to SEQ ID NO: 1022380

SEQ ID NO: 1022384 - protein, 419 aa, Homo sapiens
CPSCWFSTLVLAPGVCKMKIEEVKSTTKTQRIASHSHVKRAGGWDSELGLGQGSAVPHVACVASENCAQRHVAVIVSTFNQTATAHTWLAQQLSCEAGTSWNWAKTALALGSLLQAARVVTGPASAPHGWGSAQFHSTSSIESKHSRCCMAATSARAIWRCAIQGSTKASFMQGASHKQLNSDVQHSSHPHGAGIMDKTHSANVHPSGTQKQANRETKNRVATVAPPAIICTSWRAKQRSRKAGSMVQFTIARANTGAGPVTRRARGSGVDLPTGAQDNYDPRTGMKTVLSRLGAPGWLWHTREQDTTSKHVNLALTLGNVGKNDAAPQGGDTSDNSPGPTDVRGPKKMDKPKRNHTALTEPNKQQEQTQEGTGHTEHRTRDHARLGPEDEAVNTATTMHIKTTHQETRRKLTNKHINK

SEQ ID NO: 1022385 - protein, 117 aa, Homo sapiens
CPSCWFSTLVLAPGVCKMKIEEVKSTTKTQRIASHSHVKRAGGWDSDAVLVPSQCCASCGLCGQAELRSECMWLSYVELIKSKKMAWKMLSCLAVTSCELGKTCSVLLWLFAHVSLV

SEQ ID NO: 1022386 - protein, 214 aa, Homo sapiens
MPKKKKMGFLLQGISRKHGLHFMKTYIGIHRVTGRALSLSNSYEAILCTFQVHPLSNKLRATGQANPSKISLVPVNFSNRGHQRAWPPRPPHGANCPRINYLRTHPHRHIYLSDQLTTKDLPPMGAYNVGNANGSNSRTYDHLHTLPTIGDNGAIKAHLEPSTPSSTNPHPRARPPLTDTSDKLTRTAQHVEPPTPSGTAAGVTPPQTSAGKTT

SEQ ID NO: 1022387 - protein, 210 aa, Homo sapiens
MPLLAYHIGGILSRPVDEWPGVYDPLETSVNADILAYGQKEGWCKLAFNLLAFFSYLYGMIYVAGELLEELQQKNGPVKCMQTSLPNEGILSSKILSKSSLWNLISYFNKLTPYCHMFPHCCRGHDGLICTYLSIPRFLTRALRILSSTAASPGVDRSNLPLSQDPPYPPNDALFDDVYYTRPLSSQLSGHPLPPSTPSHSAQPATTRTV

SEQ ID NO: 1022388 - protein, 181 aa, Homo sapiens
MNADILAYCQKEGWCKLAFYLLAFFSYLYGMIYVAGELLEELQQKNGPVKCMQTSLPNEGILSSKILSKSSLWNLISYFNKLTPYCHMFPHCCRGHDGLICTYLSIPRFLTRALRILSSTAASPGVDRSNLPLSQDPPYPPNDALFDDVYYTRPLSSQLSGHPLPPSTPSHSAQPATTRTV

SEQ ID NO: 1022389 - protein, 282 aa, Homo sapiens
RVGCYGINELIRRTDVRMNEDEDEDGGQKPEGEPQQDPGTEETYGEVEEEPLDEAQDDDLDELMEMEPTFVHASSQTSGPTSGYHAENFLGASPPIIQPSRRRNQNRVPLLEGLPGTNSPFYSSPPLIRRTGRLGQRQVRRRPPVLFRLTPRQGGHTSCSWPNSSLSAGARWPPRTHPSFESPAPAYAAIPAPFADQDFREFQTCENLKKTCRIPDHLATVAREQTCCPIQGHLGKEWIKHSAWPTWHGTLLSQATKLENNVSGPVPINELVTLLYFPSGCS

SEQ ID NO: 1022390 - protein, 173 aa, Homo sapiens
MRLSALLALESKVTLPPHYRYGMSPPGSVADKRKKPPMDQAAAQWVWKPNLCSEELVSVLWRTRVGDPRRQGCRERQGNSGLNVIRSETGVAVGGLEDTLSLHLEDHGMTRGTHDPSEAPLTSGRYTVVDPMEQESDEIDWRFTEDRRGGNESPKNKGELFLKRNLPELVDWS

SEQ ID NO: 1022391 - protein, 153 aa, Homo sapiens
SLVYERSGGPVRGSDLPAELTLRDPGQLLLAAGDCGLFSAMHPLQMCSPSAKVSGVRTIGLCVRWLSLRHVHVADMDVSLVSLCASPESAEGWSSEGLQVQAGVCGPERCSHIIVVQQSASAPQEKPDLQKWKTQPPYLTMDEASWKATRKSL

SEQ ID NO: 1022392 - protein, 118 aa, Homo sapiens
SLVYERSGGPVRGSDLPAELTLRDPGQLLLAAGAPQVIHPPQARKRWDYRIGDSVAKSDPARKHLGEGLQSGGGITLKVKGGIEEQGDEKKNGEKRKVDDEKKYQTNKETGDGERDNG

SEQ ID NO: 1022393 - protein, 172 aa, Homo sapiens
LGTVGAAAVCGEAAAGVMAELSEEALLSVLPTIRVPKAGDRVHKDECAFSFDTPESEGGLYICMNTFSGLWENSMWRDISNNDRSHAQVYLPPPAGPGARKRGGPCYRHWRPTPGRSPSRDWPIGVEGGFDLRDGDNVRIHDEDVKIVSFARLPGDCPGMDWGDCLSLSDIG

SEQ ID NO: 1022394 - protein, 110 aa, Homo sapiens
SFTLVAQAECNGTTLAHGNFSLPRFKQFSCLRLLGGWDYRRVPPRQANLYFGGDIPCGQASLELLTSGDPPASAFRGAGITGISHCTWQIFILLVKSIKPHMVYLKYFII

SEQ ID NO: 1022395 - protein, 202 aa, Homo sapiens
GATKMVVSGYEAGTKPRDSGVVPVGIVGKLPKESDRPTISKSELNLVMRNVRIDDVNKTASCFRPPHLKELGGQDTKSLSCLLGMRRRGKQEAVSVFNDGSIYAWVKPSPSLEDAKSEDQVVIEIIEKNLEAIFEKRNDTKMYIKWRTFWNNSWFLWNILKLPVQRALLQLVKALMLVKDHMDHVGYNFHFWSTVVTDKAFL

SEQ ID NO: 1022396 - protein, 221 aa, Homo sapiens
AEVGAVRRRHLSRRSSPGRLKKELLLRSAPAVAPADLTSSRLGRACAGKQRTCTNTGNLSGLHTFILQARLSNQRACKGLRTFDFPLPNLWYYASLPFSVGTGKGTKEHNEYNNSVAVAANKILDTAQNANSAKQSSTPEILLWQQNPYDPVDNCWNMNIVDLTCGIFRSLWWVDLTHNRSVCGFVDERRTTRRNARRVTQDMVQLGVEQEMRSCQDREYL

SEQ ID NO: 1022397 - protein, 107 aa, Homo sapiens
MSTKCPSVSPVSGEMKKRKAITLEMKLKIIAQHEGGKPVMAIARELGLWQSTISTILRDKKQISDAAKSSASVKSTVITKKRAGPIDDMETLLVMWMEEPDREAYTI

SEQ ID NO: 1022398 - protein, 68 aa, Homo sapiens
AEWLHSKVTKKQMGCEGDKPFCLNTNSIDNELAEAAGEIMKMCESTAVRHVKPSYSRFGLLTSSISIA

SEQ ID NO: 1022399 - protein, 311 aa, Homo sapiens
MARGPKKHLNALLHAPKHWTAGQTNGCYFAPRSTRQVPTTLTGTALPSCTRLLPQRNYDLNALRLHLRRTDGYTRKTTAMQRFHSKLTGKVRAGMSHTPAGLHWHCSSATRRTTGCNISAWLYDTKGRFCLFTASQLDRGKATSCAKGGHDYCWDVKGIPHLVTHDARTIRYPDPVIKVNDTVQIDLGTGKIINFIKFDTGHWCMVIGGANLGRCSAVITNRRNDILALPTVRACDWMANGQQLATRLPTSRSLATVDLPSPYFFYKTILKKPKDRIHYHNQQLDDYRRRAPALKGRSTRPDRSFHGPSRP

SEQ ID NO: 1022400 - protein, 216 aa, Homo sapiens
MWTCNKAGSRMVVDAANSNGPFQPVVLLHIRDCKMHKIRDLCIQEGQLYIRTGSAGRLWDLNYAWIGHVPPADQEKLKSRSYVSVASSLDFASDPLSDLKWQGRQHELLHSAPWYTISTIIGNVITEPMYPEVVHMLQLTCFGTLTTSSNPKERTLDRRHCMSQRLATQAWTQSTAGYDYHPNGLTQFPDFQPNIAQHYIEPEAWPCAAFTSPCDP

SEQ ID NO: 1022401 - protein, 123 aa, Homo sapiens
MVVPSCHACPGHRLEYLMHYRLCSSVMVPSLDRDKVEARSSRVFKAVSFKSQVVAGTNDVHQGALSAIEDCAYTLRVLPMLLPCMNNKPCEPVMLIYQTNKAKHDELTYVLILTLDKALQPED

SEQ ID NO: 1022402 - protein, 406 aa, Homo sapiens
WVGGVCVWLCGGSARRRGGAAERSLGVWDVWVSMFRRGGRAVGVGVAGFLWGWWARSVVCHKGRPGRVLGRLRVSPAWGDLAGSRGAGERESWGARGVVKGRVPRGGVRSPRPVAHVVARSRREVLRGQCQPWWGKGSLLSHLVGGPLAPLGDRRSAPVEGYTTLPGAKANSDSRIMRSVPRGENRQGRSQGPMVCAHVTVGLRDVAPQRPTNRGDPHKGFGGHSAPPQGPGEGKVWPRWSPRIGGWAGPADEEGYIGLIELGHPPAKACGEMREHPKISGACVLCRCPCGPARLFRHPDARGIVTQRIAGFTPGSFAQNWVCFRIEREEVVEHQKRRSYRIPSETRPLESQNSLAQNLEAQDFMKRTFLIGKMSKPAMMPPSLLKLFPFREIAPSPMPPDVELSS

SEQ ID NO: 1022403 - protein, 128 aa, Homo sapiens
LVLSLFAINLAAAHSWVHTAFMSCDTHCKVCSFTPEANETTNPRGGMNNSRHATLRAVTLTAKVRSFTPEPEIHEPPQKEETLNTSKHQKEQTPDTPPLRTVTLILRVRGFILEVSETKNPPIPDTLS

SEQ ID NO: 1022404 - protein, 138 aa, Homo sapiens
MGNNHLCLAPILLPSTCAPNGQYRTAIDVLCRLASWFRSSSVEIIHWFSHFWLFVAKANIGLISVFQLQPTDMSVHLSPFFQHTQLRDKEGLQGIGDKEYIFNAKKPCRENRNNGVLPNIQYPWANPGKGSKEKPVAA

SEQ ID NO: 1022405 - protein, 330 aa, Homo sapiens
TSGRYSVYYSGRFLAYLLPAGSTALQVFFFLKESCFLHNSIQEWLYPNHCKMVVDRSNSVDHTFREVHTCCSILNKFLKPLQEFFQNAKSNFDSKVKANLARHTDVNAWSSQTETKYSTLMMTGNSLGRAWHACLTVHHPDHCMMSATWTFDMEDCTSRPNFYTYAERHTYLAHSSQKSPTYQRGTLSHIPPTAKGATKPHGWPSNGRPITIQSGTTRALRPRHHCRSHTLRPKIGLDTVPQDIRPVVRSTPAPAAKRGPATQTIYHSHLVNQASRHTTRARSPPPVPPPKNTPLTRRKQTRTDKQAKRPAEALHTRPPRTTDESDSRTH

SEQ ID NO: 1022406 - protein, 101 aa, Homo sapiens
RRNHLLAGQIRTTNPGSGELRTTVVNEAGASHTDLSEDRQESRNKNIVPQGSLKKAVWFYLPRNSYLVLNWKQNFLWHLVPLRYSPCSPPVSSASGSWKEV

SEQ ID NO: 1022407 - protein, 185 aa, Homo sapiens
MKCVFVTARDHHACDDLTCVCVGARQSANKIESLGYKPSYSCKLGRGTGVYLNPSATEIVKLWTVYPVQGIPLKRTTIPAQQIWVISHAGAGSCWETLDTRKATRRWLINAHSWMNNHQLEPVDKSSYTTEGHLFYGTCEHAFLGLGYKFNWTFIQHVTSVLFLTGQARKNFLASKDRVCGINKH

SEQ ID NO: 1022408 - protein, 379 aa, Homo sapiens
APCPSPPAACLGRAEDAAQRLGGQACSPPARLLTSPATSPFCPPGRPVSPRPPGRVLQERQALPPCALRRSPARPRSPPAPSAPRPRPCPRAVMLAPPAFVAALACLACLGPGRAWATEAIHCPPCSEEKLARCRPPVGCEELVREPGCGCCATCALGLGMPCGVYTPRCGSGLRCYPPRGVGEAPAHTDARARRVQWSWRRSRPSRKALQPSDRDEGDHPKKSFSPCSAHDRRCLQEDTSPKIRDRSTSGGKMKVNGGAPGGCLAWCPRAPARSELHRALERHGRFQTEPEATRTFYINARIPNLGPELEISNPSKCHPRFWYWAAWPCAWCFGPDKRGLNAFRGAWSPRGDPAGHQVVYGFQDGACHQAGTPVRGNR

SEQ ID NO: 1022409 - protein, 368 aa, Homo sapiens
GPLPLAARRLPGPGRGCGAAPRRPGLLPSGTPANFPRYVPVLPAGPPRLPAPSGSGPPGAPGAAAVCPPPLARAPALPACAQRGARGGEVGFLLLLGLPGPGPSLGDEAIHCPPCSEEKLARCRPPVGCEELVREPGCGCCATCALGLGMPCGVYTPRCGSGLRCYPPRGVGEAPAHTDARARRVQWSWRRSRPSRKALQPSDRDEGDHPKKSFSPCSAHDRRCLQEDTSPKIRDRSTSGGKMKVNGGAPGGCLAWCPRAPARSELHRALERHGRFQTEPEATRTFYINARIPNLGPELEVSNPSKCHPRFWYWAAWPCAWCFGPDKRGLNAFRGAWSPRGDPAGHQVVYGFQDGACHQAGTPVRGNR

SEQ ID NO: 1022410 - protein, 270 aa, Homo sapiens
SYLTQRARFFSANEGLDDYLEAREGMHLKDVDFRESLMVFADPLQPALCTRCAWVFWLVSAATLSVAPARVAAYGTAHVHYQVEKLFGASSPPPGAVPSGPPLSRVATVDFTELEWHICSNRQLVPSYSEAVVMGAGSGAYLRGCQRCRRSVSSNSLPPARPSGPRLPFSLSQLSLGGWRPGPRQGVFRSLSVGDRYGGTVKEDTENPVKDPTCYEDAFYFPGDSLVHGDKRLTGQDEKGCSSETTKSTHKRKTQTPKNTRKEIKIRKKK

SEQ ID NO: 1022411 - protein, 238 aa, Homo sapiens
QTRYGIITNWDDMEKIWHHTFYNELRVAPEEHPVLLTEAPLNPKANREKMTQIMFETFNSPAMYVAIQAVLSLYASGRTTGIVLDSGDGVSHTVPIYEGFALPHAILRLDLAGRDLTDYLMKILTERGYSFTTTAEREIVRDIKEKLCYVALDFEQEMATAAASTSLEKSYELPDGQVITIGNERFRCPEALFQPSFLGMESCGIHETVYNSIMKCDVDIRKDLLLTARYELDRYADN

SEQ ID NO: 1022412 - protein, 264 aa, Homo sapiens
LCPSSLFFFSRTPPLVLNAPCVPGNVPPAPRGDPRWCSCRPGHRLSLGRTLGCVTFPTESTPLYRNPHWSSAPSDKGPTPLFSRGTPLHGFIKCPPFPPPLIKFSSRVWWFLGGTHTHSTLVEREAISAPSGYSPPTTWNTSERALCIKSSTTRIYKTVGSHREALAPRDALKCALLWPSRESSGSPDTMFPRIPPAHRYYYIRHGKVFPVPLLHHHHTEKHLVAHKVGIEGESPPTSQCPHNEERWLSSGCRLLVTPEDDHDE

SEQ ID NO: 1022413 - protein, 93 aa, Homo sapiens
SSGKKEPSDKAVKKDGSASAAAKKKLRDKVDSNDRGTVIKENEAALENGIKNEENTEPGAESSENADDPNKDTSEKRSMVKSDENKDDYTSPR

SEQ ID NO: 1022414 - protein, 327 aa, Homo sapiens
PPSQSRDKLGYHFLILLFSKVRGHCLLTLNMNEEEVEKRFEGSGSTEVTCHGSLYVEDGLSRVMKRQLVKPPKYVTVPGNFQGHSGAQCITLFRTKAKLRTALPVGAVASVYVHKPRCGTSAFDEISFVNVVLVVPTYLRRSFDFEIETKQGTQYTFSSIEREEYGKLFDFVNAKKLNINNRGLKTGHEPNYDEYADSDEDQHDAYLERMKEDGMIREENANDSSDDSGEETDESFNPGEEEEDVAEECDSKATASSSSNEGDSDRGWERSGDSPKRAKMAKDRKNRKKPAGGEERAKTTNAYQEAQCVDTVRVAQSPAREKISQSG

SEQ ID NO: 1022415 - protein, 632 aa, Homo sapiens
PLRAGTSSPCRPCLTTTESRQQPMLVALTKGGEARGELFWDGESLEFLRGAYTQVIFLRNNIVNEVRVTEGGGVEQKVTVLGVATAPQQVLSNGVPVSNFTYSPTKVLDICVSLLMEEQFLVQLVLAGRSLVSPEGFPREAEPVGQQLCAGLEVRMCHLELGNHPPHRLFPPPPWPPTCLGELSPQIALWAGALEGCSCVNKIVRFALTCCRHAGSISHPPPSVPSTGEGGAQVEDVGYAPELLLFAPSSYCPNATAARLPRGLDACRIPEQAWDSGKFTGHWEILNLHVHIYSFTSNSGQLGTSTNTNKNNKANTTTQHKQQTTQTTNNKKTTPHNTRSAGDDKATQLYTAEATHTPKQAPRRRDGTRTSTTTEPHEHTSRRGQTHDSYEPKGSGRSSGPHNTGKTQDAGNNKRETTNGAEIGGWKRKDKTNNTTRAGEGADTTATGRDPRRPGERAATRTHRAPTDRPPTTPPAKRNHTARNKQTHQDPRRRRDHTAHETHEHNKKETTRPTPHTPPHDAPQQTNNKEQQTTRAHQKDQRGSTRGVQGDERRRRQPNAGAGRERTRNAISKATRGLSASERGQRKSKKTNGTKDGDEGGRQIKEDQRQNRPDDGKQTRPNRGSGQRKQRE

SEQ ID NO: 1022416 - protein, 75 aa, Homo sapiens
DRVVGAAWRGVLKKTTGLVGLAVCNTPHERLRILYTKILDVLEEIPKNAAYRRYTEQITNEKLAMGKSGTEMLKN

SEQ ID NO: 1022417 - protein, 166 aa, Homo sapiens
MAMAPRWLSGKKKCKRGKKAACGMRGTAGGQLDEWDDAGVSGQFSGFHSKSRGRGEKSAAGQHFGAIMIGEVGYDILEKNPVLPGCRHSDPIEPIPDHGLPSEPGALSIGKTASVKTGAKFQTYEISQRSQLKGDTGAEQNSRLQGSNAGQNVDVPMHGHTRDEAK

SEQ ID NO: 1022418 - protein, 65 aa, Homo sapiens
MENSLGKPTKSHVRPQVIMNTGDKTKVPKAVSRNMRHDESALLWPPDLLRDHDFFDPLRYLWSYW

SEQ ID NO: 1022419 - protein, 221 aa, Homo sapiens
MHGRLARFHSVSSYVEEHKSPSYCRNVVAIVTCKVSSIKFTLCQRYIIPVCGGPCLLRTLFEEHIRTGKMSEQLTKDKVAIYKSFRPGDIVLAKVISLGDAQSNYLLTTAENELGVVVAHSESGIQMVPISWCEMQCPKTHNERIPESSPSTTRSSCRPKKAQFTLWKGVSLFLTYYSKDGAIRMQTRARRPTLTYENNLQVYAVDGQVYVIIAMEFHCSE

SEQ ID NO: 1022420 - protein, 253 aa, Homo sapiens
MGGLCGRMNDTEEVWNRNKGVWVGKAEAQGVSLRLRFVGKGDSLRGKESLWQAIAEATNQIKKFWRNLLTITVGRPVLHHAVKDTRVLRVLLGKGSKSGIQEAKELGLGETGSYNHPFQHTLGKTANSGTRCTAQHSEGGGRSSARWDLTRGARRLGLGPALRALVTRGEGVWSLIINPTCQNIGRRKTPNGDDAGAAGGPEGLGGLGWEPRGHPEVTQDIGPGSNGQRGQAKPRKPEEGCRTMAGKNKTREH

SEQ ID NO: 1022421 - protein, 59 aa, Homo sapiens
ASPTITVAMPGVPAFLQGMTDFLQATQTAPPPPTPPPQNDPEKCISRKGTRVTPPPSPP

SEQ ID NO: 1022422 - protein, 184 aa, Homo sapiens
MDGEGQLTLTGQLGDVMKESAHLAISWFRKARQRSTMLTKCFIGGLDSVFDKQQTSICTSQLELVTQRWTIVLELTDSNPVYASLFTLGGWYRSDVAHDLDDNYTERSCASSGWNQQTNVLGGNTERALQASHYSSEKCNKTLRESQATYDRISGFVTASCLDEVLKWRLLMGGLPDKNQTWLC

SEQ ID NO: 1022423 - protein, 155 aa, Homo sapiens
PRACAAADAACGPDSAAVCFATFSPSTARAGGMANVADTTLYDILGVPPGASENELKEGIQNMLAKEYHPDKEVQMQETNLQNISFAYEVLSNPEKRELYEQISESEGLSGSAAAAVAGMDDILLSHFSALADSLRLHGPIRVEVDLAARTSDRT

SEQ ID NO: 1022424 - protein, 340 aa, Homo sapiens
VLTRSWPGPVASLRPEETVPGSMVPGPERASAETQGPGWSRGPRDPAVGHMLLPSQLFDVAPAMAWGPWPGASSSANGLALNSGLLWPLHPVEEPGAEWTRAMVWAPAGTGGSVRPRPLPPPPWPWSPRHGPQAESEDYFVQGPTPPPRVSCGLPGLGAHDPYANSRLDTAAGHCDLAPPPPGPNAGHAHSAGWVRSFHVAAHQLRCMLACGPVRASHLARTKYNNFDVYIKTRWLYGFIRFLLYFSCSLFTAAALGCAVLPSSCLQNLGVRVLLGFQRKLAVLLLLLGRGRVHFRLVNELIVYGIHVTMMLVGAGLVDQWDRRRHCKGRWLEFSGIDRA

SEQ ID NO: 1022425 - protein, 345 aa, Homo sapiens
GEATSPGRPARARSSGEGNVLARSGAGWMGAVMACPTGVPSDGTGCYVLPLLGQTASWLACALMSPFYLHGLTPCLADAVNHCPHACLAICPQPVRPSTMLADPAALEPQRDMGATLQALAPKHLPVRGTQMVLGLPGCLPAGDGHLGRRLPPGSAAGLPGLGAHDPYANSRLDTAAGHCDLAPPPPGPNAGHAHSAGWVRSFHVAAHQLRCMLACGPVRASHLARTKYNNFDVYIKTRWLYGFIRFLLYFSCSLFTAAALGCAVLPSSCLQNLERPGLLGFQRKLAVLLLLLGRGRVHFRLVNELIVYGIHVTMMLVGAGLVDQWDRRRHCKGRWLEFSGIDRA

SEQ ID NO: 1022426 - protein, 243 aa, Homo sapiens
MADKEAAFDDAVEERVINEEYKILDKRTPLSFTDLAAAPMLFQLGPSRHLPSWLPPCPQDQDGKAFPRPPSALAPARHPPPSPLAPPPLSLPTPRAARIPSPALPALPLPPCRLSHPHPPRLHAPPAAPSPPALHRPSAPAWHPHHPPHLRHPPHPPIKPPTRPHAAPHPPHPHPAPPPRPPSLRPPPPSPPPPPPPLPHPPPHLPSPPPAPPTPPAPPPPPHPPPPHPHPPPPHPSPPPPPT

SEQ ID NO: 1022427 - protein, 137 aa, Homo sapiens
EPARHCRHRCPTAFRETGVEGREDFQASVLEGVCGRARSTYRTPEEGEEQSWSAIMAGEEINEDYPVEIHEYLSAFENSIGAVDEMLKTMMSVSRNELLQKLDPLEQAKVDLVSAYTLNSMFGFIWQPKELILRNIQ

SEQ ID NO: 1022428 - protein, 108 aa, Homo sapiens
QVHNKGAKKEECKTGKQLNILTESAIMAGEEINEDYPVEIHEYLSAFENSIGAVDEMLKTMMSVSRNELLQKLDPLEQAKVDLVSAYTLNSMFGFIWQPKELILRNIQ

SEQ ID NO: 1022429 - protein, 108 aa, Homo sapiens
EPARHCRHRCPTAFRETGVEGRESAIMAGEEINEDYPVEIHEYLSAFENSIGAVDEMLKTMMSVSRNELLQKLDPLEQAKVDLVSAYTLNSMFGFIWQPKELILRNIQ

SEQ ID NO: 1022430 - protein, 121 aa, Homo sapiens
MACSHKLSQYLGSGRQLAHSLHYDMYQFGLKDIFVSTKSRSSRISTAFLHQQSKVSTVSMQQPVSCLHNLWHNYHGNRQHIYQHMQGISYTAHNMAQGILGIQFNSDHSDQSTISTAFTQS

SEQ ID NO: 1022431 - protein, 119 aa, Homo sapiens
MIIRNVSCVGADNVRLKQMQQIRMSLRGKAVVLMGKNTMMRRAIRGPPWKKNPASGENGAYISGEMWLCVTKEDLTEIRTCCLAIMVPVLPVACAFAPMVKSLVPARTCLGRKDLPFQA

SEQ ID NO: 1022432 - protein, 203 aa, Homo sapiens
CDWTRGELPFSRALLIRRSEFVPGFRAAGPAKEAIIRKGRGGPFPGKYEAAGKRIQGGEALLLSSPLSAMSLDVQEGSSLEVLVGLSSMEFMEIFHASHIQVSFQRVEFQDVIPPDDFLTSDEEVDSVYVGSCERSCVLELRYYTGVVNNNEMVDYNEILITLMIRMQLKYTDVNGKSSWHLKKELAVLGLYHGQQIGEIEGV

SEQ ID NO: 1022433 - protein, 115 aa, Homo sapiens
CDWTRGELPFSRALLIRRSEFVPGFRAAGPAKEAFEAAGKRIQGGEALLLSSPLSAMSLDVQEGSSLEVLVGLSSMEFMEIFHASHIQVSFQRFEFQDVIPPDDFLTSDEEVDSV

SEQ ID NO: 1022434 - protein, 399 aa, Homo sapiens
MSAGRIGGVYIHQQERFLDGWGSLGRRGGKSFFFRPFRKNMVATREEIIMLEKEVFADNCFNRQRKIVPRKPFGSYYNPRGGTRLMVFHTTRGCKKRQPRAPLVEELVEALFSPHSGGPIRKDYRFCSHPVGQHTEIMVGCRRPIRGLPHTRDMMAPQARHSSGVLGKRPAHTSVREVCSKKTVTPRSLGVTLSGVFSLSLLCLCVCCARVVSDWMIKIRTHTTQFTDIFSEKTLSFYSGSHGPPTHTGSLANTYSLEKDIEMEMENSLHETFAERGGSQSHTRRLCEKRSCGPQYKFECVHRATPLCEKRDTMRKAACHIVYFIPPPPRDVLSLIEKSIKMAEKKAPQFENWEKLTGGFTGEKARKFLEKSPSGNEDTGAIKLDETDGYVTPPPRNLF

SEQ ID NO: 1022435 - protein, 68 aa, Homo sapiens
MALPLNGTEATSNAKTTAIGVAASSTQAYATADTTVTAHSHWRRWTAPQRCCTVSNPFAIQPALLTLH

SEQ ID NO: 1022436 - protein, 103 aa, Homo sapiens
MGCFLNENEIVFFSGGQLMEKLPSKELRVRWTLPHSIRSDSEDICLFTKDEAQFNLLRKGTEQFYRKLLNKHGIKTVSQIISLQTLKKEYKSYEAKLRLLSSL

SEQ ID NO: 1022437 - protein, 121 aa, Homo sapiens
AGRGLATSLPPLLPGNLAPPELIAASPDACVLVSRSRRRRQWRPACRSPTGSLPWGSDAPDPLFRGSGRDNEETTGDKGQAGGGFVSPGMEEKLRRERCWHRAPAGGGSLGPGGTYPGRLD

SEQ ID NO: 1022438 - protein, 105 aa, Homo sapiens
MSTKTILCPSLPPQIAATSNAQHSRVGVDTIQYSHLGLLTTTGGVERTPLGTNSRVTGILCVITDAKKPPKVHHDKPLHSTYNRVIRARHTVLVTKVTRLANPDL

SEQ ID NO: 1022439 - protein, 259 aa, Homo sapiens
MSTKTILCPTFHPRFLQRSNAQHSRVGVDTIQYSHLGLLTTTGGVERTPLGTEQYGSTGDRSGYPPILNRTLPKTRKIKPLSAYSDGYSHAKVLGTLKIRAIPNPVPNSLWGDWDMINWMACGEMLIDEERTRELFKRDMKQKRIEYNESMNGYHNSPEYLAYINAKSRAEAAVEEESRQRQSRMENGEPYMSIQPAEDPDDYDDGFSMKHTATAFQGEKPALISEILSESVVPDVRSSVTNSKMQSQTAVQALWFIRK

SEQ ID NO: 1022440 - protein, 237 aa, Homo sapiens
MMEGLDDGPDFLSEEDRGLKAINVDLQSDAALQVDISDALSERDKVKFTVHTKSSLPNFKQNEFTVVGNMRNLSGFMIPFVENEDYAGYIIPPAPPRPDFDASREKLQKLGEGEGSMTKGTQISNQKELEIPRETWEAEYLAIFKKTVCDALKVVIPFLGWFQVGKQQSYLREEIYIPMSFLEYNPRFEWCEDKNQNRETVKTSLKNMLNQQMEYPPGVRVYIDSCEQNEILGGSNG

SEQ ID NO: 1022441 - protein, 235 aa, Homo sapiens
ALGLGAAMMEGLDDGPDFLSEEDRGLKAINVDLQSDAALQVDISDALSERDKVKFTVHTKSSLPNFKQNEFTVVGNMRNLSGFMIPFVENEDYAGYIIPPAPPRPDFDASREKLQKLGERTNGVTDRQEDFTIDDTRNWKLNYFGKYSNEGQLRLLKVFPVSCGQHILFVRRDLHSHVFLEYNPRFEWCEDKNQNRETVKTSLKTWLNQQMEYPPGVRVYIDSCEQNEILGGSNG

SEQ ID NO: 1022442 - protein, 185 aa, Homo sapiens
SGIARDPAAGQACCFLLLGSPFQTKIEKMVDLTQVMDDEVFMALASYATIILSKMMLMSTATAFYRWTRKVLANSRVRRSSDAIYGHRRTIKWRKVHVTLFRSEDEPRVANVVTHVGPTVDTDRWKTVSDYRCLRMDMCAYLIIPLVRESTSPRLTDTIPDNVQKAYVVWEDTGNRTLTSQLSLL

SEQ ID NO: 1022443 - protein, 94 aa, Homo sapiens
SGIARDPAAGQACCFLLLGSPFQTKIEKMVDLTQVMDDEVFMALASYATIILSKMMLMSTATAFYRWTRKVLANPEDCVALWQRRKCQEVSSNR

SEQ ID NO: 1022444 - protein, 94 aa, Homo sapiens; identical to SEQ ID NO: 1022443

SEQ ID NO: 1022445 - protein, 57 aa, Homo sapiens
MHARDNPLTHPGQSPETQEKAEELKPSLPPGLATEGTVNGPRHPDWDCIIFKYLKSQ

SEQ ID NO: 1022446 - protein, 130 aa, Homo sapiens
SGGEVLLRGVNTWVEKRSLWSPPPRSPARRPLSRPLSLSWKIVREIQETSPALHQPRTKGNAPILLRIPEKIRDPHCEEFEEFWKPPRYPLPPLGLIHLHPRRKSQEKTVNDSLPPGLATEEDCKWTQTP

SEQ ID NO: 1022447 - protein, 264 aa, Homo sapiens
MNKKLKLRIKKFEVYILAVNLERWLKNVPSAVLQYKSPLLIKPDSREDGFAVTRYRMAAKCPTREIEADAANRRETARRTKFSVGNFSPVTIHWGHARIRNGQFPTSAPPLFLSPLLSLFSLESLPGPTGSALLTVSVLASHCSEQRYSLPAQVPASPYSSHSISLATLHLHPPKATLRTRRLNRIPASPALSCSTHPKDTHQPHRHSPPQPTPTLRTVAPHPTAPHSRHAAPHRQARTTPTAHHAPRRHPRPHAHRRHPTPNP

SEQ ID NO: 1022448 - protein, 369 aa, Homo sapiens
HELRKGGKGSWRRGKRLLTPWLQQGEAAAARLKKEGGSGERMALKIFPRLQITDGFALGARDSLPPPEVRSHERDLMFGGTGAPYRRASQFVHCKHDGNYTRSNLTYRGIFYYVHTSGHWRVESFGAPVRIPGHKVTPLSEPDACSSSCADAENLLDRAIDDEAYHVLGNQRTLAFGGGTGLLLRGSDAVNRLKLWASNRLHNTQMGKGPVVLWGWDRLGKSHYMLMIEHRSPSQPGHKKRQRGLCSAPPTSSVAPSYHIVEASHSLVEARPNSPGSKWVSRKSAQPRTGQMPSIRERQKHNRRCSQAGVQTKGNDPGGQGAWGKKATTLATGELLVPVTKGAHVGKRLTKDEKMGPKTRDAHQQRNTR

SEQ ID NO: 1022449 - protein, 272 aa, Homo sapiens
HELRKGGKGSWRRGKRLLTPWLQQGEAAAARLKKEGGSGERMALKIFPRLQITDGFALGARDSLPPPEVRSHERDLMFGGTGAPYRRASQFVHCKDGNNHTCYRVSYNSSIWHWRVVIKGAPFQSRHKYPIPSGTVLTLPHHNSGPQQTTRLQLLEQLTLAYGGELDHTSEDRCFNSSNLSNTSCQPQPWQTPEDLGLEQKANLTNAISSTVNSSQDTATTELRGHAPHTTTFCRDPSYRPFWTRFSFACVEPTGPKPPVTTVRLSKRTFSQ

SEQ ID NO: 1022450 - protein, 98 aa, Homo sapiens
MITCINRQRRCTRLDTISIENSYTASHIPRSTSIPDRSHNSCIIDRTAPSLPENKADSHPPPAPSLLLPHLALSSLHISIETVWLLFTRAPRLPPCPP

SEQ ID NO: 1022451 - protein, 271 aa, Homo sapiens
MACAGLLTVCLLRAARAPAPCPMTPRQPQLVATEPGPALEQALFQDVFRRADKNDDGKLSFEEFQNYFADGVLSLGELQELFSGIDWASHRQFRNRRNCVTTSQSTWDVYRPGCWLPLESLNLQLLAAMDATKLEYERASKVDQFVTRYPAAGRTVSQLQCHFRSSPGAGRQDTLDGPGPLAARSDAESVERAHAGSVDSRMGRSARRPFEDVSALVHSTREYPLRSTLTQAAALSQCRKIELSAYQGRHLAYEEVIQTQLKVNGPPELTP

SEQ ID NO: 1022452 - protein, 265 aa, Homo sapiens
AEFGLEPELRRRGWRARPSRQYHRHLEYRTSVACGPRVSVEEPSGSLPSRASSGPGPGDLWAAGARTAGIELLESSGCWDLGTVDKDFSGVPREDYFEFRVVACGLAYLELKSIIWGTMDFDGFYKTGAGRMDMNPRESRYGLAGISQSCSCGYDNRSEALQRWVQAPIAREYTHCLDRMSSDGTDATGKVALVGAYCGRLVTPLVPKGDTGKQRVSGDVISKPPGARIIHAPKPHSTESQTRDDGMPLRDLNRALCAMKMRLKT

SEQ ID NO: 1022453 - protein, 177 aa, Homo sapiens
GLVVWAAESLNRGRLGRILDGGSKRKTIVRRERLSAAFFGPRKGSAGRALRGACPERAEQRFATHAARALAPRAPPPPRAPRATPPAIAPPPPPPPHPAPPRDALRPPHPPPPHPPPAPPPAAPPPPPPPTPTHTPLPPPHPTPPPPHPPPPSHTPPPHPPPSPPPPPLHTPPLPRP

SEQ ID NO: 1022454 - protein, 227 aa, Homo sapiens
GLVVWAAESLNRGRLGRILDGGSKRKTIVRRERLSAAFFGPRKGSAGRALRGACPERAEQRFATHAGAARGSDPLGLGDAPECDRAPVSLTLPREKEERAEEAARERQDCWGGLAPSRLKNGRSCINGAQYRELGRRISKWFWIQRMPCYDGSRCNLSLAIVQQLWYTSAGTSDDGKFIRSFYDKQTIGYSVREQAKKQWVNVRNGMSCIEWLMKATHGEGPEPGVL

SEQ ID NO: 1022455 - protein, 190 aa, Homo sapiens
RLGPAGGHGCHTLGPDMMASMRVVKELEDLQKKPPPYLRNLSSDDANVLVCARSSSYPTKLTYHPEKAFNLRISFPAGGIRFMASHDQIHKPEDLATPDCGLRNWIRFALRAIISSVETGKPCATQDLAKFLCSALNGAGLKYDADNIHGEHSWRDGTSLDLADTESGAVQKECRRVHPRIRSDRPPNSC

SEQ ID NO: 1022456 - protein, 186 aa, Homo sapiens
GRAGSEASSVLEANSCRGAGVTSFSNLSAGAHPRQSQNVRMLNSSFEDDPFFSESILCTHRENMRQMIRSFLNPLEETGSDISAMVEGELIIVEDIMMVEDACDLITRLSALFQTMDPNGVHPMRKLYGENIKKETSVNLPDGSNMDIHLGAFLSYDFIPTPREMNRQKFFQGLNLKVVEAPQERI

SEQ ID NO: 1022457 - protein, 238 aa, Homo sapiens
MGNSRGTLGPQKPRTLILWARGAGPLDPFQGFHQKPKTGHRDQVGNAWFPGKPSSSPGDLPSVRGLPWRLKPLLVAQPKSSQGKSGQLGLGCLEQRWQKAAHEQGVAMTGDMGQQGPPASGSQKSLASADNRGGPGLKGAGTPGDPYGNNHINPAFSKTGRTDQNAPEICLGPGMDTQLGTTSRGGGRTTGKPKQEQSLGSSTDNSKNTKPKEDPSPPERVTLGPLTHNHRNWGSRRT

SEQ ID NO: 1022458 - protein, 249 aa, Homo sapiens
RLKGVIDLIFEKAISEPNFSVGYANMCRCLMALKVPTTEKPTVTVNFRKLSLNRCQKEFEKEKDDDEVSGEEAKKRWSESRATAEELMERPERKMLEEARDIARRRSIREYQALLESCIKLTDVNRGNKCMSDVVKTDLRNHDEESLECLQSCMITTIGEEPWTFEKQAKPRMDQYVNPDGKESLTEEEDVIPRSALCCKDVLDLRGSNVGATPEGDQGPKNMDQIHKGGCDGTNIERPIKCNAASMAQ

SEQ ID NO: 1022459 - protein, 161 aa, Homo sapiens
MLEAGAGERGSPRLRLWQRRENKEVRLKRCCQGVCPGGQVNHPPLCDKAPVEPCVHLSYRIGPLYKAQEEGLVCGLVGTSSQRGVAGGEGLVIQDHKSFNIRLPTEGVWKICLLWLAPTAGPYKTSLGTQWDSFHICVGLPRKAVGYYPGDWSHGQLELRG

SEQ ID NO: 1022460 - protein, 84 aa, Homo sapiens
GFSGSCVFPLSARSTARRTRNQESVAVCWRLEPGSAARLACGCGSDGDRSAAGAMCQVVPVPANHSSLFGSTVNTVHPVSSDGT

SEQ ID NO: 1022461 - protein, 263 aa, Homo sapiens
MAVRALKLLTTLLAVVAAASQAEVESEAGWGMVTPDLLFAEGDRSLLCAGTGPGAGPEHGTGLLLLPWQILTLPFCLLLPHPVCLPDFPWDAGPLTGPPALCPVASWRLHALRDLSFFGGLTAVSAACLRRGLGPPAAPPRSAKSMELEFRKRSPYNYLQVAYFRSTSWRKAVAAGNTFFVGNPEPHGNMQQTLDYYQDHVMELKEADFKGSLRTQPPLLQRISDLGNCDSTSEDTANRKAVAPTLEGVRLQEYFVGYEELRA

SEQ ID NO: 1022462 - protein, 459 aa, Homo sapiens
EKLKEDLEREQRWLDEQQQINGISSMYYTVNCTHIRLKHFLTSKQSFNELKTNYMLQYTKNIKEKLLSTLGEFLEDHFPLPDRSVQQEQNDTNIQESSVNLITLHEHVQRFLEIDYLMFHMIHMSNISDSFWPPYVELLLRYMDIALRHPEDPTRIRFSKLSIESTRMSSFVHTSNKFLIIQGILEPQDYVAKETITGKFNAHRPSILLLAKMACAAIYRFIFNMVISYSVSASRLLQLYGIRNAGSIHILGYNNHFNVAFLMHISLGILGRFHDIAKYPYFVKIYQQSSLMHFGVQLVLLASSQHTFIPCGKVIQFASMRLHTSQVIIWRWHNFTTHIHAHRVPLILLVLLSTTTVHTFGTTAPPYIDYKLTPTIGYFNAGIFNILHVTVTIVEPHVEAGYFISHQAWVYVTFHSPPWDNPWTRNRCRHTSDKLGYTYRARVSPTQHNIEHVKSPPST

SEQ ID NO: 1022463 - protein, 246 aa, Homo sapiens
MGKKRTKGKTVPIDDSSETLEPVCRHFRKGLEQGNLKKALVNVEWNICQDCKELTIKVETIKLKKKQKKSLQFGLCLKCGHQGCGRNSQEQHALKHYLTPRSELTVWFLVVDNGVYGVTYVIMRSSIGSSNQLGQVVDYVRKQGSITNSKAREKIMEILTLTITIWTHTTKKKKIVGARRPEKFLNIGGRGPRGNGHGQRGKNRAEKVVPQKSRRRSETQGPVRHAVIPPVRGSTRSKSTYAESTA

SEQ ID NO: 1022464 - protein, 164 aa, Homo sapiens
MDSTEERDHPRDIRYSRGSLITIVAVDLREPDDEDLMRQTEGRVPVFSHEVVPDHLRTKPDPEVEEQEKQLTTDAARIGADAAQKQIQSLNKMCSNLLEKISKEERESESGGLRPNKQTFNPTDTNALVAAVAFGKGLSNWRPSGSSGPGQAGQPGAGTILAGT

SEQ ID NO: 1022465 - protein, 114 aa, Homo sapiens
SAHSKHFELPSEPTHLLSNPFFAYPSTLFSPLSCQYPYCIIRVTPSRLLLRVPPYTLPCCFAAELSLSCNSLTATNERIETIRSRLSGSSMRCLSAPAPVFHALWNSSIRQRWV

SEQ ID NO: 1022466 - protein, 111 aa, Homo sapiens
LPQSHFCVAHSYNQHCFESYSNSDADCPLALPENRKVMDMIRAQEQKRDLHDLFQHQLKCSNDSFSVIADYFGRGVFNKLTLLTDPPTARLTSSLEAGLQRDLLMHSRRGT

SEQ ID NO: 1022467 - protein, 138 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKIIGHLFLAIFLSDLVSIRNFL

SEQ ID NO: 1022468 - protein, 196 aa, Homo sapiens
SKTSEPAKRAADGPRVAMALRDYALQKEKVKKFLQEFYQEMIELGKKQFKYGNQWFGWLIVEQVALYVDLEDVAEDDPEIGGHLRFLGECLGGYAKLVLLDAVQELLPQLRRSRAHVVMITDVLGPCSLEHRHSDGSTRQSGTLGWSEAPSNHVTPCVNLIAADLSCDLQGPMGARMPRCDPGNVRGMTSCVGTGW

SEQ ID NO: 1022469 - protein, 92 aa, Homo sapiens
MTALVDASSLCLSGGGGGGVLDGGHLPPPTELRPPPMALPLLELKPPPNAKTTAIGIDCFTPPRPKPLPTPLAPPEPLETVDCTTEMLPFGE

SEQ ID NO: 1022470 - protein, 85 aa, Homo sapiens
PADAHMDPGPKFYSYANDGLPRVMDFKNFSRSLAFLCLFACFNALSSVPGCFLITPFAYFVNKLYWPPLPLHSDDKHLLNYFRSL

SEQ ID NO: 1022471 - protein, 362 aa, Homo sapiens
MGRGLVTGGKWGWGVVRSVTRSQVRGGSSRGCQAVGRVRATLQQLRACAGPCAPGLPWHRFNPSLKAGLQAAGGADRERVQSLASYNVADKIATRKAYGQALAKLGHASDRIIALDGDTKNSTFSEIFKKEHPDRFIECYIAEQNMVSIAVGCATRNRTVPFCSTFAAFFTRAFDQLRCASPKQILCGPLGSIGEDGPSQMALEDLLMFGQSHINCLYPSDGVLQRRQWNYAIHGYLSRTSAKNASSSKTNEDFQCRIKPGGPEEQDDQVTVIGLVTYEALRALLRRKIHRCDLTEPDEISQGRHKRPRGQIKAGAADNATVPRNGRDNEGNGAQSHRGPETDQNREKEKERRRKTTQKPPR

SEQ ID NO: 1022472 - protein, 159 aa, Homo sapiens
MGRGLVTGGKWGWGVVRSVTRSQVRGGSSRGCQAVGRVRATLQQLRACAGPCAPGLPWHRFNPSLKAGLQAAGGADRERVQSLASYNVADKIATRKAYGQALAKLGHASDRIIALDGDTKNSTFSEIFKKEHPDRFIECYIAEQNMVGAGAGRDRSTQG

SEQ ID NO: 1022473 - protein, 381 aa, Homo sapiens
MGRGLVTGGKWGWGVVRSVTRSQVRGGSSRGCQAVGRVRATLQQLRACAGPCAPGLPWHRFNPSLKAGLQAAGGADRERVQSLASYNVADKIATRKAYGQALAKLGHASDRIIALDGDTKNSTFSEIFKKEHPDRFIECYIAEQNMVSIAVGCATRNRTVPFCSTFAAFFTRAFDQLLLWPASPEEQLSSRLLASHVRAFPIWRNDLWPFPGLARSKIVGVVFRSQSPIINLFFYPKVIVRCVLREWHVELSPPNTRWRIVLSFRYQPAHEDMPVIYKTNEDSMSDQAKVVLKSKDDQVTVIGAVGVTLHRGLGRCRTAVEKEKINIRVLDPFTYQCPWDRHTSVLDSARATKGRILTVEDHYYAKVAFGEGVSSASTGQS

SEQ ID NO: 1022474 - protein, 452 aa, Homo sapiens
AAEHWLRATVGSGAVLGAAAADAGRRRGGVVPSCQQRAVVAPQASWYLLTLSPPMGRLWGPKARATSGCANGGGFVECEQPLAGVRILVGCEDASEGVRVRKEPAAAGGSCWCCRGMARVITALTAHDDPRCVMLTCTLIAINPEPGVPGALSKITRRVHTPYRSTGLKLACPQATGPLSTKHSSVGPVLFLQEDDDSAMTSGCVAEEPCELQHSYQARGERFGPNDPMEQWPRKPYGGTKGYGAHLNRSIVVHHEQQKVALFKRRNKAGQAVGRPAKCKARDGRWKGKRTGQQRDPQGKGNGSQQAGVDTGKRANGPGDGHGQAWHAGPRDKPRDAETMLDNLAERPKPARRKTSHRALNRKPHTGPANGDERQKSGSGQHKEKVNKHNGDNDEGQEDERKNREARRTSRQEQTDQQRTPAAQKTPHEAQYNRHTPDQTGEREQARENVEH

SEQ ID NO: 1022475 - protein, 69 aa, Homo sapiens
GGIGVKMEEYAREPCPWRIVDDCGGAFTMGTIGGGIFQGNQRFSQFSSGSKPQTTAGSLTAIKQPGLHS

SEQ ID NO: 1022476 - protein, 99 aa, Homo sapiens
GGIGVKMEEYAREPCPWRIVDDCGGAFTMGTPLVGWVGYSFHTPNSKGGFSQFFPWGDVKNQQELTEGRDVFGKPRASNCEIHPKGAFPQARLFQGHGA

SEQ ID NO: 1022477 - protein, 97 aa, Homo sapiens
MTLTGLRCWTHFGIPEQEYRCVVKDGLLGELTVICRNLQPLLEMAVVYLGAHAARDSPGTWNSRLRPYWSPTFCAQTGTVHKMRTVHNCSGRTFEAH

SEQ ID NO: 1022478 - protein, 152 aa, Homo sapiens
AGVDVGVGVGTGVDAAVGVDVGTGVDAVVGVGVGSGVDADVGVGVGTGVDAGVGVGVGTGVDAGVGVHVGTGVDAGVGVDVGTGVDAGVGVDVGTGVDADVGVGVGTGVDAGVGVDVGTGVDAGVGVDVGTGDAEVSVDSRRGREFSSSRRP

SEQ ID NO: 1022479 - protein, 84 aa, Homo sapiens
ASGIWLSSAMASLEVSRSPRRSRRELEVRSPRQNKYSVLLPTYNERENLPLIVWLLVKSFSESGINYEIIIIDDGSPDGTRGCC

SEQ ID NO: 1022480 - protein, 84 aa, Homo sapiens; identical to SEQ ID NO: 1022479

SEQ ID NO: 1022481 - protein, 84 aa, Homo sapiens; identical to SEQ ID NO: 1022479

SEQ ID NO: 1022482 - protein, 297 aa, Homo sapiens
RIMEFLSEKFALKSPPSKNSDFYMGAGGPLEHVMETLDNESFYSKASAGKCVQAFGPLPRAEHHVRLERTSPCQDSSVNYGITKVEGQPLHTELNRAMDNCNSLRMSPVKGMQEKGELDELGDKCDSNVSSSKKRRHRTTFTSLQLEELEKVFQKTHYPDVYVREQLALRTELTEARVQVWFQNRRAKWRKRERHGQIQQAKSHLLPPMIYQFGQGLTAYHRFRTIVGGMPGGLGPHCCSSELPRFELFMLEIRYGCTPNISAQILASLGRTLKPVRGSSKDPWGHFEYPVGLSTTL

SEQ ID NO: 1022483 - protein, 66 aa, Homo sapiens
AVITLFNEPSADDSKKGPLTVAQKKTQNIMESFENPLRMYLPHWDTVLPSLRQRSSIHQPNSMKSA

SEQ ID NO: 1022484 - protein, 212 aa, Homo sapiens
MLQWLVGHRVILLSGGYVLWVKTMRHCGQIDVHIFNAVSLRWTESCAPGEVVPSVGKAPVVPYMRYGALNASSSTDTVLLWGGRNDTEGACNVLYAFGRQRTVFPSDIHKLDTSTMTWTLICTKGSPGRLEGLPLSHNAGKSHVCLRGPCRSVWAIAIPKMRFTVDRIRVFDSQMKAWVVRSPDIQMLPEGAPESTRALGTREHAIGGEKDR

SEQ ID NO: 1022485 - protein, 254 aa, Homo sapiens
MLQWLVGHRVILLSGGYVLWVKTMRHCGQIDVHIFNAVSLRWTEAAPLVKSCHPWARLLWVPYMRYGALNASSSTDTVLLWGGRNDTEGACNVLYAFGRQYVSKWFTPRGVRSQYPGVPGMDIQPVSYGKIMLHLMGATSSRRTVFPSDIHKLDTSTMTWTLICTKGSPGRLEGLPLSHNAGKSHVCLRGPCRSVWAIAIPKMRFNWNRIRVFDSQMKAWVVRSPDIQMLPEGAPESTRALGTREHAIGGEKDR

SEQ ID NO: 1022486 - protein, 275 aa, Homo sapiens
YTETRWQKWQNKDDQGSTDRQRGPAPTGAGRRPAGAWGGRGRGSTNSKLTMGRGCLVSLPEPRPPGLLLCESHQEPRARPCPQGFLLFSCAPGEAEGEGWRRPQHSLISMCTRVYVCMRVCTCVCVCVRVCTCVCTHAWPPVVCTCALGSEASPELGAGWRGKGMLWGSVYLRKQGPPSPFCLVSPVASGPPSSLSASHGVVQAGTSRYPFCTPWALGALKAGGVYTGSTSTSPELVWALVHKHSVAERQRIQAAMLSHLLRAFLSHRPPRRTRG

SEQ ID NO: 1022487 - protein, 88 aa, Homo sapiens
MCSDDVTSYCEDALTRCPRAYLVRLPLSTDSFQMKEPYSLTKERIQLCLTWTLPSCAHTGNYRIERRPEHAVGSVWAASRSLPLYRAI

SEQ ID NO: 1022488 - protein, 56 aa, Homo sapiens
LKCSECMLMNIAPLSKGELCSTHSPAFDREALGGDVVVVNCWNTKERDLVKEIRPS

SEQ ID NO: 1022489 - protein, 104 aa, Homo sapiens
MPVGVGRHCSERIGNEKVATPFLPCIHALLHGATAWWPWFDHGIWPQVRPPKGGGKGDLREQQLRLSCYLKGEPLGRCHGLCARLSLLQDQFVSRFLRVTKEGG

SEQ ID NO: 1022490 - protein, 124 aa, Homo sapiens
LPPENSEDMNSRQAWRLLLSQGRGDRWVAPCSSEREEKVPRPPPGFTPVCWATPMPAPTLPMFAPRWRGTEESTAFLFLKRTFEGLGFARGSFSAVVPVFGDKRLVISSGANVRVLHYHNQGGI

SEQ ID NO: 1022491 - protein, 240 aa, Homo sapiens
VVVVWVYSGRMPEDTRLFAVSPSHLPVGIFATNDVWCAAHCWGVGGVHCPLWWSDPPPRPGGPLFEVPKMVMVGPPSVSAPSECYNFPRCGTSKGEKLVPKFNIDAPTRPSVGAPNTKKKKGLVEGGVNTTCPEGRFLILLTTQERMWVAPFYKLGGHNLEKKFPSGCNHEEVVLCWEKENGDRRRPLCGVGFVLGGAAHTTNRRGGVLILTRGILREKKVERAPQKVPHVWCSFPPSAR

SEQ ID NO: 1022492 - protein, 185 aa, Homo sapiens
VASGLDINSSVKGARSVRFSDAFNIPLITFVDVPGFLPGTEQENGGLLRHGPKLLYAFAATVPKITVLTRKAYGGAVFMGSKHLCGYPHYPWPTAEAVMGAKGAVEVLFQGHENVEAAQAKYIEKFANPFPAAVRGFVDHLIPPSPKRARCCDLDVLASKKVQRPWRKHCKYSIVNKSKETETKN

SEQ ID NO: 1022493 - protein, 227 aa, Homo sapiens
MARQGLYDRLPPLPVTPRHGSGAGVVIALGLQGVSDRKAGERVMVLNRSGMWQEEVTVPSVQTFLDILTSEEVGEVTIMDVWALPKATGRVRGRPAAYLTHHPFPRELLCCFLSPRLAQSPPVCVPCAFSIMTSSYPSRYLEPCADIRQRIESVSSGYGANLCESSMYRVISLDVPSDLGLTQDARLMGYDTDYLNTYRYLWYPQSFLKPQYGDNFQYIQGFHCTLL

SEQ ID NO: 1022494 - protein, 118 aa, Homo sapiens
MARQGLYDRLPPLPVTPRHGSGAGVVIALGLQGVSDRKAGERVMVLNRSGMWQEEVTVPSVQTFLIPEAMTFEEAADLPRQLRYQTTMVLFDFGNYSLATASGYTWLAGGVGMAAVHC

SEQ ID NO: 1022495 - protein, 253 aa, Homo sapiens
ECGGARERRQLGAAEPREAEGAVAAAHGDDEEIPRVCPSLFPPQDSPYSSLPLQSPELLEVPASIPQTSAGISLQHLLRQQGETPITPAGQVVLDPDNPKDGNMLGIKTSSSVTWWGTMSLESFSAKRIVKPNKNLNPKVHSTPRVFHVENLKQQLWVTETQMWETILLLSMARVAGCFGAPGPMPCVSHSIERMPGKLVLGKQCAVAAGQTLELHLAGKLRLRDQGQERLGFTGYLDRSRRLQARTACRNRA

SEQ ID NO: 1022496 - protein, 137 aa, Homo sapiens
MAPCKGEGKEGENHGHSRLGASTVAVKERNVFGVCPQILCIPSNDTLCPKSRDLFGQGTLCPCDLVGLRLRPDRDESSTHMLLCWLPRMCPEVKELGITALHIKLRATGGNRTQTPGPGAPSALRALARSGIKDRAD

SEQ ID NO: 1022497 - protein, 70 aa, Homo sapiens
RPRRAAEVDDDLARLDKLFRFVDLFQLVGRTRPVTLFLCQFDIRVVNVVVNPVFIEFVLGHSRKILLLCR

SEQ ID NO: 1022498 - protein, 241 aa, Homo sapiens
MREAAGGGPREGSREDLFEALRTPPPRGPPHCRFRKPCLNPKADRKMSSRKVLKWGHPCPQISKATVCYAKKGQVLKDITPGLLYQGKNFVGVLSFNPSCDFTLCVCPTEIMWFTVHGGKNDITGNSTCQVMGGFCGILISVISALGQIHLKKQGGLGPMDISFGIRTRKRTMCQDYGVLKGPDEGISSGPFIMRIRYLEIMNDSCGRLGMRLELVRAHGPGNWVSVVDWVSHHLVQGEFS

SEQ ID NO: 1022499 - protein, 563 aa, Homo sapiens
GGGSKSGLCAWTKSALSSIGGFTQIAQNAGVKVVDGYQNTIIVPECGRCTDGRMSRSIAEMGAYVSILEYKNCEGMILLSELSRRRIRSINKLIRIGRNECVVVIRVDKRTTGIIIAFSPTHSTAVSSQQAQPITTCASTQIQQHIPNSCFISHSLRPCMLQVVQHINTTGMQHAVNSLFPAGTVLGSIACTKYHRSTLAHGCRMHAISRHCRSPAAHLIFGPSVYSNLDMQACNRASHSIQSHHLTSGCCAPRQGWSKHSAAQTHSARSGLGRLRYWTGHLTWLVTHKNSPLQQARSMDIVSHRNTFPIYSFPSNITRTYTRGTVHMTVTEQTIGRRNTDRHLSWSLPVQDILRSDITRQNTLADTRRDGCTTGSTRASAQNKLFTQTFTNCKHWDIRRPPRTWMNELATTENWDKVKREHDTVRQKSVKQTKLSNYNQFVRQHTVHNLEEPHTSSASPEVATTTLERRTTDGHDLHQQTAIVEQNKRTTTTETIVRHMNENASNPNRTHSHYSRRGTLQHSTTTTRHHVTTTNPINQQQLTLDTQTKIPHQRRPSRHTTND

SEQ ID NO: 1022500 - protein, 150 aa, Homo sapiens
MLNDIDECQTRHETLVIIFCKNIVGSFDCGCKKGFKLLTDEKSCQDVDECSLDRTCDHSCINHPGTVACACNRGYTLYGFTHCGDTNECSINNGGCQQVCVNTVGSYECQCHPGYKLHWNKKDCVVKGLLPTSVSPRVSLHCGKSGGGDG

SEQ ID NO: 1022501 - protein, 372 aa, Homo sapiens
PEVPPAWGSTRTLIYILEINMAKTSQTVAHLFLVYDARQQKGLTSSGGSMERAVILELKRAVCERRGLPFDGRHPCLGTWRYYMNQVGGETRYCVEPVDLLKDYFPVQVVTARCCCGIYQELLGLAFHHRGGRLVPVPEDVRLYTARDAASGEVVGKFYLDLYPREGKYGHAACFGLQPGCLRQDGSRQIAIAAMVANFTKPEAADAPSLLQHDEVETYFHEFGHVIAPALAQAEFAMFPGGPTLSGDFVGGAVADAGELGCGSRKRCCGISGLPTGSAVPRELLEEVIESPGGHNRAFLTLAGIVLSHGWTTGPFTEKGSCPRESICALFGKHSGPARRKQFCGPCHWRVLYPNWTVLRETETNNTHKVLA

SEQ ID NO: 1022502 - protein, 168 aa, Homo sapiens
MRIEKCYFCSGPIYPGHGMMFVRNDCKVFRFGKSKCHKNFKKKRNPLSLLGWNRQHSGKRSWNRAYTWMILFEFSNVEMKPIIHTMQRAYGDKTIDAMKRVEEIKQKRQAKFIMNRLKKNKELQKVQDIKEVKQNIHLIRAPLAGKGKQLEEKMVQQLQEDVDMEDAP

SEQ ID NO: 1022503 - protein, 163 aa, Homo sapiens
MRIEKCYFCSGPIYPGHGMMFVRNDCKVFRFGKSKCHKNFKKKRNPRKVRWTKAFRKAAGKELTVDNSFEFEKRRNEPIKYQRELWNKTIDAMKRVEEIKQKRQAKFIMNRLKKNKELQKVQDIKEVKQNIHLIRAPLAGKGKQLEEKMVQQLQEDVDMEDAP

SEQ ID NO: 1022504 - protein, 174 aa, Homo sapiens
MRIEKCYFCSGPIYPGHGMMFVRNDCKVFRFGKSKCHKNFKKKRNPRKVRWTKAFRKAAGKELTVDNSFEFEKRRNEPIKYQRELWNYKTYFGLPELRTTQRTFRHDNSEPGTRQAKFIMNRLKKNKELQKVQDIKEVKQNIHLIRAPLAGKGKQLEEKMVQQLQEDVDMEDAP

SEQ ID NO: 1022505 - protein, 180 aa, Homo sapiens
MRIEKCYFCSGPIYPGHGMMFVRNDCKVFRFGKSKCHKNFKKKRNPLSAKKVLRVGPKSNSGNSSWVNELTGGLNPIFGKTFCGEKKKPLGKIEPIKYQRELWNKTIDAMKRVEEIKQKRQAKFIMNRLKKNKELQKVQDIKEVKQNIHLIRAPLAGKGKQLEEKMVQQLQEDVDMEDAP

SEQ ID NO: 1022506 - protein, 136 aa, Homo sapiens
MDAELEFATSAQIQLANNFFDQVVNNQWLLREVWFIGLQYVAQHKVILHWFKPKYKGYHSQDCSTTQQNSFTRSSLELNFLSLKMLPDEQLIQEHNPETLLPCKLQNAISKLMRYIAPPENCKSYGLTYACPKPKY

SEQ ID NO: 1022507 - protein, 157 aa, Homo sapiens
PTRRDHASPTRSLSGQVVGGKDSGSVLTRPWPEAQWPPALPPRTNSVTSQAQSWTAHLGTRFSHFLRTSPRLEERSEEVGDGLFARTPAAGPGEAARRRRAAAGGDMAEEQDLSEVELSPVDSGGAPLTVPGGDAPSCRCPDGRPAGRIRALRSTAR

SEQ ID NO: 1022508 - protein, 145 aa, Homo sapiens
RTMAQGQRKFQAHKPAKSKTAAEPLKRIGAQEKAVVLSLPRRRASCSSKSSRENLEVGIRKKIEHDVVMKASSSLPKKLAPAEGPAKKKGAACLPPPPRHLPEDAGPSAGQIPTPYLHIGTLQGPSHRLHVSGKRDPVPPARGFT

SEQ ID NO: 1022509 - protein, 84 aa, Homo sapiens
VEEQASAAVAGCRFDKIKAAGKWTVRFREMEGSGICIDDAWREDKLPFMQDVGNTTECSFLNLNKTMSGTTESVKEQRNEVEQT

SEQ ID NO: 1022510 - protein, 178 aa, Homo sapiens
VEEQASAAVAGCRFDKIKAAGKWTVRFREMEGSGICIDDAWREDKLPFMQDVGNTTECSFLNLNKTNWWGNQTKENSLAPNKGKTKERLDSCDYDFSTNQVTVQLRMFPPCGNWTLWFLFFVDGFSQSTQIKAVVVFSVSKIQTLVSNKSASQECTAQFSWWVAKCKWKLNEKLEISQ

SEQ ID NO: 1022511 - protein, 334 aa, Homo sapiens
VLPGPTFHPVPWTLGWVAPPERPKSRAFQGALQSHKSSMAAARKPKKPFPGVCTDLGDLRLENYPIPEPGPNEVLLRDAVLWAICGSDVHYWEVWSNGELSCVKQAPWLLGHDSFRGSSSDRKRGTHRYKAPIQFRGECVCAYLSRLVASPQKSDRTSCKKRADTNLFTFHAFFCATSSPPYDGEHSAGYYKQQSAAFVLQSFLTNVTFEEGALIEATFAGGGIHDLQEEEELPPGNTTVLCGGGAGPIRDGHFAPGQSNGEHAKVVVNDLSATSDCAIAKEIGADLVLQISKESPQEIARKVEGQLGCKAGSHIECRGKRAPSRGAFKQFVWW

SEQ ID NO: 1022512 - protein, 111 aa, Homo sapiens
MPTVSVKRDLLFQALGRTYTDRKNFDEPTVFELWVWTLDEIKDLSFYVQGAVRPLITSILMFGPLKQGCLLSRKKLDAIQCTVEGESANYIDKRHNYTNQTNHWNWQKQDI

SEQ ID NO: 1022513 - protein, 178 aa, Homo sapiens
MPTVSVKRDLLFQALGRTYTDRKNFDEPMYLNFGSGRLMKLTTLRTETNKVQLTPGNVNGSRSLCCCIFTNTLTVPCQYDIDLLVVLDRESGSQTGLSKRSFPTDRTQGIEYGIPVCYLNTGGKMALDWDTKFPRHKSSTSHFPRENKVKLTQPFIGLYRYPFFGAGGYEPGPRFRRG

SEQ ID NO: 1022514 - protein, 185 aa, Homo sapiens
AGEGYGKPPAGNPGRRGTVDRCPRPTAGLGLVSGLRTLEALVDHPFRSCPKWSWNWMLVTKICWLFLATMEQCDDFWETVQPDCRPVMDPYCDMVRLRLFLSVPELTGEVSMDSAGGSLLSPPASCEHSQALSNPRALSTMTITYSSSQGNTVSMDLESESCQKEVGDPRRLQQHMEELAEQEIR

SEQ ID NO: 1022515 - protein, 69 aa, Homo sapiens
GPSHATSREASWAQAAAFDIQRNRCHRHSSGSRMGYTEGSCSLLQQSPLAKMHDSQSTFYSHCETLPKC

SEQ ID NO: 1022516 - protein, 381 aa, Homo sapiens
MPGALGCAKYFRTPRGVEHQSTAIGRVWAKRQHSALFFQNRRAPIEGGESHNKKEKSGGGEPPHVCSKGKKEFGVYEMGERTHPVAVIGFQQKLMRKLFLGRKAPRCLVLHPRGRPNKGDPPKMVAQSAEVGSFNKGGSSLLCFGKDGRSFSLPVEMFRPKRIGVGESVAQFVIERKISSKSAWRFYPLEKKECVSQRGLLKKPLRALGAVEHVFPTTGAPIGRSSLYHPVGDPQNEEGVPPIGVPTHKYMRHDNHIGILERLPHTVWNKVATGAFTTRRRGVYTHERLCRASVSSLCVVGCVFICSIDKTPAHPLLIYRRYSREKTPLSYIALNGPPDTRGVSAHTYLPGEDDEMIDECENIYFEAPSRECAHSTHNETL

SEQ ID NO: 1022517 - protein, 140 aa, Homo sapiens
ANETFKNGEADAWDTVTVSNIAKFLTDLGSEEVFVNDYGDIIENPDREQQVKKKSKITVYFDNLRKINKEQFSKFRDMADLNFRSSDFASEETKGNVFSSMMSGINLFLQDNIAKLTSKNSIDLESVDAAANLVVVVGGR

SEQ ID NO: 1022518 - protein, 202 aa, Homo sapiens
ECSQCAGVGLSPCQSAAACGLVALWQRRRQDSGTMSGFSTEERAAPFSLEYRVFLKNEKGQYISPFHDIPIYADKDVFHMVVEVPRWSNCKQVEMATKDPLNPIKQDVNNRKNSAMSANSFPYKDYTLATMAAIPQTWRKTQATFDNTYCCSVADTLNPIDVCDTSDAAYVQGGDILGVKRSRHYGAMIDEGENRLERSFAH

SEQ ID NO: 1022519 - protein, 128 aa, Homo sapiens
RRLSSQMWPVPLICVQVAGVVASEIVHAAQVVRVGLSDTKVPETDTCSPYTIVTVCLRKAACGCKSHLGQRTQQLCFLIPTASSRPHFLGIFVDMMYPTPFVKALPVNCPAQIHLCLGHGDGDGLPSK

SEQ ID NO: 1022520 - protein, 112 aa, Homo sapiens
MSRSPDAKEDPVECPLCMEPLEIDDINFFPCTCGYQIGRFCWHRIRTDENGLCPACRKPYPEDPAVYKALSQEELREDQRMRKKRKKMRETEKISENGKDLGSVRVYKKKLV

SEQ ID NO: 1022521 - protein, 141 aa, Homo sapiens
MEENLVNSEPQLSTSGSISTADGSALVKWGKYYSNSVELKQNFAAPINRCPLIKDTLFLMWIYHALCSSRFRSGPPGEEAQVASQFICRCHLKNSQIIQKEDLCIFSRKACLGFYTGDLILPRLRWKHLWMPAHCACARRV

SEQ ID NO: 1022522 - protein, 103 aa, Homo sapiens
GFRVGRSSMRSHESLQVYRYGINLTDPMFRGIYRGVQKHQDDLQDVIGRAVEIGVKKFMITGGNLQDSKRCTAFGTNKWYAQYSWDVILQDVVNLKRITLIFT

SEQ ID NO: 1022523 - protein, 243 aa, Homo sapiens
MTKARLFRLWLVLGSVFMILLIIVYWDSAGAAHFYLHTSFSRPHTGPPLPTPGPDRDRELTADSDVDEFLDKFLSAGVKQSDLPRKGDGAAGLAPGSIGRKSRERATTGSPGDARAQPRPGPGSRRSGGACCGGFVRQLPALPFPTKERAFDDIPNSELSHLIVDDRARGPSTCYVPKVALHQLNPSSPLFSNLYPNPHHNIHTHNFLYFNLLHPNNFNLNNNTNLFFLYPSLPNPSYLINIY

SEQ ID NO: 1022524 - protein, 186 aa, Homo sapiens
DIELRAHLRTAQMRAAGHPPHLVSRSSSRHMYWSEAQMVTHHTINGCDLRPGDLLGTGTLSGPTPGSEGTLMELSHGGNDPITLPNGEIRTFVEDGDEVLLTARARRPGAASIGFGECVAVVQPAITYPDFSGVMHQAVRHLVVHVGEEAADHVFDLSESSGAEKNWLIVRDVVGLHPHSADVERP

SEQ ID NO: 1022525 - protein, 359 aa, Homo sapiens
MRRDVHPVAHKTEEPLVTYEGGACAHDGAPHLQTAHTQATITSPTETRAHNTGESTRRRAPLRHNNSPHQKSDPTRGRVREHADHAYRYHTLRESERGAAPTRERGDTSAAVTTGQTERAETRPREQEKSKQQMRRQHLTRRTETHRPTHRPRTRTPNEREESEDTPERDTQQPASRTTPAAPSPTKRKEGTRATALNGPPPARNRNHGQRQHGERQHHPPKRRTDQQRRPIQRRGGTPQRPNRRQPRRPRRDGEPSHKPPHNEPTKEPARQRSNTHAATHTHRGRTSNKNRTERKNSSHHEHIHAIRRRRQNYTTDTRQEAQARQQQNTAARRQTPTTRTDANPNQRHGRPEKSIERR

SEQ ID NO: 1022526 - protein, 194 aa, Homo sapiens
PLIGLLFWCFLLFSVRLVSVTEWSSVWCVDVGWCSIVVWSVVCCVGVVWGLWCWWLVGVFVVGVAVCWWWFVVCLFLGGLWVVVVWPDCSLGVVPRTFDPMPLCVFDEPPMRCFGGPPQCVTSGKGFPSTRGGAPIQATALCLYPPRPDGMLLFFCVPIWVLRSPLCVVGGIFVHSMGGPHWGIGMPRRVGTGR

SEQ ID NO: 1022527 - protein, 97 aa, Homo sapiens
QNGDAAMEDLTRLKETIDNNSVSSPLQLFSREHGSYMVSAGFFNHPKGRDNIMDLFLYQPQYLNAIQTMCPHILRYSDYSSHNKQGCRTTSAGYERL

SEQ ID NO: 1022528 - protein, 97 aa, Homo sapiens
QNGDAAMEDLTRLKETIDNNSVSSPLQLFSREHGSYMVSAGFFNHPKGRDNIMDLFLYQPQYLNAIQTMCPHILRYSDYSSHNKQGCRTTSAGSNKI

SEQ ID NO: 1022529 - protein, 85 aa, Homo sapiens
KNQNLQPVVISKSFYVQILSLHKGYYLRFAALIVDFSVDHNFWIRRLQLLSVDVNLRTSSTGFLSEILHKKSAIWVLICCNKMKI

SEQ ID NO: 1022530 - protein, 103 aa, Homo sapiens
GKQILVCVPQAGSALGTNLGPRAPPASVGPGNFPCLSLPSKREITGHPTTQCPANFGLFLTKELIMVYLIKSGFHQLWARRVLNSGPQVILRHGPPKVREFQA

SEQ ID NO: 1022531 - protein, 215 aa, Homo sapiens
GHSAPGPGSGAAGSRFGFVAPVPGPGRSLRPPQPGAAAGGVGTLWTHPSGPRRRSASGPGSQSRRPRRPMESQCDYSMYFPAVPLPPRAELAGDPGRYRALPRRNHLYLGETVRFLLVLRCRGGAGSGTGGGPGLGSRGAWAELATALAALASVSAGGGMPGGGGAGDQDSEPPGEGILGGEAVVFRGCSPLLYATGPGTCYLKGSDHGEELWGT

SEQ ID NO: 1022532 - protein, 62 aa, Homo sapiens
MAEAEGRGGKWRSVDCPLPCPTRLLTLYLKTGDALEGDLGGAGRRLGCGGVLNLTEAGDAER

SEQ ID NO: 1022533 - protein, 107 aa, Homo sapiens
MKSKSGHIKFLTKGDNNAVDDRGLYKQGQHWLEKNRCCGESQGFVSYIGIVTILMNDYPKFKYAVLFCWVYSCWVIVSKNLLAVWEDAIVSYWRWSHTGWIGGLANT

SEQ ID NO: 1022534 - protein, 75 aa, Homo sapiens
KKVAHLGRLAHEVAWKYHAVTSPPGGEEQKEEPRVPFPGEETSSMRLPETRPEKNLEKGNVANTTRGPPDPRLLV

SEQ ID NO: 1022535 - protein, 405 aa, Homo sapiens
FVVISAGCVFLPLFTWLVGGFSSSVLPLLYAVAAARPFIYHFLCLGGRPPNITSPIFFVLGREALLLLERGIIFFGRPPFPPHPYWREGAITCLPALSCGGALVSVTKRVVVFVRARQYSLLSPPLLLAVVPKVGIYASVNFGGGGFSTCALAPAVSKGVLSVRVSLVKGRRLPPKEKKVVVAPQYYFVGALPPFVARSTTEEEFFGSVGENGVFRPRRPLGGSHCFHPPPWGRVKRERGGEIEWISLPKDSLSFTPAVIDYRDTHAFFIRGGVNTGRHTRPPRERSHVCERREEVCDPHKPHERFLSPGGALRRLSSGVCEAPPNVKELCVEYVLSLGVCASGPLRSPLLVWAPSEISNAGDPTGGTRTRTVSHRVGAHTVHRPLGDTQRRSSGERHTGEKGVL

SEQ ID NO: 1022536 - protein, 100 aa, Homo sapiens
RLPVLSPRRRCLRLPLHARFFSPGRGPGDQSEEAGTMLPTQVDGSRTTIEPRSVFNVQEMKTEFRNFIVWVEDQKIRHYIVLKTEGIYRDIHSSDWPKFY

SEQ ID NO: 1022537 - protein, 87 aa, Homo sapiens
MKPDGRLGSATARSHQTEPTARAPPGCKKGKEAKMNPLSKYESQRLTAVAITAACETHTLDPDRAAAVCVTPPLPLGGTGLTLPPPH

SEQ ID NO: 1022538 - protein, 106 aa, Homo sapiens
SQDSVHHTSGDKSTDYANFYQGLWDCTGAFSDELSSKRGDVIDILSKEYNRYGWWVGEMKGAIGLVPKAYIMEMYDILRVLEKENSSAVCKCFGFRSVTESTSDSS

SEQ ID NO: 1022539 - protein, 177 aa, Homo sapiens
MSSASGLRGGTRQVGEENMTETDAFYKREMFDPAEKYKMNHRQARGIALIFNHERFFWHLTLPESGHLRQIEDKSYPQFPDLGFDMNALMILKAEELLLKIHEVSPVRPTQMPGCALCVSPEAMAEGNHIYAYDASNSDTGCSRRQVSQPVGPDIIISRGTSTMCHHPWMYSIDELD

SEQ ID NO: 1022540 - protein, 83 aa, Homo sapiens
GVASVLRSSELYKVQKDSVSEDEVTSEDHYIYFQNGRIIPKLNIAHGNAYVDMLGSVYEGVLANDGVWACGAGARPTSHEVFW

SEQ ID NO: 1022541 - protein, 103 aa, Homo sapiens
HASRNLDFFFNYCKNVKPILSSQAMEKLVGTRPSSLAGWAGEGAVTVAAATHCSVWKTQDLAITARRTIMCGRSLRDAVSCPRALFIFCCFSALKEFTWKHVL

SEQ ID NO: 1022542 - protein, 67 aa, Homo sapiens
MTWGNLLIITGMIHLMNSHHTTPPCTIFLSILSLADMGFTSTTVPRMIVNIQTHSRIISYAGCLTQM

SEQ ID NO: 1022543 - protein, 120 aa, Homo sapiens
GTASGLLRDWTGRRSKARPPFALFVGLIMKRLGSVQSENAVCVCDGGEQRSLPPKKGASAILKFGHTDTCQSHKAIQLQIYTVQFHTEKVDWQHVVYVPTYKDQPYLWGSTSIEKPTKQS

SEQ ID NO: 1022544 - protein, 121 aa, Homo sapiens
GTASGLLRDWTGRRSKARPPFALFVGLIMKRLGSVQRKMPCVFVTEVNRGAFLPKREHQVSTYWGNPLISHILKFGHTDTCQSHKAIQLQIYTVQFHTEKVAGNMCECSYLYRSAIPMGLD

SEQ ID NO: 1022545 - protein, 105 aa, Homo sapiens
LKLVSRGAAHWWLGQCRAPIGRYREALVAFRLDGAGQPWYAGFWVFEPAAMSDLHRLNNPGSGLTTCGRATDRSVPGKRFEIAFYKTKVCVCGELCQVHKKRDSS

SEQ ID NO: 1022546 - protein, 132 aa, Homo sapiens
LKLVSRGAAHWWLGQCRAPIGRYREALVAFRLDGAGQPWYAGFWVFEPAAMSDLHRLNNPGSGLTTCGRATDEACREALRNRLVQKTRVVGWRSGVEKDLDEVLGDPLSVCKVFLNGQVAKKEDLISAFGNR

SEQ ID NO: 1022547 - protein, 68 aa, Homo sapiens
EAVVSGDDLAVRQLVATSTRQELGSSRGHLYARKSSDDCSHMLSTLTVTALISLLRAVWVCSKLVSTL

SEQ ID NO: 1022548 - protein, 269 aa, Homo sapiens
MDEKVFTKGAGPSGSEQLNDVQAAVRVPGQEPLASKAKEISDKEESNVQEVRCPSYLSVENVHGQFHDLMEPVQKLRGNINQDTNYLVYWEHYCRPSGYYFTLPTVTAACTLLQVPLTVNPITTASRDIPEQQTRSHKFSGPYDALFTKIWTLPLFANFSPDLLDYLPLTALGGWARSSVYGGWSPRPFYRFGWVHIRSLGSPTGKFPMRVHCFTCVARSQYGGGGGISLRGGLHLCGREFFAAESLRGPVCVTPPHGGVHGGAGLDGA

SEQ ID NO: 1022549 - protein, 71 aa, Homo sapiens
PVPEHACLPAGRRVFTTAQHASLYKIRRHVSTVLTSKYVKLEPGRRVFTTAEHASLYKFRRHVSTVLTSKY

SEQ ID NO: 1022550 - protein, 138 aa, Homo sapiens
EIDAIHFYNKSLAEHRTPDVLKKCQQAEKILKEQERLAYINPDLALEEKNKGNECFQKGDYPQAMKHYTEAIKRNPKDAKLYSNRAACYTKLLEFQLALKDCEECIQLEPTFIKGYTRKAAALEAMKDYTKAMDVYQK

SEQ ID NO: 1022551 - protein, 91 aa, Homo sapiens
NVIINAPYLDYYERLNYYFKNYVSEAEKILKEQERLAYINPDLALEEKNKGNECFQKGTGCSWGIGGAVLGVPPVPGCGVNGRLHIEGADM

SEQ ID NO: 1022552 - protein, 198 aa, Homo sapiens
GFGMADFFWPGGPSCRLIRREDVEFQKEVAQVRKRITQRNKNKNNLLLEQSMCAHPPNLLARNPDLCHYFFPALASVTTVQAVHEVNRTWKIATGYAIGGVGALRMLPKIVAETMNNYLFGVEQNFLEVSIIIATLEKKYIKELLIKDWTLFHFKQAIISISGNGFNRKSGQLTTKSYGLEERFIIRTEHDYSGQKVS

SEQ ID NO: 1022553 - protein, 103 aa, Homo sapiens
MSFWSWKSHCLLHGPEKPLAGVDDFTFFPIRSTMLTSYILPVSSDDILGPALFVSDRGKMSVTPFICWLPVRAASGSRMDLEDVATTVPSWEASSDLLQPSYF

SEQ ID NO: 1022554 - protein, 357 aa, Homo sapiens
DNCWRTVVAQKVVLYSSSELCLAMAWKSGGASDWGAPPQSPHHMESITAQIKYRESDAWLQDRSQYATMYPQYMDSSTINRFPSNNQLLHTCMHMPKNFYLISCMKELKLLHVGSGSGIPYCMFARMVGCTGKGHRIDHIKELVDDSVNNVRKDDPTLLSSGRVQLVVGDGRMGYAEEAPYDAIHVGAAAPVVPQGANRSVKARRKIDIACWSLQAETKCWSSMTSYKMAAIQNEASDGGDYSWCHFTQYKRKAVAPGMNGKSKHQLDQYKITSGMVISVLKAVWKTKTISSWLWTGVTTVYLFSMNICVSYRVSDSSKRHKSQIGQRKDAKVFNLCNITLDIAHSFTWDNIYKKGV

SEQ ID NO: 1022555 - protein, 237 aa, Homo sapiens
DNCWRTVVAQKVVLYSSSELCLAMAWKSGGASDWGAPPQSPHHMESITAQIKYRESDAWLQDRSQYATMYPQYMDSSTINRFPSNNQLLHTCMHMPKNFYLISCMKELKLLHVGSGSGIPYCMFARMVGCTGKGHRIDHIKELVDDSVNNVRKDDPTLLSSGRVQLVVGDGRMGYAEEAPYDAIHVGAAAPVVPQGANRSVKARRKIDIACWSLQAETKCWSSMTSYKMAAIQNEAS

SEQ ID NO: 1022556 - protein, 75 aa, Homo sapiens
LSRLRCSECGTSPSCSQASYAIVLPVYSIGSGYRMDFGRRESALDLQGSHVQTSTTFASPDEFIVGQNQALIEPG

SEQ ID NO: 1022557 - protein, 85 aa, Homo sapiens
RVSGGPVAPECTEDGGCCRTVAPSVGCPTCECHSLGHFCHCSPQACCMWKNELDKFIVFWFQSSKIIQHQFLMPCTCCHPACTLF

SEQ ID NO: 1022558 - protein, 85 aa, Homo sapiens; identical to SEQ ID NO: 1022557

SEQ ID NO: 1022559 - protein, 84 aa, Homo sapiens
RVSGGPVAPECTEDGGCCRTVAPSVGCPTCECHSLGHFCHCSPQACCMWKNELDKFIVFWFQSSKIIQHHAFSDKANEFHDVNL

SEQ ID NO: 1022560 - protein, 88 aa, Homo sapiens
VSLRRVLPGLDVVCLLRPLFALSFHFLQRASRMAHKQIYYSDKYFDEHYEYRHVMLPRELSKQVPKTHLMFCKKRVEETVGVQTRSLG

SEQ ID NO: 1022561 - protein, 37 aa, Homo sapiens
MRIVLVLEAEPASPERDYSPYYKTIEELRDKILTANS

SEQ ID NO: 1022562 - protein, 121 aa, Homo sapiens
MAETDPKTVQDLTSVVQTLLQQMQDKFQTMSDQIIGRMDDMSSRIDDSGKEYRGPHDTRAGVEELKSEIQDSCHAKELKVVIIYTESWLFSNAKRRSKWFLELTTMCRQVLLLIKYGILIT

SEQ ID NO: 1022563 - protein, 225 aa, Homo sapiens
MAETDPKTVQDLTSVVQTLLQQMQDKFQTMSDQIIGRMDDMSSRIDDSGKEYRGPHGIFTSVDLGSVCAIHYENTKTLGVLGITLSDFLVDFCEVISFLVNSFGSQLLVGSKVDCVIFYSTNSKPFNHSLRLLRDRKMLRRTLAAPLTPWHNVTVELTPNSVSGNTFSTWLKTPKTLAHSRNSLSLALLPNLRHKNLYDRLPGVPLDPLLKGRSTTLTPGPGLVV

SEQ ID NO: 1022564 - protein, 104 aa, Homo sapiens
HSSQPACRRFTIILNVNQRVDVSQSSLISTTVSRFHNHPKCQPACRRFTIILNVNQRVEVSQSSLMSTSVSTFHNHPNSTTVSRFHNHPKCQPACRRFTIILNL

SEQ ID NO: 1022565 - protein, 382 aa, Homo sapiens
QVRPGVNRTRLSPLLYDCTPAPSPKSPLFGLFDLLTWLRCTLCVCVFALRSLLRRLLYFNSYTVDALSRPPSPDPSDLRSLYDVIAVQYDNGPFPWVMAELMALNESSPPKEIHTTGAVLRLLDDFILTNGFTLPVGSQGTRPFSIFHGKCDAATRYSSVLGRQLQVFYATKFTSCGKIQSQQRLVRKMSTEKVDQKEEAGETRGVRRPDQRDRTKRRNHQLLHPICQGWRPGGRAARNARLNLGPDDLLSRHGQTSNYCLLWAQEVAVWGVPRCVVGAPDILLCSGVVFLYGPSISYCAVSHLSPVHFYYRTTVIPPHSSAPSLCQCLADYGTYRASWTRSVLKLDCKSWIKIGLFWHILYTEVRYLILRSVMWITVNLSD

SEQ ID NO: 1022566 - protein, 300 aa, Homo sapiens
QVRPGVNRTRLSPLLYDCTPAPSPKSPLFGLFDLLTWLRCTLCVCVFALRSLLRRLLYFNSYTVDALSRPPSPDPSDLRSLYDVIAVQYDNGPFPWVMAELMALNESSPPKEIHTTGAVLRLLDDFILTNGFTLPVGSQGTRPFSIFHGKCDAATRYSSVLGRQLQVFYATKFTSCGKIQSQQRLVRKMSTEKVDQKEEAGETRGVRRPDQRDRTKRRNHQLLHPICQGWRPGGRAARNARLNLGPDDLLSRPWSGPPITAYCGPRRWAKSWQAVPAGSLLQFGGALLHNPPFALGVCLL

SEQ ID NO: 1022567 - protein, 327 aa, Homo sapiens
GVGVGGLVRGAAGEAAGGQHGGGGRGGCAQVAAGEACEFQSRARGPVLTKAGLPAGGSLSAEVGERDPVSLGLPFPIHFRAFFFPENACPARAVPSFKCRPHGTEDCQARGKILSRGNSQVRGLKHRVFRTFTSFGAGPPKGVLPREPLDTTFEASGGYYFECDRTLGNHGRRESGQESGKQVVEVGPIREAPGHRYKGMCFAPQTTKWVFYLISIPSKRQRGIRWETHTFQETHSPTSIGLPDNFRVRGRHALSINQDGGPWVGHTLVGPQSTPIMTTLWTGRALQGTPSYQQDDSLSHHNVVILQHTGGLNLHPNYTAFNQYPKG

SEQ ID NO: 1022568 - protein, 40 aa, Homo sapiens
IDAGTPSDFLQCHLLQKAQPDPPNVEYKCPMCHMNAMCDS

SEQ ID NO: 1022569 - protein, 226 aa, Homo sapiens
PRYKVKEPEICAVGPLPISLTSPFKPKLEPTVHRPSMLSPWLSAMLTCKKQIKHMMAFIEQEANEKAEEIDAKAEEEFTHRDTGRLVQTPKTNRLWNYYENEHEKQIEQQKNIQMSRFDESSETQSPPEQEMTLSQDLLNEAKQRLSKVVKDTNTGTKVLAEWTGSPGFVLPVGWSPEVIVRGRENKDFPSGKWLQEQTGNSYCTKIGTNNDVDVHIDQESYLPED

SEQ ID NO: 1022570 - protein, 192 aa, Homo sapiens
PRYKVKEPEICAVGPLPISLTSPFKPKLEPTVHRPSMLSPWLSAMLTCKKQIKHMMAFIEQEANEKAEEIDAKAEEEFTHRDTGRLVQTPKTNRLWNYYENEHEKQIEQQKNIQMSRFDESSETQSPPEQEMTLSQVPVGWSPEVIVRGRENKDFPSGKWLQEQTGNSYCTKIGTNNDVDVHIDQESYLPED

SEQ ID NO: 1022571 - protein, 75 aa, Homo sapiens
RGSPCATLPSKNIFMKIILIHQGINLGLQLHLVHVGSIYILLQHHKLILSSGTLLISSSYLFLKSSTRSCMFLSS

SEQ ID NO: 1022572 - protein, 39 aa, Homo sapiens
MGGGHNNDCPPKSKGKHTTIPRGSDDEGSRTQRDAHKQQ

SEQ ID NO: 1022573 - protein, 338 aa, Homo sapiens
RALRRLGCCSQWCGVRKGTDLGALPACAEFLSAFPTQTGVSQSEALRVQPRAGPVCNLRRWAGRCPRSCCVLPPHTPMSSEFPRSQRAPHHDTPRKAMNADRTELPEIFSANSTDDCTELAKQHTQSDLVLNWGSHVVYQETNGETRVEIKESGSVSQDMLHYNRTNNQRCEYKHVMELLIMEYKHLKDCLCQGTIIGVIPYFPYSKQSKHEEEGTIVCKLLAIHAGESRFNSHYRLWIFIKGNTRLFRIPVTTLEPHLTAQYIREEFNLRQCRKSYVADAEGGPAYDESCVWVGRFREHQARLEWRRSNPLVDDFTRCVLRAGSPTCECPANGHHGN

SEQ ID NO: 1022574 - protein, 333 aa, Homo sapiens
AGRCEGSAAVVSGVGCARARTVGALPACAEFLSAFPTQTGVSQSEALRVQPRAGPVCNLRRWAGRCPRSCCVLPPPRSRFRSAPPSPRHDAVDGTEFSAIQALHGAGRSSIKSDLVLNWGSHVVYQETNGETRVEIKESGSVSQDMLHYMQTNNQRCEYKLCMELLIMEYKHLKDCLCQGTIIGVIPYFPYSKQSKHEEEGTIVCKLLAIHAGESRFNSHYRLWIFIKGNTRLFRIPVTTLEPHLTAQYIREEFNLRQCRKSYVADAEGGPAYDESCVWVGRISGNIRPDLNGDGRTRLEMTYPLRAEGRQPYVRVPRQRTPRQLDGAQSKLT

SEQ ID NO: 1022575 - protein, 206 aa, Homo sapiens
IFYSTLLKIKTTETKPNVPKLKEVGKQTGSKGSVVTGGEVDNSAVTSHSHPVATEEPRKRVRVALSVPFFHHEAPRKPVQENVKTITNIFNRASLVAKGSKERAVEIRNLSAKKGQAASSVDIRVCKKRLTTLNQHAGIRNSAGSDPGYGGGDKALGGGKMFSNQVRHTGKAFPPKGLRSTKARLGRTTTSSVPGCSHDHPGYNAL

SEQ ID NO: 1022576 - protein, 297 aa, Homo sapiens
QRSRLSRARQNLSQVPEADSVSFLQELLALRLALEDGCGPVALDPLRELMLHQIIPMLSCACEMTCLACWPAVNLVGAALRGPGWQRGMWPHEAVTRKLMLSPYDLESTSLLESEAPRHYFLKFAYIVDLDRDTVDKFLQLFGTRGVKRVLCPIKIPLVGPPRFTHCELRCWGEGAWTEAATYCEVHDYLTVLVSMGVMADDFSHKRPMTGGRRGAAEPTPLLALRGVTWTAAFSLLGFMALEVPLAQPFSATGGVCWNTLTGPWASMLVPGREDELLGGVGGRSGPRRGWSRASPF

SEQ ID NO: 1022577 - protein, 95 aa, Homo sapiens
DPPQCLGLQRTRILFGAVSPAQDDILLMRMTCKGWSRTGYGSHLMHNFLPCTYRDKFGQPPGLQRDSCSYSSDPMWAKERKLIPLLPSSGPGQKW

SEQ ID NO: 1022578 - protein, 282 aa, Homo sapiens
EISAAKLRLPGPGLCPGARLRPTTRTPASSGFARGPPSSHPRQTPVGSPSLTPRPPASTCNRVALPSSKFRGWLLTVYRNFPYTPSRGPWGRRRPASEEVDGAQVSPLGCPLENEDSEGWDTRWATPGQGPRPIKSRSHYRVPEQHETWRIIDRASISIILRSIPGSSTGSPISWGHEMQFEQHLTHCQIPTDISSMEITCKGLIHQNKRQAAAQRSRRDLMAIDHYSAAGNTTAKLEHYEDPLTGTNIAQRQDANEDDSLEEPKNPNDLHSNPVNLVQMGN

SEQ ID NO: 1022579 - protein, 70 aa, Homo sapiens
RDDPVACSKLFVVLCQRNFMEYFFPPPFLCFPLPVSPPSHLFLSFPIPCTLTSSWMHLLPSLSSCCFLPV

SEQ ID NO: 1022580 - protein, 72 aa, Homo sapiens
GYVPLWLLVLNLEPYPDMGLAGLSKMMLTESGDPEEEEEEIGGIIGSPNNSERAMLSSLEKCVIGPWERLEL

SEQ ID NO: 1022581 - protein, 122 aa, Homo sapiens
MQEVAVSLGVSQRGMLSRMMSPGGPKHSEDPGTPRGSSGDHLMGTPGFGLAFQGSKKCHTHWCLAGNTTVSTGDIKGQPQGTRVAGGLARDVDNPQKEYKLTRMVVQYQRDHLMGELGSHQE

SEQ ID NO: 1022582 - protein, 231 aa, Homo sapiens
MSYVNDALWTAHRAHSSMVGVNLPQKAGGFDEEGAELLCKGLESPERPFLAILGGAKLRTRSSSSSNMLGKVNEMIMCGGMAFTFLKVLEQSWRLATTRVDEEGAEDCQYDLVSKAEKNGVKITLPVDFVTADKFDENAKTGQAMVASGNTCWLDGLGLVVLKAAKIMLRLSLGLSRLCGMVLWGYLNGKLLPGEPQALMDEVVKATSRGCITIIGGGDTATCCAQMGPGG

SEQ ID NO: 1022583 - protein, 42 aa, Homo sapiens
MGYNLIQQVSILLDALRDNRPPGGLSSRGSLECPIHPLKFQV

SEQ ID NO: 1022584 - protein, 257 aa, Homo sapiens
EPSVETEDPSPETFRQLFRRFCYQEVAGPRGGPEPPLGAVLPLAAGRSCAPMEQILELLVLEQFLTCAACGEIQCSVRTAEQHAWRAGEEAVVLVWTGLHAECPSEDTCACCVAQMLAYLDDEVPPRGLGGDMFFKTSMCTMAHDHDVIWSLDGNDGSDSPDQTAPQTQPEPQATEGPAVVAMSRGPPAPPCISEMASASPFLSAWSQVPVNLEDVAVYQSGEEPRFLDPAQRDAPLENCRTGIQLEAGGDARHDAR

SEQ ID NO: 1022585 - protein, 109 aa, Homo sapiens
LVHASAPPGRGTLLGRPRVPPRCSVPSSQLEPSSSPAVLPQRLAAGRRQTKGLEPRLTLAFVPRPSSAAAVEAASPSPSMFGLSRLLSACVGERGTRRNERTGACLHGN

SEQ ID NO: 1022586 - protein, 159 aa, Homo sapiens
EPSCVLSAAVPFAAMPLENLEEEGLPKNPDLRIAQLRFLLRPARAPVKTLPCRNELMAAVRDNNMAPYYEAFVPKFPSTWQIDRGPYFNKMKKANEDELNDVWMRTLEDAREESRERAKFAMAIDGKGRVPLPDRVTKEGASLTAFRKIMTKCVPWVTD

SEQ ID NO: 1022587 - protein, 73 aa, Homo sapiens
NSRPRRRLRGGLPDAARQVVAVEIDPPLAQQLPHTIAKFRPDKAQNVNVVLMDALKVTELPHTPDALLTRPRI

SEQ ID NO: 1022588 - protein, 120 aa, Homo sapiens
MTFSYRPWEEYSRAAEKLDLADPMKAQCGSQIYGILTGNLCVDSNTDDLDIPTLERMYKKIEKFHSQLMRLMVKANGSPHCYHGNLSEWFESEDFVVYFREVTYLLNLPESVGTESTLCN

SEQ ID NO: 1022589 - protein, 73 aa, Homo sapiens
GFDLGRATPGRSVVRVAEVLKPWVLFNCSTLAIVWLEYQSLGMDVHTSLSEQMSLPRLTRMRGPRVVLMIWAF

SEQ ID NO: 1022590 - protein, 174 aa, Homo sapiens
MIHHYLSHHQYLTTPPATTYSPPTTTPLHPLPSPPLLHSSTLNTIKQTYTLSHLHPPAPHLPPHTPLSPSPSPPPPPPHNQLPQPTPHPYNIIPTTSTPPTTSHLTLPPLLTLPPPTKHPPPHTTPAPTPPHNTPTTHSSHFSTYLTPHTNATLLTLHNSINSPPFLPTSFPTH

SEQ ID NO: 1022591 - protein, 135 aa, Homo sapiens
MPTRLTLSGLRQYLPPVPLSDARLPPPDATPTLGHCGILPAPVDTRHSSVIFRTIWRGTKAQYLAAKAAKESSHGDSTPSTCMWFQRHEEPKTITDEFEQGTYIVRLTYREVGASGRRNGSAPCEYRYLEDRDLQ

SEQ ID NO: 1022592 - protein, 39 aa, Homo sapiens
MAITWHFVHHMGYATHELSACRPLKELDKNPKAPQDSTS

SEQ ID NO: 1022593 - protein, 101 aa, Homo sapiens
VDSEDFWLVLGLNPVDLFYSTLIVNALNHDAHHYPPEELTSSFPRCVGIRTEERFPGDTLRCPHRDQDAFVDSLALTSVMLLATHGNPSMNEASKTFLGVC

SEQ ID NO: 1022594 - protein, 132 aa, Homo sapiens
MSGLWRQQPGCVQVALTATAQEQCRVESEHPSAQPQAPSEAVERALRMPQSWALVGGFQVKPWGPGSPAQQAALDPTSAAPDPTSAAAGSQGDEGPTREMVGELVAPGNAGHQGGSTGPHPSLPGLHPALSP

SEQ ID NO: 1022595 - protein, 251 aa, Homo sapiens
WQSCSPGSRAHNHDAKDTPDEPWAFPAREFLRKKLIGKDSLFHDSKTSTPQGRRVMRMHRHRMAKSIPTCGQHTFASQSTWLAKQRHSAKPSSSKAMQQAKSIHASQHTGNSSNRRKKHSQRQAKNSGCGVRGTGSHTIRDLKYAIENPRHFVDSRHQKPVNAIIEHVRDGSVVRALLLPDYYLVTVMLSGIKCPTFRREADGSDTPEPFAVSSQNISMSRDCFKEMSDHSGELTQQNILGTILHPNGTSQ

SEQ ID NO: 1022596 - protein, 255 aa, Homo sapiens
CGGRCSMFEPSVLHRYTSLTMSGPRQDWRKARAKDKKRSSRAGSSSSQWAVYTGCCGRATTPSASAPARQCTLAAVLEYLTGESWSWRAMRNRDNKKTQNPSPAKLRVQAIRNNEELNKLLGGVTIAQGGVCPTSMAVLLPKKTSATVVAECAPRAGKKATQASQWSTNEWPCAAGLACHGLPNATTNGPFKGHHLPVMVKELSLLQSCGAKRCAAHLPLEVIKNWALHGGKNDNAWLLHLTPKHKTCKRPSKKT

SEQ ID NO: 1022597 - protein, 119 aa, Homo sapiens
MRQGFLPPNGKCKLNWLLKATLVEKFLLHGFTPWWRRLFQSLHDCPVEKPTRPVLPHPNCVTDIVPTLVQKEERKPEEESPRKDDAKKAQPEPRGEREAMGMLSPSGNEISENTLEEGG

SEQ ID NO: 1022598 - protein, 114 aa, Homo sapiens
AQLSPSHSERNVLSFCGCNLFSLGMTCYVWTLIRAAARRSHAIINYPVSLGVRSPPPPPPTFFSSPSSSSHWKSRCGWFLGGFQAHADQHHLPLATLPCDRQHMSPHAAPAWGA

SEQ ID NO: 1022599 - protein, 326 aa, Homo sapiens
MGAWYVTSTLLGVQVAMRTNWELRSSGSGLLLEGELIMEARTLPTGIPMSIDNGLVAEFEHEADSDYRSSPVCDTTAQSQLVALVVREPSHCRSEREVAEAASRARRLFAGSENEAVSDPQHPAASEGPPRAAASPPLLRCLVLTGFGGYDKVNAAWSRRQRPRPWARQLTLRLRACGLNFADLMARQGLYDRLPPLPVTPGMEGAGCVIAVGRGSQRPRRQDDRVMVLNRVRDGGRKKVDCALGPDLPGFLRPGPLRKAVPCVVNLHYSLHGPSLTSEPTALAKAVLVHMVQGVWYGCCAAVPYSADVTSVRNGSPSSTSTEGDG

SEQ ID NO: 1022600 - protein, 142 aa, Homo sapiens
LQLNPGTPLYAAHFRPGQYVDVTAKTGKGFQGVMKGFLPTHGQTHRPAVAGDIGRWPGTKMKMGIYRTEYGLKVWRINKHNIIYVNGFVPCLVQIKESKLPAYKDLGKIHPFPTNFPDGDEEETGQKDLYDEKRVPAPGGAF

SEQ ID NO: 1022601 - protein, 157 aa, Homo sapiens
LQLNPGTPLYAAHFRPGQYVDVTAKTGKGFQGVMKGFLPTHGQTHRPAVAGDIGRWPGTKMKMGIYRTEYGLKVWRINKHNIIYVNGFVPCLVQIKESKLPAYKDLGKIHPFPTNFPDGDEEETGQKDLYDEKRVPARCADDIGRTLDVAPDGCERR

SEQ ID NO: 1022602 - protein, 148 aa, Homo sapiens
RIRHEAARRRWGPKFLAPRRTASPPHSPQRTGPLPAAACPPCLPPTGPRSAPSQPHLWVLSLVEASSFICLFVLFSLLPSPPLSLPLFFLFSFFFFFCLCSVYPGSPLSNFFDVIKQLFSDEKNGQAAQAPSTPAKRSAHGPLGDSAA

SEQ ID NO: 1022603 - protein, 277 aa, Homo sapiens
SLLSCRSQTCGVPGRGNLWSLHLPGKGAPEVKEMAWWKSWIEQEGVTVKSSSHFKPDPGCKRPSTKTSEGDLVTDKRAGSIIVVCSHKMERHDCSGSRSPKSFKALVSARTLTVVPLKSELMWLKFEEAHCGLLVYPRIPDYQEAKGAALTTDARGLHGDQGRGVIIEDPGLSAPGTMAAGTMLKAYEEDYGSSLLRRTSKADTSGYTGEDPGVPPAGLLGLCELFLWPLGCASKTRWALYAAGETLRGTDALRFITHPVHAQGRFGLCECSDELMD

SEQ ID NO: 1022604 - protein, 297 aa, Homo sapiens
SLLSCRSQTCGVPGRGNLWSLHLPGKGAPEVKEMAWWKSWIEQEGVTVKSSSHFKPDPGCKRPSTKTSEGDLVTDKRAGSIIVVCSHKMERHDCSGSRSPKSFKALVSARTLTVVPLKSELMWLKFEEAHCGLLVYPRIPDYQEAKGAALTPMQGLSESNGPVSIDMTILALSGPRSQLRDIMKALLSERLLGPRLEDGHPNSDTMWPNLGEQDPVVCAPCHRPSDVVLDCLKPRPWVGTPSALRPLPQVVPQDLVIPCRAEDSNPSATPASDFTFSSPLLMPAPVSPHLCLQCFAP

SEQ ID NO: 1022605 - protein, 147 aa, Homo sapiens
MNKRSTLGCSQSSQAAHPKKKKKKIKNKQKQQQTKTNNVVCGPPARPPEKEVFITQHLCVGAARGATEWGKREKRGAKTRVVPQEGESTAGDTKRKQGGGRRFLSHHIYKKNRRRGGGATPREALLAERKNLPETRGRGHTEEGGTI

SEQ ID NO: 1022606 - protein, 145 aa, Homo sapiens
MVDTPKVCGDSACARNHIGQDNNQLTQECDTIKNGSSKTRNGTRHTRDEACNEERAKIDGRRRQQEKQPQTADNQGPTHIEAHSPEAVTEQRGATEQNPTRRKRQRNQTPHTTDNSQTHAAAHTSNTATTQHTCATTPQGTRTAT

SEQ ID NO: 1022607 - protein, 548 aa, Homo sapiens
MASMRESDTGLWLHNKLGATDELAPPSIASLLTAAIIDNIRLCFHGLSSASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 1022608 - protein, 264 aa, Homo sapiens
SARKVARPASPRDSLLKSVYCLPPHPYLAVAPSAHHGCDKMLVPLNTMLACSGVPAQCSAGELPPPRCPRVPPCPACLLHLCPAPMLYSMAPVPALGAAAHRASLVAVCRLRSTTLSLPCRRPTGGGAGACDAGWRTTAVLNAQKPDSNPPGPGCTNYMEPAQHACSRQRLDVFFNHLRLGGATPNYDLTPRFTPAGQPQSSLTVTRGYSPAWTRRGQIVDSAQHLVGQDPEDWALGWEQGGKKERPSLALVDGPTNLQTLETV

SEQ ID NO: 1022609 - protein, 112 aa, Homo sapiens
TVVSGKRDSKWVAVAAALHGGNVGVPGPHPGRENAGAEKGPGLGREIGEGAVAIPDRRRSRSPRRHRSTSPSPSRLKGKNEMRQKKEPKETKSKERQITEERLRGAKTRGRT

SEQ ID NO: 1022610 - protein, 64 aa, Homo sapiens
MITCSWSQRGPSGLLHSLGILSSKASFSSREHLEALTPTDLKGEIFSIQWFLLWLGRGAGVVGQ

SEQ ID NO: 1022611 - protein, 249 aa, Homo sapiens
PLSVEVEFGGGAELLFDGIKKHRVTLPGQEEPWDIRNLLIWIKKNLLKERPELFIQGDSVRPGILVLINDADWELLGELELPASGPGQRPLAISTLQRAAEGPFSGAWAPLRGENEAIRHPPWALASRSPVSPLAVAFFPALSPKLPPGREKRPRCVRKWSLSQAREHAEGQTGRQSPGIHFSSRLCVGEGSPARFVQELKESSVAKVTLGCLSQSLYLMAIPSGVGADRGASSPQSHAFFMGKMNGPE

SEQ ID NO: 1022612 - protein, 219 aa, Homo sapiens
MHDSGNDDLSEQWLVMLEANHDAYRKGRGNPCVNVIPWYVTLLRFFPKALTIMQGWVSSVPSMTNQCGPGRTYRLEDLSQFQKILGETVHGYSSRIQASHGKKTKAVCPKRKRWQTESDAEVECDLSNGWHITEELRKYFAETRGLGDERGGNKKMEDERPDRYGTLTRPVTETPAAGKAHWKPGDGAANEVARKGAQPTEPGTTGKLGHTGGGPEEQT

SEQ ID NO: 1022613 - protein, 202 aa, Homo sapiens
RTAKMQQHVCETIIRIFKRHGAVQLCTPLLLPRNRQIYEHNEAVLLHGPQRDAGDASFGPCGIPFCRDMWQEIIVLEFAKRYCCSERVSQAALSSESISSQENFWSVHLISVYCAYHTRSAFHDPLLNTYLQLVYARSSKEFSRHCQAIEDYSYLYLRPYHVIEQQYPYTVGSQKINSVKVYTYSVMTAVTETADEDENVES

SEQ ID NO: 1022614 - protein, 99 aa, Homo sapiens
AGPVGRGGGGGMGAPKLPPAWQPFLKDHRISTFKNWPFLEGCACTPERMAEAGFIHCPTENEPDLDQCFFCFKELEGWEPDDDPIEEHKKHSSGCSFPF

SEQ ID NO: 1022615 - protein, 293 aa, Homo sapiens
SGGGRGDRGGGGGGEELCLPPLQPRQDGGGRRNPGRGQHAASRRAPPPGSGPDTRGERESGSGGGGGGGGGRMQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGERGARTRPSSGRQPDGLPNMMYLLAIGAQVLLGIGATPVQPLGVSYIDDHVRRKDSSLYIGILC

SEQ ID NO: 1022616 - protein, 137 aa, Homo sapiens
MVSHSYCEFLFIPLFFFYKPMVYSWRIGGNFFRITPESTGWSSWWAQTELAVPAGLVQQGGRLASVRAQQQGSRDIRGVWSGGHQAQVGLPGQCPDTGREGTTEQSSAGGQGGGTTRVGNHITPPSVEAPRSTNVGS

SEQ ID NO: 1022617 - protein, 41 aa, Homo sapiens
MGSLGAPLGIILTSMYLGAGSQVASGELGIVKGTDLVLIEG

SEQ ID NO: 1022618 - protein, 215 aa, Homo sapiens
CVGSRAAAERPPRPRFRSGKVRAGAVASGAGRGGGGGAGGEPNPLHGTPRAAREEAGPAAPCARHGGLGGDVSGSADPERGPGRDLSRRRAPGAMRPTLLWSLLLLLGVFAAAACGPARPSFPAARSSAPEEFACNNAEQVLSWEPGGPEQKHEACVYQVQFKYTDSRWFTGDIMSIGGELYTDHSQQSVTFTGRPDPISRLPNGFQVSLYAFRG

SEQ ID NO: 1022619 - protein, 509 aa, Homo sapiens
SWSKILLKGLIEKQLPDSKIQLPEETRLYVLGGTVAVGHVAGGSLGFSHPFVVRESGGWVGRYSSFSVGFSTMCLTCGLRDGGASLISAPHLLYPRVWVSQEDRHVISSHLCVYVATSTTPLCVCEHNTLGAAQHSQSVSHTLIRTCINEGSSRARGGSLIERHISHTQTFRCEHLIAASLCVSLRRVFLHEETHNKSSLGRDSVWGPPNSLSQSESGKHAAEAHTPDIARGPLSRPQSAKSAPLSKRESVLVITQAEEETLSVRCARHRWCGPHTETLSLLVWRPHPYVYRRPYEKRLSYNQLVSPSGVRKEAQKPSLSLWNTIPRDELIEVFSAEKIAHAETPFFFTARERTPFFVGVSRGGGTLQEITSGHFAGRPGAFGRGLTLRATLSKVFREERCYAPYSLRSHKALPEKFKQNTASSYKVPTPIWNTEIAPHQSGETKNFPPTFLWRAKLGRPRGRPEIIWHHPRGACGDNPLWDTRLNKDNSEGASDEIKHTAPGDYRGRT

SEQ ID NO: 1022620 - protein, 346 aa, Homo sapiens
RKERTKKRQERSEFRGIRLPVPRSLLSPDSALAVALAIRTDPTWAEVARAPRHEPVTKLGAEREAAVAEECEEEAVCVIKCASVKYNIRGPALIPRMKTKLPEFYYITLYIHGTYLGIIATWHVSVLDPILSSPQKTGNVEKRSIRDAAGLLGCQQKVPSQSRGRSQLAELHTCPDVYRCGFNPKNKIKAGYIYCSDHKYAATDFGVSVSNNISREYNELLMAISDSDYYTDCTSNAACPDIDPSIRCASPRNTLRIKADSNKRMAQLSRLRIEGRLTCCSTCCLGGPPDYNTALDVPRDRALAGGFSTWTYRQGYDVSIVYSLSAEVQRKDRSTAILPVISGGCH

SEQ ID NO: 1022621 - protein, 173 aa, Homo sapiens
LEEKVQGLGASVRRFQQLVQPAGTLDGVAGLLLQLSQAAAGGHAGPLATLKDAYLEVTLRPLEEVWRERAEEAMRRLQAWVPGMPGNGGPRPIRAALGAMKGALELAAHQMLSWAEATFSRALKRLCKPLLDLYSLSARNRSVVVMLPLLPAGDEPLDVARVTSYLMEEKLLR

SEQ ID NO: 1022622 - protein, 199 aa, Homo sapiens
LEEKVQGLGASVRRFQQLVQPAGTLDGVAGLLLQLSQAAAGGHAGPLATLKDAYLEVTLRPLEEVWRERAEEAMRRLQAWVPGMPGNGGPRPIRAALGAMKGALELVSEQGWGVVGKVRMTEPALTVPSLLQAAHQMLSWAEATFSRALKRLCKPLLDLYSLSARNRSVVVMLPLLPAGDEPLDVARVTSYLMEEKLLR

SEQ ID NO: 1022623 - protein, 237 aa, Homo sapiens
GHLLLVGWSTLCAVDCRRQLVELDAGPPGPLLGRSGSSWAPRPGLADLKNCSEVGAWGWTRPRAWPAAMNSNVENLPPHIILPVVQGGDDTDLQTHPMGIKVFPNRGVTSPTSSVTIEGPEGTPYAGGLFRMKLLLGKDFPASPPKGYFLTKIFHPNVGANGEICVNVLKRDWTAELGIRHVLLTIKCLLIHPNPESALNEEAGRLLLENVLREYAAQGPVYSQEIQVGAAGQRKAN

SEQ ID NO: 1022624 - protein, 237 aa, Homo sapiens
HAELVTAMEGSLRMCVAALCERSQGCQQYRKDPKECCKFMCLDPDDDAFEPVEVSCQPLGMVGVKVHYSGAWSSSAHCVVASLADLEDSADSSERPAPVPPDPAQSGEHPSCRGNCQGVGRHSRSSLNTVVVDCLGLYPKRSWEHLSVVENNGSLGRLEMAPVPGLDAKATCRHVTWRARVVYMETTGRHSARRSDGLHRASLRASETCIAWITVFYLIKWRKSDKFIQTANVRRRE

SEQ ID NO: 1022625 - protein, 68 aa, Homo sapiens
GALQPRLLGRGPGNPRTRVCGGGICVVALALQRLVRAVRRREGAALGLVSLVVVRPVGALPCVLRVPR

SEQ ID NO: 1022626 - protein, 68 aa, Homo sapiens; identical to SEQ ID NO: 1022625

SEQ ID NO: 1022627 - protein, 244 aa, Homo sapiens
ERCARGEERGLGDPALPTLMFEEPEWAEAAPDSPRVLGSRNFNDLRLRPPRKTRPHPFSLGPTVIPDLPLRVSKRRQSLGHHKRARRGSSLFSRDIPPALVYKVISEGGGGGKEEEVPLRRHLAKPLPEVGADGERRTCQRSVGPSLASDSEDTEVAKEERNCHQHRLLWHVTLLKMRHRKRNCQTIMPAYQIQRDVSLFRFPKDWAPLVGPRLSFQACSFPPMSLTSAGELWIFLATGRHDLT

SEQ ID NO: 1022628 - protein, 227 aa, Homo sapiens
ERCARGEERGLGDPALPTLMFEEPEWAEAAPDSPRVLGSRNFNDLRLRPPRKTRVSKRRQSLGHHKRARRGSSLFSRDIPPALVYKVISEGGGGGKEEEVPLRRHLAKPLPEVGADGERRTCQRSVGPSLASDSEDTEVAKEERNCHQHRLLWHVTLLKMRHRKRNCQTIMPAYQIQRDVSLFRFPKDWAPLVGPRLSFQACSFPPMSLTSAGELWIFLATGRHDLT

SEQ ID NO: 1022629 - protein, 183 aa, Homo sapiens
MTHSKEFTTKSSRALHAAVERYNPGLTREAPTNVVSNGLNPRRCQAGGESEDRRNRHYTTGRTKKRPQLNKTEPNKGKYRTTVENGRKRADKKTNSMSKQQYSRDLHGRKNQTKQRREDSESTRARNETRDPPRQPQEDRDNDPGQRKNEKKQGKKRNKKTRKRPDRKTTDELSNTSNAAPAT

SEQ ID NO: 1022630 - protein, 136 aa, Homo sapiens
MSPAPWAGGPGTGLYLAVGCPSSDTLETKKKPWEMERVSGNRTNVISARDWATELGLMIVIDSLVTQEMAAMDQGGLCDKTENAKHLEGRVGTGVGGLKLVYPHARLEKADVWSAINLTVSDVRRPALGKSTLISY

SEQ ID NO: 1022631 - protein, 188 aa, Homo sapiens
IRQGTPCSIFNSLPTLVHWTYHKHLLFYRNLIDGSFLSDYPISACCVPRITSLQPGLRFFKISDPIATCLYHHSSAKKSSMMQLHLPIHWSLYFFPDMAKPTMLCPSGVQCPFGTSATRQWSKGCSPKPSSSRSFSVKITCSSMYSYLASSLISRSMSLQSAAVAGRITNLAIFVFCFSSLCGPGPCT

SEQ ID NO: 1022632 - protein, 106 aa, Homo sapiens
GTSRTASTLRLASDSPDCLRLLSSWDYRCAPPHPANFDVVFLVETGFHHIGQAGLTTPDLMIQPASSLPKCWDYRHEPPHPAILVFLVETGVLLCSPGWSRTPDLK

SEQ ID NO: 1022633 - protein, 150 aa, Homo sapiens
MGIQGGSVLFGLLLVLAVFCHSGHSLQLLQLFLTQLLTAKQAVNCSSDFDACLITKAGLQVYNKCWKFEHCNFNDVTTRLRENELTYYCCKKDLCNFNEQLENGGTSLNQRKQFFLLGELAIFWQLACEPSSLMSSTDGELSPKTPRYLL

SEQ ID NO: 1022634 - protein, 160 aa, Homo sapiens
MGIQGGSVLFGLLLVLAVFCHSGHSLQLLQLFLTQLLTAKQAVNCSSDFDACLITKAGLQVYNKCWKFEHCNFNDVTTRLRENELTYYCCKKDLCNFNEQLENGGTSLSEKTVLLRGDPDSAHARAWSAFRPKSTPRDGASPQTPALGVVPAFLFACHNS

SEQ ID NO: 1022635 - protein, 127 aa, Homo sapiens
RSLSESVLGAGGVKGLERASCRIILFPLPLSRPVSLCIASLRRIDFFVGPCVGGSVGRLDLEIPHIRSSSSVPCGSPEPVRVPRVRAKGSSRTALVTRPCGHTSTCAQTPVSSWQGCIRYHEYPSAS

SEQ ID NO: 1022636 - protein, 184 aa, Homo sapiens
MEDDRADKSSILMTGARDMISSGEHVKKTGVYDLWDTQAESVPAFPWAGFQMSSDVDFITIILALLYVTISFRIYKSGIQAVTEVRRRPSMSKAYLDVDITLSSEAFHNLHDMLAMVHNHNGALNTSLFRLFLVDRIWLTSLKLAVLHVADDLCWCWVFNGIPLLILAGTGHFQGAIVYETYQT

SEQ ID NO: 1022637 - protein, 362 aa, Homo sapiens
ASLRQSEPVSPTMLRDGQSIIHKHRRAMKKQRKNKKSNLEAKWQTITIFRKQHSLIFLVDASKAMFESQSEDELTPFDMSHPSVSKVCTSDKIISSDSTTLLAVVFYGTDDKTKKFTLNSKNTLPSYSELDNPGRKTNSSSLTSFKGAEGTNNVSIDMMGHGSDYSLSDVLWVCANPLSVDVQIQDRVDKEDHMLFTNEDKPHGNDSAKASRARTKKTVILRDTGIFLELMHLEENWGALTYPCSTRDIQTRIARRHEETPRDQQREKYKHRLEDPVLQKDQTTGEPKEQANTITHRVQRLKRLNDRIQQKPRGTINTPWPNKGTKDIIPDNSTTQENTLTQRHTNTGPYRQYRRLHNKQQQ

SEQ ID NO: 1022638 - protein, 110 aa, Homo sapiens
MAIYPLLGRGYQGVVNVSSCKWWLLVQAYIKLKHPARGGRAKKHNLLLGGPLQPQKKKFLEKTQSLVGDSGGTHRGHRAKRGHHSVSPRKAPGDRAKGVVCSPPKKNAGG

SEQ ID NO: 1022639 - protein, 214 aa, Homo sapiens
MDEAGSSAELAGGFLPGRGQPGLNLPNSRIFLVIMQCTHREYGAGRELLLSLFGEHPWTSWVGAWTMHTNGVQWAFAIRQCSPCSSHGLHGPMEEMHGHVHSARNDTEATSRLFMCSVPDHRGSHLRCLKHAQNLQAIFCHCYQMSYTARRSARTNFKVYGDIEYCSIIKNTVTGESKGLGYVRYLKPSQAAQAIDNCDRSFRAILAEPTHYSI

SEQ ID NO: 1022640 - protein, 110 aa, Homo sapiens
MDEAGSSAELAGGFLPGRGQPGLNLPNSRIFLVITIHTDRAERFAGSDLGGNNRSAVVSRPAHRLRAMEEMHGSARPNDTAISAGAGSGCLGGRMGLWTPFTCCSAGREE

SEQ ID NO: 1022641 - protein, 157 aa, Homo sapiens
QTKAGPEGTVPEASGPGNGNRHNSAPEHPGGPGAFRAREGLSPRARRGRGSQPRRRPREKPPSLSTRQLEEAGPGLGTAGSTRLGLGRRLGIADRGGRTCETLFPARREAGRSPNFRRRRRVPPGGRRGGPSAHAPDSVPTARPGAPGPPCDWPGRP

SEQ ID NO: 1022642 - protein, 109 aa, Homo sapiens
SILNDENNGEDIFRTGIIGRVLILYNIAPATLHSDSRSILRNRPGIIFSLSARLSESPSESSASLSISEGGSKLAVELSRSSRFTDSLEDVRTIDSLEEDRNRDSFIGL

SEQ ID NO: 1022643 - protein, 321 aa, Homo sapiens
TQGSGAWGKSGAGAGTHRWRGGDGGRSDLVEASGAAMAEFPSESLALLDQHVLLQGGRSLGVVRCALDLGFRALPASGALMLLQLGAWALLCVRLLIAGHTRYHTCIRAIWAGVTVRSASLPSELVNNSVTSSNLIALFQAWHIDSFVHVFPWATWLLHDSLDIKATGSHTFTGLSSAVLWRQVEPDIPGGAPGPYNQRADASFFACRVMIAYGVSAFFSYQAWRGVGSNAATSQMAGDMPKPPVPRAPLGLKPPLGHRAVSPLKPEAGEPCVGVRASGDWVLGPSLAGQTLALQRRQGEQAPGVGGSFRVAGGRLAGSLF

SEQ ID NO: 1022644 - protein, 335 aa, Homo sapiens
RHLWACFLVMGQGLVFNANTCASWCRDIKGHNQSLEDAWDLKPESRKALGGESSSVQGASTPVYFISTKRSVLIDRLYLIHLDKLCCTSASFPCVWIAASVLPDHFSPENANDDGQGNMPNIGLGKIASIRELIPRDNTWRLSILKCNRFLSKTGIHIICLPLVDYVMIRGIGDPLVSVYARAYLCRVGMEVAPHLKETLNKNFFDFLLTFKQIHGDTVQNQLVVTRGSGASQSYLPLYPPAMDVDLPGSIVPTHAPEALLTEMMERCKKLGKQVPLPGSESFSCHVVPFPGLQFTRHKVMDFIGMIKECDESGFPKHLLFRVTGRLYKPFAPLP

SEQ ID NO: 1022645 - protein, 174 aa, Homo sapiens
RSSWVLPDLREGRVKAISDSDGVSYPWYGNTTETVTLVGPTNKISRFSVSMNDNFYPSVTWAVPVSDSNVPLLTRIKRDQSFTTWLVAMNTTTKEKIILQTIKWRMRVDIEVDPLQLLGQRARLVGRTQQEQPRILSRMEPIPPNALVKPNANDAQVLMWRPKRGPPLVVIPPK

SEQ ID NO: 1022646 - protein, 174 aa, Homo sapiens; identical to SEQ ID NO: 1022645

SEQ ID NO: 1022647 - protein, 228 aa, Homo sapiens
GRGTPAVHAFGPPWLTHRPRRRTMDAPRQVVNFGPGPAKLPHSGVVEDEYRQGHLTGELQEESAFVVLDNDVTGPQSFGKIMKQYRESCAGMLAVPDNYKVIVSAKEVGDGQLQCCPLKPSLDLKAGRCADYVVTASLVSYRPQNEAKKKGDFTKSSYILTLGQLIQKIPDPKTPGTSHPDASYDVLLRKLRRLLDDGVSTFIPDVKGAATGFVTCPQTSCPSQWDVS

SEQ ID NO: 1022648 - protein, 162 aa, Homo sapiens
MLTKTSCEFTGDILRRSPVSEDMLGRVFNGSGKPIDRGPVVLAEDFLDIMGQPIKPQCRIYPEEMIQTGISAIDGMNSIARGQKIPIFSAAGLPHNEIAAQICRQAGLVKKSKDVVDYSEENFAIVFAAMGVNMETGRFFKSDFEEMGQWTMSAPFELGYDP

SEQ ID NO: 1022649 - protein, 231 aa, Homo sapiens
RGVSARWRLGSGVLALAKRAPARLAGTVHEVGDAVPPRAPDQDISCLNRDPARVVVVDCRRKPSAGPYNGVALRPWAGNSDDPGLVDLSAFLKTIALDGVEDVRTVLEHYALEDDPRGGLQTAESRVEQEEQQCLARLSKSKKPEHSFLGSLNHALVGLAPKQPETLGSSKLSDLGPGPQLLPRQDFGPQLVQVKYIPDATPVVFPRVSNDGGHQVDGPGDFLGSHRPTSG

SEQ ID NO: 1022650 - protein, 440 aa, Homo sapiens
AWRQRKMAARQRCSRACEAGSGSARGDCARGWRRRPASGPRSGPSEIGQAAGALSAQGPQVSSRAQEGPSYANNKLRSELAGAALDAGWDCDASVYTLVGNNPAGRNTWCQAFLMSSTMTPILVQQLRRTYKYFKDYRQMIIEPTRPLPSPRPSAGTCTTSHPTRSFVEAHRLSSCILSGRLATGWRFKKRPGIETLFQQLAPLYEIVIFTSETGMTAFPLIDSVDPHGFISYRYFRDGHKIHGMDDHVNGYFMSESGPSSSSSCGPAEGSLPLDPITALPCGPGDGNSDDPGLVDLSAFLKTIALDGVEDVRTVLEHYALEDDPRGGLQTAESRVEQEEQQCLARLSKSKKPEHSFLGSLNHALVGLAPKQPETLGSSKLSDLGPGPQLLPRQDFGPQLVQVKYIPDATPVVFPRVSNDGGHQVDGPGDFLGSHRPTSG

SEQ ID NO: 1022651 - protein, 106 aa, Homo sapiens
AYSSLVCCILCALVCVLVVDLLSSSLVRTPSFDLASTFPPWWLCLVAVHGVRPLCLWVLCSVLGCVWDHWWLSFLALTPWALVFRVARTASFCSVGGLCARILCCY

SEQ ID NO: 1022652 - protein, 370 aa, Homo sapiens
TPQHPQASGGSGVNGTEATWLAQQKRMNKNGEDFSLTDFLAEDGGTGGGSTYVSKPVSWADETVMTWQGDVSDHLSTVTMTMCIVAPPIDRSILPTAPRGAGVNPVTDRSLSYPNRHPTMLFLGNLPNDVKKDQFTEFFRGLNISAVRLPREPSNPAEVERYTVHAEEEDLDSLLSALSLNEESLGNTEKFEWTLLIKHRIQTGMLVLMAVIEIADFCQPDTDWRARPATDSLMTTHLEEVMHRYGDTFSRSLCIRTGIGDAHGMGSGLPPPGNWIDKGDRERKEDRGHKKHEDSEGNPAKDEHKKGHLGTAGTRGKRTTDADAETRHDARHTHAHIASGNHNTIRQTTKRTEDTHQNQPRGKTDDKEQA

SEQ ID NO: 1022653 - protein, 368 aa, Homo sapiens
GDRSPMATCPAPPQPILRESNGSMSATTVAPSCQLVGRAITLGSGQLVYSYSLLASKRTHGGDCTGWHECLLTSLDKALKVRCLNQDWCVVYRLIKGRIDWFTSVWIISPLLRLDGEELIVEVLEDVPLTMHNFVRKTFFERWAFCCTFCLQGFMYPVAFRCQTCGYKFHRMHCSSKVPTVCVDMSTNRQQFYHSVQDLSGGSRQHEAPSKTAALNELLTPQVPSPRASYCDSVITSPSLTQSPDAPPTVSLRSDGATLQASIWVSIHGPHGLQPHPDSLARVSALMLPVVQEVVMEPPGGAQAQSACPRGGSPQHSKFTSRAANEPEVLGDDKKTVKNLGYPGYSGYYWEVPPSDEVQLLNRIGTGS

SEQ ID NO: 1022654 - protein, 476 aa, Homo sapiens
MIRPQLRTAGLGRCLLPGLLLLLVPVLWAGAEKLHTQPSCPAVCQPTRCPALPTCALGTTPVFDLCRCCRVCPAAEREVCGGAQGQPCAPGLQCLQPLRPGFPSTCGCPTLGGAVCGSDRRTYPSMCALRAENRAARRLGKVPAVPVQWGNCGDTGTRSAGPLRRNYNFIAAVVEKVAPSVVHVQLWGRLLHGSRLVPVYSGSGFIVSEDGLIITNAHVVRNQQWIEVVLQNGARYEAVVKDIDLKLDLAVIKIESNAELPVLMLGRSSDLRAGEFVVALGSPFSLQNTATAGIVSTKQRGGKELGMKDSDMDYVQIDATINYGNSGGPLVNLDGDVIGVNSLRVTDGISFAIPSDRVRQFLAEYHEHQMKGKAFSNKKYLGLQMLSLTVPLSEELKMHYPDFPDVSSGVYVCKVVEGTAAQSSGLRDHDVIVNINGKPITTTTDVVKALDSDSLSMAVLRGKDNLLLTVIPETIN

SEQ ID NO: 1022655 - protein, 475 aa, Homo sapiens
MIRPQLRTAGLGRCLLPGLLLLLVPVLWAGAEKLHTQPSCPAVCQPTRCPALPTCALGTTPVFDLCRCCRVCPAAEREVCGGAQGQPCAPGLQCLQPLRPGFPSTCGCPTLGGAVCGSDRRTYPSMCALRAENRAARRLGKVPAVPVQWGNCGDTGTRSAGPLRRNYNFIAAVVEKVAPSVVHVQLWGRLLHGSRLVPVYSGSGFIVSEDGLIITNAHVVRNQQWIEVVLQNGARYEAVVKDIDLKLDLAVIKIESNAELPVLMLGRSSDLRAGEFVVALGSPFSLQNTATAGIVSTKQRGGKELGMKDSDMDYVQIDATINYGNSGGPLVNLDGDVIGVNSLRVTDGISFAIPSDRVRQFLAEYHEHQMKGKAFSNKKYLGLQMLSLTVPLSEELKMHYPDFPDVSSGVYVCKVVEGTAAQSSGLRDHDVIVNINGKPITTTTDVVKALDSDSLSMAVLRGKDNLLLTVIPETI

SEQ ID NO: 1022656 - protein, 218 aa, Homo sapiens
GLKGAWLVPGSLDGPCSSWAWPCFAGPVAPALALFPAAAPVARLSPCCAASMACGMWNLTMPVARAWCLAWCFHAALQRRSSVAVRCALSKRYLELFSLPVCGPDDCDDGRVMAATVWPLGWRLPLFEAKRYLDLLTTWYCSFKDCCPRGDLHESPTTFTGKDFVGTDSLVETLYRAGLNEYLVLRECPFATFHFSSPQYMWTLYTGAADEPDPGDAA

SEQ ID NO: 1022657 - protein, 305 aa, Homo sapiens
GLKGAWLVPGSLDGPCSSWAWPCFAGPVAPALALFPAAAPVARLSPCCAASMACGMWNLTMPVARAWCLAWCFHAALQRRSSVAVRCALSKRYLELFSLPVCGPDDCDDGRVMAATVWPLGWRLPLFEAKRYLDLLTTWYCSFKDCCPRGDLHESPTTFTGLEWDLNVRLHGQHLVQQLVLRTSGGYLETPQPENGLALSFHGWSGTGKNFVARMLVAEPSIGDEADEVNCCPAMSQRHASHFSFNIKTMWNLYHRDAACTSCHNPGTNASRLLPSRTLLPLRLNRYTLQTRYAWKASRHPLKNA

SEQ ID NO: 1022658 - protein, 198 aa, Homo sapiens
MKRKEKKNEGNNHLYPGPVVVGGIQYKEHWSEPTSSAALETLAAMHKSKMVSGTMSNPHLLPFFFFFKNSLTLVGPGGSKGAGALISGSLATCGLLGLKPSSLASQVSLETTGWWYQHVSGLIVVWVFIGGGGGGDEGFGQCVCPGCGLESAIGLKVIVPTLRSSHKVLEIPDGEPLGPSPKPFTFHKGTGDDQTDGL

SEQ ID NO: 1022659 - protein, 121 aa, Homo sapiens
MVLLPLGPPLVLPFTLQLAPGLGLSFEPKGPYWIPCPPLFGRHGPTHILDGMALGAHGPQQPLERMALEPHWVPPAFGAMGPPHGPRPLATCTFSGMGLGHIGLPACRVPQHFGPVPNLKM

SEQ ID NO: 1022660 - protein, 49 aa, Homo sapiens
MVSKHNRSASIARRILIALEERGSHQELQHWIPLLPLHLHHYLEQKVYL

SEQ ID NO: 1022661 - protein, 396 aa, Homo sapiens
YAWRAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTNYLQEKLGASPLHVDLATLRELKLNASLPALLLIRLSYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELTLTGSFWNDSFARLSLDAMNDPGSQELQFRLDKRTTMAARRITGRPDTEGRTIQYRNGTTTDQQANKNKHKPTHPETNNTQRETKKPRHQPLTTHTWHSQ

SEQ ID NO: 1022662 - protein, 282 aa, Homo sapiens
YCRCSRRKGLRDKMKLIILEHYSQASEWAAKYIRNRSSSLTQGREVLHPGAPHWEYPTWLLQEADEYYKNGDLSFKYVKTFNMDEYVGPSLETTRRVYHSFMWNQLSFKAHVDIHPRKTPTLLDWECTLDPTGRTVIASVKEKDHRAAQLGIEAYSALRTALGPEWHHTCLHTSQAPVWLSTDPCEPRWATGPTNPGQLLGLFRVEELTHSCPAWPCTVAVATVTGMLAAGEDLITGAHKAIALYKAIARPGVQPHVDRVWLRRTRPVGCGRSLGELSRSFH

SEQ ID NO: 1022663 - protein, 92 aa, Homo sapiens
MADDLKSISCSNKVTNVLKGLHAIVGVMIEMEYLLSKWLHMTMLQELCCCDSVSYPLLPLQQTKERTWTFQIKCLCYSNTSPVVHIIAYPGG

SEQ ID NO: 1022664 - protein, 276 aa, Homo sapiens
EVRDGRGGEGQRLGASRPLSGVPLSRPCRGPPGCPRSSRSPPEPLRGGRSPAAPRGHHRPTEQHSSPTPGSIFAPFHLSSVTRPQGDLEDRGPAWVGSHGVLQHTQGLPADRGGLRPGSLDAEIDLLSSTLAELNGGRGHASRRPDRQAYEPPPPPAYRTGSLKPNPASPLPASSIWGPHIQPSYTTASTPAGPAFPVQVKVAQPVRGCGPTRRGASQASGPLPGPQFPLPGRGEVWGPGYRSQREPGPGAKEELGLWPKRRGASTGPGALSSLRG

SEQ ID NO: 1022665 - protein, 280 aa, Homo sapiens
SPGPVVFPLPLAWPLAAGALSRALLAALFPRSGPASPPCAPCRAPLSSLSRRSAPVSAPSCRSRPFFCFLWVPPPPPARPSPVPPSLLFQTDLGSFHDLLRRCAVQEGEGHSLCLNRLQLEAHVRFSPLSGWVSGESGVRIHFVRLSPLGHRMQLERAHFAMFQPPPPLALASLQPAIAFCQLPSLGPHQILGVVKKWCTMSHRNWGPSLDSDHARLWTFRPASPGLLRSHSFYRHSVITAPCGQGGSPSDQLSRLLSLRLWLMRKHSGLTYAWESNCSY

SEQ ID NO: 1022666 - protein, 297 aa, Homo sapiens
QTLTFSASVQRHGALQEVLRGGTLEMNGRKQSLGELIGTLNAAKVRPTPRCLCAPPYAYIDFAGKKARSQDVLWLRRNVTKVTNGAFTGEISPGMIKGLGSHVVGSWGTQREGHVWGSQMSVMWAERCPVLWKEGTRSNRLMGGEADEGKWQSLRGCVRADKGHRDKVKDLYAVSSAYERVWAMGYARLETPQKAQEVNEKLPENGEVNLASDAGGHRGTVSLMRARDGKLKEVATSGGGGYLGGAPQANGHHMAKGPIHSYLCRPEKGKQKARRGEAPAQGSEFRGSPQWTQRGGE

SEQ ID NO: 1022667 - protein, 280 aa, Homo sapiens
EEKPDIRRATLEHPALVPLQPEEMVELMSRCGSSFCPSFCIWLRPKSGKCCPVGCVHQTVQLPGKVVVVTGANTGIGKETAKELAQRGARVYLAVPGMWKKGELVAKEIQEQDRKPAGVVCGKLDLSDTKSNRALAKGASKLRKKRPPGLDQQCRSDDVSVLEDRRWFGMHIGVNHLVHFLPKTNLAAKKKLKEFSPIRDSKMCLSSAHHLGRIHFHNLQGEKFYNAGLAYLSPAKLANILFTKELAPETKQALGVYDVYLYTLAQVQSELVRALIFHED

SEQ ID NO: 1022668 - protein, 281 aa, Homo sapiens
MSIDAYTKWLTASHIVSHSEYTDARDITGSDACIVAQVHQRTLRHEQSHMYTAHERAQKACLVSPRIGADVTFSACGRLERCRSDLRMKQERRWWRLLTIVADTIHGGCGHLWCYVERPLAGLRTFKTVFAEHISDECKRRFYKNWHKSKKKAFDQMYCKKSGRMRTGNEAAARTDFSSMEEVLQRLVRDHCPHPDGAMLPLSHKKAQADWRSTVNGGTVAEKLDWARVEAVMQQVPVKAKSMGSDADDRRNIPGDPGAKARPGGHRGVGDTEGSCPGKNP

SEQ ID NO: 1022669 - protein, 260 aa, Homo sapiens
VCVPRLSAPVPERKNPAQPRAAAGGESRRGSGDSARAAGSALRGGSGPARGARALRIRPLPGSRPLGDSSGCSGGFAVGRGTRGSGRHAGTRCCLSVLRPEGPVASGHSPWAFTPEPAQRHLGGGAVAARPDPSLETLSCRRAVTTNAARRPNSVQPGSGSAEKPGARRKAPGRIGSRASCPYTTLHKPGQGALEKARPGTRLHHARKHVASGQRLMLEVLTLSEPGMTTLGGAPMNRTLRHRLKRVVFPDRAHGGAGAT

SEQ ID NO: 1022670 - protein, 139 aa, Homo sapiens
LLWSRPRDSTTPGLQTLTFNVHVQVSVSPEDEEEEEEEDEEDEDEDLEELEVLERKPAAGLSAAPVAHRPLPPAAPLMDFGNDFVPAWLPLGTPCLACSPLSPPELAACLWDPEPWCRSTCAPLRIPCLSCCTQVLATP

SEQ ID NO: 1022671 - protein, 71 aa, Homo sapiens
PKISPRGPRRGQLPWPWAISNFGDLTFSSGWGAPSGNRGNQPSRNKRMVFFFQFWPPQCPPTLVHDLRGPS

SEQ ID NO: 1022672 - protein, 231 aa, Homo sapiens
MRAGQSKTEHAESAPKTKRDRQNYEQAENSEQSRRTRPRTRSRQPPDNTRENEAATEDNAGDRQPRAGTNASRASQTASDRAHETHKQQTEPPRSSRARHPKQQRRQQERKQQEDESQRRRRHTRANAANTSRSAKPEPAAERLQRQTEQQEATQPGKRDSSTTNTDTEGKTKRKRARQKRSKGTRKAQTKETGAAKGNNTDSIADTGTDRHTGRGREHKQKSTRERSTDR

SEQ ID NO: 1022673 - protein, 226 aa, Homo sapiens
RDPEAADGRRTSCARLSAGELRCRTGILGLAVSFSLGRHCAHESPMATAGARPRGGQSEWGCGAPGDIRGGVAVFAAVAVSVHSSSLSPFEYRGETPRETRFTARNIETMELPILLGYPLFTLVAKLAITLFPVWFNAYARQSSAVCLIVEQIAGIINFYVNAFTGFLVHLLEESLAAGVYSFSRLTMAGGPLAAEVKSINNLFVGLLMALTVHFEEAALLRRDQR

SEQ ID NO: 1022674 - protein, 142 aa, Homo sapiens
REWDQRWCGDCFRTPGTALGGSWPQTSVFSAAVKARGCRIATLPMDLIWFWVMHALADFVEALFGYITEKVVFPSLIRWVFVVGCVGRANGSFTRVSNDKRRCTPCHLCLSLMMIPENIVFVACSEHSGRKHEKLKFTVILL

SEQ ID NO: 1022675 - protein, 117 aa, Homo sapiens
REWDQRWCGDCFRTPGTALGGSWPQTSVFSAAVKARGCRIATLPMDLIWFWVMHALADFVEALFGYITEKVVFPSLIRWVFVVGCVGRANGSFTRVSNDKGDVVSVAVYSVSSLGYH

SEQ ID NO: 1022676 - protein, 191 aa, Homo sapiens
MWWRRAPAGPGEKSFYKTHIARGGARGPQEGKGNRGHKGGSPREENTAGARENKREEGNLSPHKYKNNSAARGDTPREAFSEKNLPKRGRASEERGQEEGGPSIHKRESHQEERAREIYKILYQRPPRGPAGGGVKHNTRTEHKTNNERATKHNTNNKHTTPTKPQERKHITTKKHNTKHAKTHETSTKKN

SEQ ID NO: 1022677 - protein, 85 aa, Homo sapiens
CSAQHSVGASDWRRENCPSLSRTSSKGQNAQFRKINSPLPTFFFFFKTVSLGAPGWERKGAWIWAHWRTSGLPGFKAILLPQPSK

SEQ ID NO: 1022678 - protein, 252 aa, Homo sapiens
GRTGAFALLYAAVQEVEAGNGIPELPQLVRRMREQRKHMLQEKLHLRFCYEAVVRHVEQVLQRHGVPPPCKPLASASISQKNHLPQDSQDLVLGGDVPISSIQATIAKLSIRPPGGLESPVASLPGLKSPQASGQPSLPESTPIPSFPPQPPFFPPNYLEAPQPRGGAASCLKSPPARGAPPYSSLEIAWPPLTPRGLSPWTDSLRGQNQRDEASNNFSAGPITGQGVGGAPGPLERPLQPSGIHSWTLNKT

SEQ ID NO: 1022679 - protein, 110 aa, Homo sapiens
FRCCKSLVRWWERYRQGQRCRRGPGADPSDFPSVPSHSSRSMSGDEMILILYDARRHHEEEEAFYVQMQEGDYPKTMRKTQSSETKRSGARATEDKDWKLLKRTLGKKMF

SEQ ID NO: 1022680 - protein, 287 aa, Homo sapiens
LPDVSSGGGAGISLRGQNGARGHEQIYQPSEPSVFPHLTVVLWAIGMFFTACSSFTEGHHLPSTPRDIYKELLISISGLTLQWAVEVLFLLLMGGHLRVSTQGLTTQDGFTVKPVLCVTLLFFQPGVLESGSPPWVLINYKCRMYKTTKKKNKEQMNTQHTRDSTKQNTQQNNTKGWGGASGARAKKRDRLRPHNKLMRGAGRDTTSEERKDRRVSTRVCTNKKETPSAQSTQRAEGGIHQTKKKNAPGGTDSVLRKTTPREDIGSHKRVTTKDETSGNKTAAAVGE

SEQ ID NO: 1022681 - protein, 215 aa, Homo sapiens
QKLCKRNGQPLKLPDTKRTLLFTFNVPGSGNTYPKDMEALLPLMNMVIYSIDKAKKFRLNREGKQKADKNRARVEENFLKLTMCKDRKQHSRAREEKKRAEKERTRKEEDPEKQRPEEAAGRRQKKSEKKQRKRKQTKGKARESHPREGRPDATRKPRIHRKHEKRQPISQPEPDRPGQPRNPDATHPGGGGGVHRDGRYLERALQEPDNQMGRL

SEQ ID NO: 1022682 - protein, 421 aa, Homo sapiens
WLAVWCWGPCEREDGVLCAVRRTGPAAAVVAAGGGSSGQVTSNGSILDGTLPAGGPMPQNPPGPCLAPKCLAVSSKVCAVLGSSSSVAISMFVFRLMGLGSLSDPVLGPGRMPQRCRTCLKPSSPNDSFNDTFHVVQSQKQRCTLAGPSDATDRHYFCGDSSDLVYGDWTSGENSDGCYEHFAELDIPQSVQQNGSIYIHVYFTKSGFHPDPRQKALYRRLATVHMSRMINKYKRRRFQKTKNLSLLQQVLGFLTGETEADPEMIKRAEDYGPVEVISHWAPNITINIVDDHTPWVKGSVAPPLDQYVKFDAVSGDYYPIIYFNDYWNLQKDYYPINESLAADSIRVSILPTLCFGAGSSMLAQSTKSPWNFLGDELYSSQPDEEPGLVLNGGPVWKNKRQLVALTIISDIFRNKMPYFRD

SEQ ID NO: 1022683 - protein, 414 aa, Homo sapiens
WLAVWCWGPCEREDGVLCAVRRTGPAAAVVAAGGGSSGQVTSNGSILDGTLPAGGPMPQNPPGPCLAPKCLAVSSKVCAVLGSSSSVAISMFVFRLMGLGSLSDPVLGPGRMPQRCRTCLKPSSPNDSFNDTFHVVQSQKQRCTLAGPSDATDRARTICGDSSDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWAPNITINIVDDHTPWVKGSVAPPLDQYVKFDAVSGDYYPIIYFNDYWNLQKDYYPINESLDRLTASESPSDHISALALARSMLAQSTKSPWNFLGDELYSSQPDEEPGLVLNGGPVWKNKRQLVALTIISDIFRNKMPYFRD

SEQ ID NO: 1022684 - protein, 153 aa, Homo sapiens
MAMVNQQEGTVKAASGFNAMEDAQTLRKAMKGLGTDEDAIISVLAYRNTAQRQEIRTAYKSTIGRDLIDDLKSELSGNFEQVIVGMMTPTVLYDVQELRRMKGAGTECLIEILASRTPIRIIQTYQYRSLEDYILSYTSFIFLSLSENYLALS

SEQ ID NO: 1022685 - protein, 283 aa, Homo sapiens
FTGTLRRSRRGPAPAARTPGASAPAGSRPVSCPEAAGSRRHGVPTVSQPNTGEVLRGRVGAPMHARALRFSAMQGWRVSMEDAHNCIPELDSETAMFSVYDGHGGEEVALYWCQNILPAYPSKASRRPPKGRQAHKKAFSKNAFLAHCTPKLTTAQNSPFKELAQIAGRTTEDDDDKKKVDEDDVATLRRLHCLREEGYHGLLKSCDTLRETVTGPPTSNPGVAADKVRPMEAELDNRNLQKMASKPQAPNHGRRTEPTRRAVTEDINLNRKEEKKQEKPNNS

SEQ ID NO: 1022686 - protein, 470 aa, Homo sapiens
FTGTLRRSRRGPAPAARTPGASAPAGSRPVSCPEAAGSRRHGVPTVSQPNTGEVLRGRVGAPMHARALRFSAMQGWRVSMEDAHNCIPELDSETAMFSVYDGHGGEEVALYWCQNILPAYPSKASRRPPKGRQAHKKAFSKNAFLAHCTPKLTTAQNSPFKELAQIAGRTTEACKHAHTQHKTVACMHSMHGGPTSQAACHLLPGQQAYQVQLKRHATCATRQRRPNNRQRRGNDHRTSTARDWQDERNKPKDNQRHPKGNSEERHSNQAPEEDAHGTATTPFTRAHTGHHQGHRGDNTRPKSHTKSRNRTGTRRNQGTENRIEPGTAPTSADREQRTRRTATDKEEERERDTAGRGSARGSVGTSHRGGRTKQEDDGRRDRVDRQKRRHGKTEGRGEDDEARTEAEADQGSKNETHKGGSETEEKEGGEQAGSETTEEGHADDAGEKAGEGRAGAKARRGKSGGNEREN

SEQ ID NO: 1022687 - protein, 308 aa, Homo sapiens
MRPRRGLRNSAKRVKRKKQTEERKKHTTNKKKKLCGAPARTRKRSFQQHCRGGTGDPRDTQHDGSPAGAAERERGATNRGAVVSPQKKRRGGHTSRLFGHTPRRRLARNKDGLSQERMPHRKRDNNNRPARGGTNKQSLLLRRTDQTAHDQPRRHSERHETETRVGKTEASSRARRSREEELIENRVLGSHTTRTTRKARRHEEASAAAAADEREPQRQGSDEIAEETIALPAANAEDNRSKSDVEKYRQQMPIEHSTTDENGQQLRNRQEDNKGQAVQQTRRAHREDRESDRYRREMNGQRQREKNE

SEQ ID NO: 1022688 - protein, 36 aa, Homo sapiens
MWHNYNKLVIPKLVIPKLVIPKLVIPKLVIPKLVIP

SEQ ID NO: 1022689 - protein, 51 aa, Homo sapiens
RFYGVLTFSLIKRYLYYKSYLCKLVIPKLVIPKLVIPKLVIPKLVIPKLVI

SEQ ID NO: 1022690 - protein, 345 aa, Homo sapiens
MWFKYLPLHLSDEAADEAAGPVLGVCSGQLVELGLEPQSAPKKLKEMDFLFFFLKRKTHSVAQNWSAVARSVAYYNLRLRGFKRSSCLSPPPAWDYRHMPPVPGIIEWYLKVETRLRQCGPGWYSNPVSSGDSTVPRPSQSGKGAHITKGQQVIPSRGLRGPRLFQWPKAWLWVALLVPPPSGLWEHQMNSGGRGGALFEEGSETTQPNGFSTLEKALGQEGGAVSGAALLGFRDRGGSRRVSSPWPKCQVARSTHAQSLCGVGISGVVSWKNPLEILYEDPVADLTFTGGVVISPGPCVGLPRKAMGVEAPSTNVKPALSQEGSGCPIKTRKREGPNISGATGP

SEQ ID NO: 1022691 - protein, 255 aa, Homo sapiens
MPPMNCADQCTHVLVTCMLEMLCLLCCSEALELAPQWTLPMTAWCLPWMCTKMEHALLPRLTHTQLRDTGRGPWWPLSTRLQTPETEPGGQPGLTPTWSLKAAWCARGPWPRGLAGGGSYFSGQGSDTWRVSQARLFGAGTPDCPQQQRRDHRRRLHPRDSTFTPAGVAAVEVQGGARGGITEEQEGFADGYGQGLDDLAKMKPRDTTQRVLGRYRVAPCGPVAVKRAGATPFNHLSSIPALSRSPGLRDWTRRA

SEQ ID NO: 1022692 - protein, 74 aa, Homo sapiens
GVKKGPAFKQQRRKMAATTGSGVKVPRNFRLLEELEEGQKGVGDGTVSWGLEDDEDMTLTRWTGMIIGPPRTIL

SEQ ID NO: 1022693 - protein, 123 aa, Homo sapiens
MYTCVSCISDAGGHVRHVGISDWNGGLGEARTNYLLYRVASDTLQLQYKGGKGRPQYRISDTLGNRVVKPEKVAYSGGRPSVTWTPLVRGALQIREACPISRGGPLLGSVAAAKTVGSSLGRE

SEQ ID NO: 1022694 - protein, 338 aa, Homo sapiens
VPLATSTPRHLLCGSCASQAQCLQLHCLEVACMLALAAGACPALGLCVLLGLLPPAAGPARALDLLGSAVLPWCSATLACVAGIGITAAMVAPEICLRQDCRAVGWGSSVWCLLGLLPAAMLAVPCTSAPPQLSPALHSWKSSGKFFTYKGLRIFYQDSVGVVGSPEIVVLLHGFPRSSYDLYKIWEGLTLRLHRVIGLDFLGFGSVTKLRPITIPYFEQASIVGSGFCGHLGAPEPGGSHFFLMTMAAYWWPRKLLYSFQRRIGLGRAYHKTSLALSQFEELIPGELYGPLISQEGNSKIARWSDPDFYTDCMTPLCIHSRVYPQVWDAITAPFIIR

SEQ ID NO: 1022695 - protein, 253 aa, Homo sapiens
RLGRGWVFNRRGCRGVEGRGVPGASPGARVLAPWPCVTVSRSPPGSGASTALWGPGIPERGEGTALPALTCPGAALSAGPGWSSEGVDSSEAELCGAPVGAVLGTARMEGDKWMMASKKAKFLKANRTEGPRSLEEEASTGGPRPDFRAKGSQKSPESTEEQEREHSAASWYRRAEAAGMTSDLEAQAGGTPGLPGIRIPCLVVSTREGRRSEPRMRRSSWDVDFPDSRFEQGEERRGKEGLHVSLVAKRIFK

SEQ ID NO: 1022696 - protein, 323 aa, Homo sapiens
DFSLFDVVLKMRKQRPAAVRAEEQYRFLYHTVAQMFCSTLQNASPHYQNIKENCAPLYDDALFLDSPGTSRPYPAHQEGSSGASLCPGPRATPWLTPTRWCRSAGLQRAPGVGRRRGRGRGRGRAARKGGAALQQGDARAPSDPGRTREDARGTLPGRVPADQSPAGSGAYEDVAGGAQTGGLGFNLRIGRPTGPRDPPAEWTPGVGLPRQFLPVASCELRTADAPVLLSAVRRSGNNGPGSPVKISQGGKCGGFARMNVAMQGLKLEEVAKVLVAAEAAQTQHSCKDRIQGGGDAPLSYAGGEGDRLSFRRVFSITTHSILT

SEQ ID NO: 1022697 - protein, 95 aa, Homo sapiens
RLTDWGSEMAWGFLQNVISPPGDCLEDSGAWAAFAYSHLLLSCPGGHWQVSRRREETHLLEEAAHDSSPSWDSPSSSSYSPFLGCSLKGPMSSHH

SEQ ID NO: 1022698 - protein, 256 aa, Homo sapiens
MPSRRRPKSPRKHNYRNESARESLCDFSSSDISQDPSSGNTEELNTLFTSLGPTEYSYSRHSYSTTQDTRKEINTTPQGGMTPGRLLQIYEDVSCCLLKGGAGNKRDNTFVRGGGGQCSYNEEHETDDKKRLKSHKPSSQICSSPKSSKSVFQCKTTISSVIATHKNSTSHTGEDQNNATTSQLGKLSQQTDITSTFHEARAWDDLTHKGINLHLNLLSPSDGHRVHARLPETIILLKIARLPFRNHYRLLTLPST

SEQ ID NO: 1022699 - protein, 75 aa, Homo sapiens
LGLIIRRQYDGFIPVHERQNDVRRPESYKSISSFFRAATAIERCFLSSSSSASISRTCLTSCFFFSSLCSSRPCR

SEQ ID NO: 1022700 - protein, 236 aa, Homo sapiens
AEACGGMSGLGGSGRARRENRQLGSSTVHSCELESIASLNMCNDDLDFETGDAGALSSAFPKCRCSGLRKNGFVVLKWRVACKIVEMSTSKTGKALASAKGPIWIGIDHLLPGKEHIEVIILPRQPHNMVCPQIESKGSDFQLIGIQDGYLSLLQDSGEVREDLRLPEGDLGKEIEQKYDCGEEILITVLSAMTEEAAVAIYLTFYFGFPHPLNLSGSPCPSPSSLGQERAKLWPW

SEQ ID NO: 1022701 - protein, 376 aa, Homo sapiens
AEACGGMSGLGGSGRARRENRQLGSSTVHSCELESIASLNMCNDDLDFETGDAGALSSAFPKCRCSGLRKNGFVVLKWRVACKIVEMSTSKTGKALASAKGPIWIGIDHLLPGKEHIEVIILPRQPHNMVCPQIESKGSDFQLIGIQDGYLSLLQDSGEVREDLRLPEGDLGKEIEQKYDCGEEILITVLSAMTEEAAVAIKASGKNNGPRVPGGGSSDPLNLQKAPPRAGLALAPVLKLDSSYTIDLTCIEGFRHPVNLDGETLPLTKYVCKNRRSEALEKCIIGAINKTAGEKKGGNCKGQQGRRVYNTQKRKREQDKTVATKKGGAEKEQAEKPNGRPRTVIHNRDNKEGTTVEATTAAKEKEKETSITGHRT

SEQ ID NO: 1022702 - protein, 207 aa, Homo sapiens
MVAIRKKLVIVGDGACGKTCLLIVFSKDQFPEVIRPYWSLENYIADIEGATGKAGGAGSVGTQQAREDYDRMRPLSYRDTDVILMCSSNRTALEAWENIPENIGPPEGDSTSGPKCAQSILGGEIKKGPEGKTEAHQREELAKMKQGARPGLEDMAGTYGEPGISAFGVTSECSAKTKEGVRRGVSAMPLRAGLQGPKNKRWRAAIL

SEQ ID NO: 1022703 - protein, 323 aa, Homo sapiens
RAIVVTGWFNRHEGELLWCGAFGGRRRAAQGLPAGLGAQRVAAGVEWAGRAGGPGAAGPRPGPARGGRATPGELPGRRVCPAAERRREPGEGPSKTPVETQGRESWGAVFPGEGPRRTPRCKVTVLGPREKGSSGWTPAGALGEGGGEDRTRGASERGEGRGATGGSKGSGGLDGMRASSDGAGQGSAEGWKRGLRGPFGGGATRNLPGGKAGAGGSGIAGTFPKEERPGAGEMNGFTRESEAKGPRQQGGADGDRERVALEGGDVVRPGNALRRGQKAPENQVASKEERILVQKFRGSRETRVEFRTRIRVSRTTLEGRERK

SEQ ID NO: 1022704 - protein, 99 aa, Homo sapiens
MIIALYSSLGDTASPCLRVSKDFSWGKVAESCETPSSPILSSLSASGSECCWVVMAVYFATRFGGKAWTLNGMEGVNIARVSNEDTSEGWQQLWARERD

SEQ ID NO: 1022705 - protein, 259 aa, Homo sapiens
MSLRWDPTDLSKLENSVIHKIFSKFGKITNDFYPEEDGKTKGYIFLEYASPAHAVDAVKNADGYKLDKQHTFRVNLFTDFDKVYDRSSDELGYSRENSVSKTWGNLRYWVEKGRMLEISTGVTFEEVGNRLHSFWRLERYTEPRFSLVRTARAFVTEASSVVGEVVPYKGGPTHGGPLSLRRVSLSAESGDENQMQHTHDHDAITTRATHSQHPPPDSSRIHVCSILPDHDAYASPYPHPNCAKHTSTYGIATMRHSAQ

SEQ ID NO: 1022706 - protein, 164 aa, Homo sapiens
FAAASTIGVTVTEASATFSGHGSKMAIPGRQYGLILPKKTQQLHPVLQKPSVFGNDSDDDDETSVSESLQREAAKKQAMKQTKLEIQKALAEDATVYEYDSIYDEMQKKKEENNPKCFGERQKAQVYSQLAKSTLRSEKQEQDTTELDKKIQREREMETQGEFD

SEQ ID NO: 1022707 - protein, 97 aa, Homo sapiens
FAAASTIGVTVTEASATFSGHGSKMAIPGRQYGLILPKKTQQLHPVLQKPSVFGNDSDDDDEDLALSPRMECNLCSHNSWQPSTSQAEARLFTSASQ

SEQ ID NO: 1022708 - protein, 95 aa, Homo sapiens
FAAASTIGVTVTEASATFSGHGSKMAIPGRQYGLILPKKTQQLHPVLQKPSVFGNDSDDDDEDLALSPRMECSGAISAYCNLCLPGSSSSPVSAS

SEQ ID NO: 1022709 - protein, 215 aa, Homo sapiens
AGSGWCNRGEGCLAVLCYLLPVRTEPAVSTRRVESSPDSRSREKTTRDTLGAVRRAELVLKRGSEAGYIFSSGLLLSLGTGCQCLDGGFQRHMGAPLPPGSPVPHPVTGRSGKMPVQVHEDEKFPWGGSSSSRKYGVLSAPKCKISSYCRSQTPARLISGEEHFSSKKCLAWFYEYAGPDEVVGPEGMDNNFVKTLVLKPENIIMVGFKGGNLGG

SEQ ID NO: 1022710 - protein, 147 aa, Homo sapiens
MNYINPAVAKLLRCIFLRKASQNMGAPGRKSRTHGWAFAAEKAEAKGGAGNRPRSSGADPGAFHGPGGKGRAHREASSPRPRWDPQARPGRCREAGPAALLARIDPSVPGCPLTRLPARTAPGSRVPGKAERSGPKPKARPPQGASG

SEQ ID NO: 1022711 - protein, 70 aa, Homo sapiens
MTNEETEEHEAPRKRQNNEPKRHKTGDRQTNLTTQHNNQTTSTQQKHSRQRTPKTRTIQTTGQPKKTIDG

SEQ ID NO: 1022712 - protein, 271 aa, Homo sapiens
LPQLQNFRPARPFGFLTLGYGDRFLCGVLRAIMSVLTPLCCGADKARPAAPSAARKIHSLPPEGKLGDHGTVAVWFNLLLRDLPPASGVAPGHTLEDLTGGQQCKGVRSVPHNVDLDPAPPPILGSWNWHFVAGSPESCHPNFQYTSFCIHDLCDVSMGDPPVGVTGPLSGGVPLCNNKIYLTKTDRSAAKQPNNNFCWAGLRSSEKGSKDPIWWGGAGPGRFSVQLCPMAAPKGDCGIGILGVVPPEKSARGNRGFGNKSKGGLGAIQAL

SEQ ID NO: 1022713 - protein, 234 aa, Homo sapiens
KKVYILIWGGGSKKASPYTGPYSGAASGPIGYKEDSEEIKVVGKNPGVVAWYVVRGRRDEVKCEGPSYPPSVPQTMSWNPGGEKAPLSFRLLGMVDGHVVIRERQAKKSGQAQNGWAERWAELARPGIILDQSGLGLRGHQENLGNKSPWRPPSRMERETRESQELFMAQEKAGIPVRHFSQNRTGVLTEDERGHPEIGECNGRGIKEDREYKATGTAQYNRGYDGGSSIRDLV

SEQ ID NO: 1022714 - protein, 285 aa, Homo sapiens
MWALCPRRTPILHSKMAEGNSTQRSLKENIRARAQYVSPTSVVSPQEPGRDHKLFSPFYNGLQGKHLLAVAHTVLEPPVGWRTKIHQINTRGHIKTAEEHLYLMDAPGESAGSPRAINSHPVKTRYEKDPQRVSISPTVAAGGPIFFGVSCPPPPQPVLRHRKPNTFPLSEPRQATPFFFGTSLRSAPQYVRPPKRKNVFLSKKSPAEGRFSTSTIYQCPAVTDVHGWEANRANGSTRAVVEDHHILTLAHSDDPHQPPSCRTLRERTAQVLTRTVCEQQTTQND

SEQ ID NO: 1022715 - protein, 365 aa, Homo sapiens
PVKLGTRPRSRTAQPNSGLLQCLGHHPLHHVMSPGQPYPVSLNRNATPICQPSWATTHTLCAAPRRAMRPSGGMPRAFVGLIIFLLCTLFISLRSSDHRQVNSLMQTEECPPMLDATQQQHAARLARLLQAPGPFAQRRSDVRHLQPTPSSNFCLAAGPHCTVMMTLTNLVPALVRPWTDDLSTCAAVWVTHSVPAWPGLLLYLCHPWSPHSSCRNRDFPPEAALTALPSGAFLLSLVCHLQSFALTWPNFASLSLHRIQRYVSISSNHLTLTLSVLALGACGSFMPLATKAPPQVTPTTGSPCELLLYYPPAAHSSKCLLPRSPLPDPYYSLCLTPILLECSGLKLCNSFVPPRSHAKLERSTT

SEQ ID NO: 1022716 - protein, 96 aa, Homo sapiens
LCCQGECQWLHLDLIKEMRQFCQSLFPVVAYAYCTIPTYPSGQIGFMLCSKNPSTNFQEPVQPLTQQQVAQMQLKYYNSDVHRAAFVLPEFAAQGP

SEQ ID NO: 1022717 - protein, 238 aa, Homo sapiens
MTSVSGQPGARKNSENRQAGLVDAEARQVAARMPAGSTYRYSRGKHRGRHSGWARSQPRKGPRRGCRAELQDAIHVSGHLRGSLGGVVMSCGGASAPPAPGRTSLLVLAQPTKVLQAPEMLPGCPVGRDLSVCLVSLAFHPPSLYQLVLQGPSLCLSVAPQLTKTRVFIDTKTQTTKQQHLLLALSALKNSLNQSLGARPQDIETWQVAQEDWDRHGGFPLNRGPGGTQACDTGYGRA

SEQ ID NO: 1022718 - protein, 51 aa, Homo sapiens
CAGVTRGSREYVNMSVGGNISNHSSMKTIFNSKGIWSRLQGGKEYGYENTE

SEQ ID NO: 1022719 - protein, 162 aa, Homo sapiens
MVPFLREDVSILHRCVLAGAEESLVRRSLGLRSRFKRPCELTQKKKKAGDIMTGGGKGGIEWGLASFAGPGFLCQGGNSGGPMGADNCRRGHRRSGETNARRRAHKAVPLGTKWQAQMTVANILPEKTTVSDEDRETKRKADRRDRTPEQNNDQRKHRTQAA

SEQ ID NO: 1022720 - protein, 92 aa, Homo sapiens
WSRSVVVAHGVGFLSWQGGMGSQNVGPWGALSVPVAPQESLSFAVVLRMAQRVPERPQCGQLGFKLTSEPPCGGGASEGSEVIFLCGFSLLA

SEQ ID NO: 1022721 - protein, 582 aa, Homo sapiens
WVRVRGWRQRAPYLPGPPIGVPYPIPDPGVRARGPGITRLPVMVLKAFFPTCCSRRDSGLLVGRWVPDQISAVVLAFLHFPLIPIQVKQCSCAQVRQASQCVDVAVLVHLCATAGRRPEESLGPLPGEPGLLSSPQDALAAAVPGERLDVLELRGQPTGKRPLAPDAPGEDQVMLIFYDQRQVLLSQLHLSHLSCPDLPGWSHHCQQQGWPWLPVFDTDSTAVSVLFQTDDQHLMSGPDAAEATGQYGGRGGPRILADAGTGRHLEDPFVCMFGPDLHVRIGLQDCHDALARSGSKGYWDTHDPIPTRDAKHRHNGDGNRTPGNPGCETTITADIYSYNVTGRTKTPDHKREMQERANHRERPHLMTRLAQLAPWAHQCLLSLSIHRGRKAEIGAFMGTERHNGSSVGMNTLGRRTHQGHYVMADRHRTGDGSHAWGLTNEPTGAQQGYTTVAWGNAVHSHIAQNPTWCEYVVTNPSHQCMHTYRSEHNIAIADRWRIIVAWYVAPIKCCTMRTNPTLETVDLQRPYYRLQQVNGGDADTSVGPHGYSHESDQWQGATSSGHRPSSTSVSDYTAKQRSYKYA

SEQ ID NO: 1022722 - protein, 534 aa, Homo sapiens
MAKGLISSKEPRHGPSQIPPWVSFQFPPLPNAVRIPFQFSSNLQNQPLFFFQQAQTFPNLFSTHKCNYTCVKFTHTFLTYFTEERGAQLENKSLHLVVSTQDTWWTPPRGFVRQAVAKELLSLCGTQFLEESPTGEKNGGSCKRVWKFRGVERGFRGVHPTSVAPFFSLREECVLRACGTPSAAKPVGVSEGAHKGAEFVQTVGPLGGTQRDTRGCELCECACAHWCGPPCVTESFKKTRVTIFRKKSLRHRRVSHTGCWRRRSSCFQRGVCVGPVLKTFYTKGTKKVFLFHQSGRPNRLVCVGASWGRPTQYYIFGALGVGAQMVLISVYTRPPQEWGLTQTIHEGSHPHEEGTTHAVGVIMFPLFNSFPLVGRAPTQALANVLPPTLGPTTCSSVSKTMGYRTYPSIALTTSSPGTTPPSWGYQTADLYGPSQGPLVVLGRSPRFSRGGKRSPLFTLSSRCVTTRWWAQKKVGAYRGFLSSTCAPRGSTHPRTSVPGQTVSRHRLFGGPLLLLSSRKPIIKRGFVIPQRVVG

SEQ ID NO: 1022723 - protein, 158 aa, Homo sapiens
SRRPPATRQRCPPASQLVCRSARPSVPEPADRDPERAGPESRETVPGAARSSGPRDPGTGPGPQRPGGRGHHRKGLRSVFVAGEAARALPGAASGPSPAGGLRPAGRGRGREGRAAPSASWVAASEHDPRGPAPRALIRGDPALPQPWAPGAGGGRRP

SEQ ID NO: 1022724 - protein, 44 aa, Homo sapiens
SLLADTTRTRKLQEQRLRVVYSTSYRAEEYGNRITVHGNGSLDI

SEQ ID NO: 1022725 - protein, 227 aa, Homo sapiens
HEGVLMDGKWRLSEWETQLQRLQPRSPAAKGPPSSGRGRPLRPSALRPPAPPPPPPCSFALQVSEDPILALPVSARNLPEAVGATPSPCGPPRAAHACPPAPRSAGLYPRQGWLSEPGRSVPLSAASPATRGPRYPLPAAGGAWTPGGGWLDAGACGVPRGRRLPEVIRDDADSSVLLGGCAQFVAFAAKAPGAFFIYICAGREIRTVIQYQTVRYILPLSPVSRNR

SEQ ID NO: 1022726 - protein, 100 aa, Homo sapiens
NGARELTDTLQAETDQLEDEKSAMQTEIANLQKEKGKTRVIPGSLTEPGLQESLMNLVFPKREMSARSPYLYSGGPQRGVPPRVSRGSPTPSLYYSSPVE

SEQ ID NO: 1022727 - protein, 78 aa, Homo sapiens
GFRWQGLGKRRRRMSGREGGKKKPLKQPKKQAKEMDEEDKAFKQEKKEEEQKKVEELKARGGGRGPWAQVELMKSGKK

SEQ ID NO: 1022728 - protein, 366 aa, Homo sapiens
GFRWQGLGKRRRRMSGREGGKKKPLKQPKKQAKEMDEKKKKKKKKKMGGGLAEKSFLRPFRCGGPRRAPFSYVEIWALRARVAKRKDAGSYALECLGFFHQLKNRPRGTPELRSEQIPREGVPEANHGLPITGVPRDEALDINYAPRPGSGKEERRGKNTIKGASGQQVSSNTTKQRQEEKLKNGKAGLTDTVRDEGGNNKFRTYGKKRGGTNNVATHCDPVKRQNTGKTHTQEEWGGTNKKNLNTKPPRETRPDTPEQATNRVNIDVNQQREQGGRSTTKRENVQSSHRKRGKREEQPKTKETLHGNKTEEKHSDEMKNRRTRGIDSYRRNTKAEKNDKEEQSTDRHIEQDSHQHRDKQQQHRRQ

SEQ ID NO: 1022729 - protein, 116 aa, Homo sapiens
GIDVKNLGGDVQGRSVIPGHDTICSTGVQTAPALDSHRGTFSQKNQSTSNCCGYLHNSNEKRGPFGLTSVSYEVWNESYEHWNCGIGEENEDPHTMIKVKKQVKEFLLLYSYLHHV

SEQ ID NO: 1022730 - protein, 141 aa, Homo sapiens
RGLEEASVPGEAGGSWRLAGAARAARAPQPGPVLGAMSWLVGLREAALWWLWAEARTSSFAEPWRLEAGGGGGWPLEALASGPGGTGGVKGICRGHGWGRRGLELRGWTRLACGGGGSGGPVRRQLSFPPPITTSTQQPTQ

SEQ ID NO: 1022731 - protein, 279 aa, Homo sapiens
MCTGTEKARIVMDDEIHRNIMDIFFKAPFIFKCGTETGGFEELKEARHDTARNKHAAKCPEIERQIAAKTAHNDAKQRQCAAAIGAAVSQRASVISFGLRFSGQAVVSFHNGAIQIQQPRARKHALRPKHDQFPHAIFQRIMASSSLFGQNQRDRFAWQAYPTLIDMDQMRNPSPFRHVKRNRLTFDRYWGTIWIRCPSTHIRIRHGHRGKHGNNSRMVKRESFSLREWKRRLVGSHQAELGPRKTGLPLVSKTHSVRGKRNHGVPGQKVAPHVLCGKY

SEQ ID NO: 1022732 - protein, 220 aa, Homo sapiens
DAWVRFALLGQKCLKQWGTCHPTLTLSLPQPPTHTHTHTHTHTHTGTMHTRIWEGNAMLPVKGTCLFPQLSSGCSNKGCGGALEEHPRVTRVLCALSHRPPWWTPPAGGADDPALSLPSRGPGAPRPRDLWTGQDSGIPISPPKQQPAREEPNKPKVVDPQCSANLGPHHEVSHSTQTCRLDGAGGWDVKGVCIDRWHKGGAQERGDSEGRDDPERNATP

SEQ ID NO: 1022733 - protein, 95 aa, Homo sapiens
GRNMADRLTSSFSDAVNSLADQFCNAIGVLQQCGPPAPFNNIQHSKLSKDQPANPTEEYAQLYGSTDVHDQRKDIDVGDRFLTRGEEFYSCFTGC

SEQ ID NO: 1022734 - protein, 117 aa, Homo sapiens
MDNRFATAFVMACVLSLISTIVLLSSLHVQRLLGMNIGSPDQRKFPVIGIMKHLGDEFISDEADETDSLMTALFRLQLAQWDVDDRCITIPKNMLGIAHQKGQSHLTVVTKMCELPQ

SEQ ID NO: 1022735 - protein, 331 aa, Homo sapiens
MVDGTLLLLLSEALALTQTWAGSHSLKYFHTSVSRPGRGEPRFISVGYVDDTQFVRFDNDAARSEDGVRGPPLDGRRQRRSELLRDPGTTTADATGPPHSSLFRADTLRTAAAPYYQLSSEAGLLSTPGKLDCTGLTQPGRPTRRFPSEEYDTATAYDAAQDSILTRELRTCASWTAVDNGGPQIVRHKSRHCLPLSAEHQRAYLARHNAVAVASTNTCSTGQGDTAYTLEPPKHTTDITNPNLWTMTANLTCRARRYYLLETHMDRHKKAQSHTQDTTPRTPAKGQNIEGKRRNKDTEKKRYTQQAPNDKLNAPQPHNKQPTAPDDEDTS

SEQ ID NO: 1022736 - protein, 231 aa, Homo sapiens
HPEPPKAEMQPPPPPPGHYGAWAAQELQAKLAEIGAPIQGNREELVERLQSYTRQTGIVLNRPVLRGEDGDKAAPPPMSAQLPGIPMPPPPLGLPPLQPPPQPHSSTRPWSWFPMEPSHQIWGPRPPLRVGDARWHCQRRSGCTLAQQQAALLMQQEERAKQQGDHSLKEHELIGGSRSGQSVELGAGNESRQIANDGHPGPRPPKDMAPRFGVRTPLGPRVSCSSGPDGT

SEQ ID NO: 1022737 - protein, 177 aa, Homo sapiens
MLGLFPPKAAHLQNLDSWTGTWDTFNPLTRLQFRLTHFLPQILEYPLGRRLLIIPFQINPRAPKILTTLTKPPSEGAQTIVVGITFHKAYHGGSVPGSEWVGAMVLDVLNMRDRTYNFLKEYYTHRDIPLRHVHPETTDITNMTATKEMNKHIFALWAAREIAKIDGPMKKDREQTT

SEQ ID NO: 1022738 - protein, 90 aa, Homo sapiens
MSREPTSYTRERRDGKVAETGKPRETLELDTKFTQGKARTLGETGKCPQTIHAPCVTSSAPMGPVTPDRICLTQRFKIDTTIASPHALPP

SEQ ID NO: 1022739 - protein, 70 aa, Homo sapiens
MSREPTSYTRERRDGKVAETGKPRETLELDTKFTQGKAREKRRDDFKYFTISSTIELPVTLSAFHLLTPV

SEQ ID NO: 1022740 - protein, 167 aa, Homo sapiens
SGAAADVGVSEAAPVTHGGCRAPDPGLLPEFLHLSSGAPHPSTVALSPVATEAALLCILRCPGLPALVSCWLLLALPAPSCLPDVTAAVRRHSHGRVVVKAAVLRVSQCDSRRRSRKVLASPRRAAASVGAPNISDTVTVKNPERTNGRNSPCQRIAPSSSLTERNL

SEQ ID NO: 1022741 - protein, 73 aa, Homo sapiens
AQTSLPSFSLRPPEHQRALSCPQESLPLLQPESPYWREEVREEERKGSLDLKYPDQSRVHMGLVGVTTQINTA

SEQ ID NO: 1022742 - protein, 88 aa, Homo sapiens
SGSQRVVSTGKCTPPCDSVMQTKVPFGPVPVMSQFSHQRTGHLVGLQVTRAFKTSVVRTDIERPTTLTYRPISQMVSSITACRRFDGA

SEQ ID NO: 1022743 - protein, 326 aa, Homo sapiens
RDRERERPRAAPAPSAPSPPGPRAKDARPPPSPRLPAHRAHRAATPTPLRTACPLRHQLVGVFVAALAPGYLLRATNELAASPGRSPLVVTLLHLTRLALLHLPPLPATAPWRRPSARRGGRDWSGTGCGCCKVCAKQPKEDCSKKAALENNKGAGNETSAPDHRSERGICKNISQRADPVNITPESNKKGKGSSPTVNISDHVLMAPGAAFLCVPKKYLSPTWAVPTLGWSKLPGSAAEEWVCDEDSIKDPMEDQDGLLGKELGFDASEVELTRNNELIAVGKGSSLKRLPVFGMELASYTTFTRQKCIVQQLHGPVLKTVDWYL

SEQ ID NO: 1022744 - protein, 68 aa, Homo sapiens
MDLVPYYWQNGTKAIFDSLRENSYKTSSHSYILEANDRLLNTVNVFTWAFVKAWPKRRDTYAINRRFY

SEQ ID NO: 1022745 - protein, 130 aa, Homo sapiens
LLLNSRPRRMEVGHRDYRSMEVGHRDYRSVEVEHRDYRSMEVEHRDYRSMEVGHRDYRSMEVEHRDYRSMEVGSQGLQVNGGGAQGLQVNGGGAQGLQVNGGGAQGLQVNGGGGRDCFSFCPRGREFSSS

SEQ ID NO: 1022746 - protein, 134 aa, Homo sapiens
LLLNSRPRRMEVGHRDYRSMEVGHRDYRSVEVEHRDYRSMEVEHRDYRSMEVGHRDYRSMEVEHRDYRSMEVGSQGLQVNGGGAQGLQVNGGGAQGLQVNGGGVTGTTGQWTWSTETAGQLRQTTGRVDAAANL

SEQ ID NO: 1022747 - protein, 151 aa, Homo sapiens
LLLNSRPRRMEVGHRDYRSMEVGHRDYRSVEVEHRDYRSMEVEHRDYRSMEVGHRDYRSMEVEHRDYRSMEVGSQGLQVNGGGAQGLQVNGGGAQGLQVNGGGAQRLQGSGGGVRRTAYQWRWRAQGLQVNGGGGRDCFSFCPRGREFSSS

SEQ ID NO: 1022748 - protein, 186 aa, Homo sapiens
MERQGARKTVSPTPSQYCENCDTHFQDSNHRTSTAHLLSLSQGPQPPNLPLGVPISSPGFKLLRGGWEPGMGLGRGEGRNPIPTVLKRDQERNLGISESSILLALEMTHIRPALGYLESGGWDGERPPSGGHHLSLEGGEKEGGERQGIGQLGSTGLYMKPRVLTLVKSDPSLLLKSELGLLTWAL

SEQ ID NO: 1022749 - protein, 126 aa, Homo sapiens
MAGVGPGWDVAVGLGHGLQGLIGSLGPPGFKVILWFSVPLRQSPTAQLHIFCGDYRGLISVAIGLSGTFRGLKEICVALASIKVRGYRALSSLSPAVLYRFKDAYDHLAAYPENPGRLLYFQGQLI

SEQ ID NO: 1022750 - protein, 87 aa, Homo sapiens
MRAEPISTPKLDKMPGMFFSANPKEFKGNHSFTSGRQNAKKEAKDFLGLDIKAYLQIYDPTTWILELNLPKSQGCTSSSEGINVLTF

SEQ ID NO: 1022751 - protein, 290 aa, Homo sapiens
SGGAELGKGRQRRRRQRQRQSPVPETKRQTGGAGPRKAGSASSPDTRAGEEKQRLLARIPGSRTPDWPGSQGLRSRSRGRLCSASDEGWPFGSAPSTAGPRQATMTENSTVRPCGQGPMRAKAIQEVHRPTQCIQTLIVAAIQAREEPRWLLAPVHSEVYQEPATRWCENADSQIKLSIKRLVTTGVLKQTKGVGASGSFRLAKSDEPEEVSGLQEDHRRTSQNGSHAKEGIQAKKACSNSPKQESQEPPGSGSQEEAGGTPRKPKPQDWQGQPARIQAQKGKPVEPSKV

SEQ ID NO: 1022752 - protein, 106 aa, Homo sapiens
RPPTTTKFAAASTAMEEAKKEGYDLRSDAIPIVAAKASRDIASDYKYKEAYRKQLGHHIGARAVHDDPKIMWSLHIAKVQSDREYKKDFEKYETIQQPRRSTRPRI

SEQ ID NO: 1022753 - protein, 113 aa, Homo sapiens
SWDVEYGQPWRSSHEHCTVERDPFVFPYRPPPRALSAQSLDARHPSGGSLTGHWKTPQPLLNVHFQEASPVPTDISTLCSDTCHPAEAWRATGHHVLYLKVAAGPDMGPVLKR

SEQ ID NO: 1022754 - protein, 442 aa, Homo sapiens
APFTPPSTPPSNTNYNKTNKIDDVEVEQKQTHLQIKIFYTLSPVNGKITGANAKKEMVKSKLPNTVLGKIWKLANVDKDGLLDDEEFALANHLIKVKLEGHELPADLPPHLVPPSKRRHECWRPAPHLPFARPAGRQRRGEGKPHHFSRSIKTERMFPRLSKRKTTIFLLRLFLGLAGEAELRGWNRVHKNCGYFNIYTLEAAFFVAASPDVPSPVCTDSDPPGLCCGLELDMCSDCDLWGSQVRPFWPAAEAEAAWTGTPGTLTCASELRELHVDRGFLPHLGSAFPTCISGAKMEYLWPYTLHEDPVVTVTRSLDPLHPRDTTGFRALQHRTQARIHRKARGPGQHGTIRRGRSRDRTPERTGYTHKKTYQHELNNRVSGNKTNLTHNLYPNEPTPNIPTQQGHTRTGAYGPPTTTPPTEGDTRPAGQQGERTVRPRRVH

SEQ ID NO: 1022755 - protein, 512 aa, Homo sapiens
MHELAAEPRTSALCPGDEAQAVSDTVGLTCSAIRTSSRLIGDGCGRSESLDALPRVGHTARRLLTGLMNRAVRVLAHRAMGGRLRASDYVGVGELRQWINAHLQIKIFYTLSPVNGKITGANAKKEMVKSKLPNTVLGKIWKLANVDKDGLLDDEEFALANHLIKVKLEGHELPADLPPHLVPPSKRRHECWRPAPHLPFARPAGRQRRGEGKPHHFSRSIKTERMFPRLSKRKTTIFLLRLFLGLAGEAELRGWNRVHKNCGYFNIYTLEAAFFVAASPDVPSPVCTDSDPPGLCCGLELDMCSDCDLWGSQVRPFWPAAEAEAAWTGTPGTLTCASELRELHVDRGFLPHLGSAFPTCISGAKMEYLWPYTLHEDPVVTVTRSLDPLHPRDTTGFRALQHRTQARIHRKARGPGQHGTIRRGRSRDRTPERTGYTHKKTYQHELNNRVSGNKTNLTHNLYPNEPTPNIPTQQGHTRTGAYGPPTTTPPTEGDTRPAGQQGERTVRPRRVH

SEQ ID NO: 1022756 - protein, 300 aa, Homo sapiens
MSSINAVLCCSFPLCPVLLFLVCSFWVVVRRSSRELVVVVCPPATMSPFGSPRSRLMDSLPLFSSGESPPNNGGSCCAVVLLLEYHLRFCPPPLGMAVAYIFNRGDPQRVHNLAPPVVKCPQCCCYGGDPLGECCAHPALSWFSFLPWRFPCAHNTNWLLAPRWPPVFNSPGPKPVWGILWETELPLAPHGPPVPNLQAPPPGKDLCDGPPLRGNLCWPCMGPRAAFSPGRVYIPPAVYMGARAQGLVGAKRSIPEALHREDVYMAIGHSRGLPTCPTGSTWLAHMTPARFRKHFRPIFE

SEQ ID NO: 1022757 - protein, 171 aa, Homo sapiens
MRSPRIAQDRLYGATKEIELTHMCIAWRRQKPTRGSALPVEQQYQVSVQLDFQLRLQSSTGSSSGSSVFLSIQPLRKLQSPPAAPGSEQLFWLSKSFSAQTADNRRRSRSKSKTNLKGDLQPGDGKWRAPILLSPRKCHLRDSTGLCRKDLVVENISTYEETSMMAARKGW

SEQ ID NO: 1022758 - protein, 164 aa, Homo sapiens
EESDARIVADSDQLTSVMILVMILLHARRRRSRRNQKRLINYKKTQKVTVPRTFCDVVTNYKRVHERRLSSSESEESYLSKNSEDDELAKESKRSVRKRGRSTDEYSEADEEEEEEEGKPSRKRLHRIETDEEESCDNAHGDANQPARDSQPRVLPSEQESTKK

SEQ ID NO: 1022759 - protein, 104 aa, Homo sapiens
THHVHLCTKDELREISLSTNIKLKEVYRDALLIENILMLILLYACLNKLRNSNTPRRNKENKNPGCTAVILHRIKTLGFHAVIMLTKRQCSRAKRMRPNTHSMD

SEQ ID NO: 1022760 - protein, 326 aa, Homo sapiens
LFPAPAPPPAPAFAPPPKVPSPERSAPRVPLPSPQPSYPFRPAASGGTPPTACLPPAQPCQGSPAMNLFRFLGDLSQPPRHHLATAQESGSPARAPEFQGRARSCLPVVFTARYLDLFTNYISRLQHVYEGGLHSLLLHHGLARLYTPSSQATYDGNHDTFRVEFLVVPTAILAFLVNHDFTPLEILWDLLHLPGVSGHLCRSLFMVEQDRRGRRPSPGHYLLCARRLPNSSILFKLDLALPISQGFFDLIAMWQACPDSPLLHFFYLYIPRLLKGRKLSFAGIAPVLSISLLGSTEKETDAAEDVSRFPIQGDFSNTHSGAPSAS

SEQ ID NO: 1022761 - protein, 233 aa, Homo sapiens
LFPAPAPPPAPAFAPPPKVPSPERSAPRVPLPSPQPSYPFRPAASGGTPPTACLPPAQPCQGSPAMNLFRFLGDLSQPPRHHLATAQESGSPARAPVRGPPGLAKERDRRAGVGRTYAGPQEGSCGALGAPGSTPHCIAGDLSLLGSWVSKGHTASLPQDWPGEHYSCSLCTAHYTPPTSATPPAPVWRSPQGSLAPRSQGTRGTRAQARCESGDAGPGRPRRDTGGKVTGLG

SEQ ID NO: 1022762 - protein, 376 aa, Homo sapiens
CYLFLSVLFSPDDAPALLSLSSLPLDPLFGPPLFTFTLSLPLSLPPSILDTTADLHITRYLFPTRRSDNDLAPTHSPEDKPGSYPWTYYRRVLHLLGIDVSRGFSMVVQDGIRDRTCSVVNQIGTCAGILLDSESNPNIHLHETLVVRLGPDYFTTTPYPSHLPSPVLGPMQIGNDGPDCLQINHSAGLAAQVKKTNNQNKEQTTKKHKKQRDATQHNNKQTPRKQAPHHTPTTTHTKQRQAKEEGQPTKDKSNTYQNQRQRGGKHHATRNRANNAATPPAYTTTTTNPAGQITASTHKEEDEYTKQERIRNRTTTKHHRKPRNDSTYAQPTQRTYMKDTKNNHGRNQQHTAQDRSENTRQHSRAGTRKTRRQKQR

SEQ ID NO: 1022763 - protein, 340 aa, Homo sapiens
AARMLSVALNFAYTGEHTAIYHLSPVMVWCCMLPVHEDCEEATEFLTCHGLTCFLTGCVELNLVCYSCEAAGIDPGDLGGVWCFIHYVKLTVSSRGNCELEGHCTLAARVVMPPCVQGSTSQNKCIGESLAAGAGRQEPESRLRQQWAEGEERSVVEEAGMHLLCSLAHSALTGRWSLIMGSASCPGGEPVCRRPGLCASCLCELNQRLQSRVSMYSDPRYSPAGPGVTWTQPKLLTRKPRATDPRRDVGAAACLTEAGWPTRECPYCLPRRHGTQLQPATPSMASELTRRTDTTTPTDRTPHPPRATPSYYRTSPDTHTHHPHTPPIPHTRAQHKPHTP

SEQ ID NO: 1022764 - protein, 140 aa, Homo sapiens
MPREDAHFIYGYPKKGHGHSYTTAEEAAGIGILTVDPWEVFNCSFGWWDLEKTENGVHQQPVTEDKEVLQCVDISSGVAFNKKMPNKKGWIIGAQQKCLFKRKIGEPVVPNGSTLLLTEKLLLQEQVTTTLFNLKSQRDT

SEQ ID NO: 1022765 - protein, 42 aa, Homo sapiens
SLGGIYLPRRVPSVKNGFVAGIAPHGGQSPSASALSPVYSSR

SEQ ID NO: 1022766 - protein, 56 aa, Homo sapiens
SAQVTRCLEEDCSSESFKVREENKQQPKSLLSKMSVWAQGTRRARFDTKPMNPWGR

SEQ ID NO: 1022767 - protein, 333 aa, Homo sapiens
TKCELRYPSNVGISHGVPRALFLQVAVIHVVSYVQPCVPPAVESFLLRQGQCGLNISWSLEAVSLPLLPPLALALILAFSLPAPRVKTGHSAPTDSAQLCNGDLQVHGAWNTCGSPLGQTSVCYCPSPPCPSFPDRKRVLLDYKVSPGVCDGAPGGQLLSLCLLTSFVPFFSCIHSVDVVLSKLRMSALCEVLGALRGDDSMFLPQGLPIQLGDRQLTTRAGLLVCTGGVLPGSRAPTVLCGSRLPGYLNPIPPIILTQSMGLGRKPGERDIAPRPRVENLVVVQQCLSSVLLSVGQAPMALWTFHSSRQGRAWGKAGLECFGDTEGTCPHPT

SEQ ID NO: 1022768 - protein, 223 aa, Homo sapiens
MADDFWQLLDKYALEALLRSCVRMRLCSEPVRWRTLPEIPHPGRPPHAQIQLKPQAMDFIHYHASDVLETSGWKSMVVSHPPLVAEAYRFWLQHHVPLFWEPPPPTPDSHPIDPACCKTPFNFHEARSHLLLPPEPPTVDTRHLWSFYSLVRGRDCTCGPRLFKQQLNNLGENGGRENEMETLCCVTVFPLGLAEFDTVGIQFRRWPEDIPAVVLRRHLSASD

SEQ ID NO: 1022769 - protein, 183 aa, Homo sapiens
MSVYVYVQLPFMEDLRQYMFSSLKNSKKYAPTEAQMNAVDALIDSNGAVAKARDEIILDDPYGTMFPNQIRIDPQDPSHLQRLYQCLLHRALTSPGMRILLTLISSKTIILVIIARTSFPVGELHYCIDVKHSIIILKNKRTLVFRLMCKRQEERHQSDCSGTFFHMKTSQCREWDAEQAKET

SEQ ID NO: 1022770 - protein, 190 aa, Homo sapiens
DSVLCFVGVLSTIARWFGGSISRLVSLDPVGGPPLSAEPGIGRNLRVDEDTSVGPMASGQIRVCLPVTTPPLWCSGTTALCPGPHAPIFWRIRRFNTAHDDNVTQVGPFYVNVLNEEPRKRLCENIAGHLKDAQIFIQKKAVKNFTEVHPDYGSHIQALLDKYNAEKPKNAIHTFVQSGSHLAAREKANL

SEQ ID NO: 1022771 - protein, 190 aa, Homo sapiens; identical to SEQ ID NO: 1022770

SEQ ID NO: 1022772 - protein, 38 aa, Homo sapiens
MAKGHKNIQTEEPQYTQADTKHSRDILYIKYAIGHETG

SEQ ID NO: 1022773 - protein, 223 aa, Homo sapiens
MSRSRQPGASLVLGEPPWGELGPPEICGAPKKRVHMGVRRDVCCAQQNWAFPKKPWGFRRPTHPFPTGLYSRFQHKNICSHVSWGLYTGVPNTQAISKSVPFVENPQRPHVCQRVPHNGTQVITQGPNPHPQAAQDTQGEHIVIERPLPTGPQDSRFLVARPERIHPFTKKDGASTHKFTIADEFERHTWWLKKRLNPQNGCGVKRHIPQIVALLDKWRALHS

SEQ ID NO: 1022774 - protein, 303 aa, Homo sapiens
MSLWQPLVLVLLVLGCCLCCTPDSRQYSPLCLFPGMTCERNLTERGSLVMRNTCSRYGYTSGEHGDDVVDVLINSLGRSATCLTVYPEDRLIPAHEILVELEYAALQLNGHDETPRCGVPDLSAWFQTFEGDLKWYQHNITYWIQNYSEDLPRAVIDDAFARAFCTVERGRRRLTFTRVYSRDADIVDPVMVLRSTGDGYPFDGKDGLLDTLPFLLAPAFRETPISDDDELVVPGARASWFQHRYGNADGAACHFPFIFEGRSYSALQHLTVASDGLPWCSTTANYDTDERFGFCPSEKSTPG

SEQ ID NO: 1022775 - protein, 85 aa, Homo sapiens
DRVCVVGVVLHHGSVGATSSSWFQHRYGNADGAACHFPFIFEGRSYCCLQHLTVASDGLPWCSTTANYDTDERFGFCPSEKSTPG

SEQ ID NO: 1022776 - protein, 108 aa, Homo sapiens
GVSWKLLQVKRARKELQSKCGLFPFFAPFHYPSSVFTLSPGLRVEPANFEEEVAKWEKRGVGYGVKCMLCICIFNFLISTFSPTLSAAANAILPVLRRLVHLRGSLSG

SEQ ID NO: 1022777 - protein, 74 aa, Homo sapiens
MLISIKSSSPTIYFIIFLTGIVGNGMVILVMGYQKKLRSMTDKDRLPFQLPTPFCHRLLFWAVDAVANWYFGTP

SEQ ID NO: 1022778 - protein, 35 aa, Homo sapiens
MSWDTRHRVPHETQKHYAHIHTHPSMAHSLCHTRP

SEQ ID NO: 1022779 - protein, 214 aa, Homo sapiens
MTLEISSQNNRSFTQAGCAHRDVLIQHRSCEFYPLVGDGRVTQGARDASSKKDQRQFYIRLLGIYVGWVMDSRRTHGPSYCFHQLLAPQKRTPTVGSYACTPQSLPKFQHPSHELLKENGFTQHVYHKYRRRCLNERKRLGIGQSQEMNTLFRFWSFFLRDHFNPKMYEEFPACWLWTDAKTGYRYGLECLSSILPLWPGKRSSGWNIRIFTEK

SEQ ID NO: 1022780 - protein, 212 aa, Homo sapiens
MHTLYRVCFIQKIEGRAIRLELQGPRGSPNARSQPSKISVCQTCLSEDTTEETLKESFDGSVRARIVTDRDNWVLQRALAFVDFNSEEDAKAAKEAMDTTVNIDGQIQVTLALAPRTLNGVNRWPSEGIVGGGQPGGFGGRRLVVEEAEEDLLAEAGGGSGGRGRLPRRQRKEDRAPQDHKAQEDDTRIASVPLLSHFPLCTERDSGSLPVT

SEQ ID NO: 1022781 - protein, 206 aa, Homo sapiens
MNEHGQIEGRAIRLELQGPRGSPNARSQPSKISVCQTCLSEDTTEETLKESFDGSVRARIVTDRDNWVLQRALAFVDFNSEEDAKAAKEAMDTTVNIDGQIQVTLALAPRTLNGVNRWPSEGIVVEASQAALRGRRLVVEEAEEDLLAEAGGGSGGRGRLPRRQRKEDRAPQDHKAQEDDTRIASVPLLSHFPLCTERDSGSLPVT

SEQ ID NO: 1022782 - protein, 253 aa, Homo sapiens
MQPEETLQEVFEKATFITVPQNQNGKSKGYAFIEVASFEDAKECFKFLSLAREIEGRAIRLELQGPRGSPNARSQPSKISVCQTCLSEDTTEETLKESFDGSVRARIVTDRDNWVLQRALAFVDFNSEEDAKAAKEAMDTTVNIDGQIQVTLALAPRTLNGVNRWPSEGIVGGGQPGGFGGRRLVVEEAEEDLVAEAGGGSGGRGRLPRRQRKEDRAPQDHKAQEDDTRIASVPLLSHFPLCTERDSGSLPVT

SEQ ID NO: 1022783 - protein, 99 aa, Homo sapiens
MLLQKYPETDCMAAGGNGNPQVNPWLVRDSSSVVKDSREITLMVRRTRLYHLPRSHSVAKRCPQQGSLRLCVNTESRESCVNPNERSEYKVADQSETRD

SEQ ID NO: 1022784 - protein, 185 aa, Homo sapiens
MMLHDHVILIEERGLSILPERLSPQACELTSVPCQVIRCRLYERTLWSPVGNGQGFIVDWDDGYKAKRIFISDGATILIDFLMLSILRQSTVWVDIARESQDAEVGDWRRTSVTVGGRARSCTEARVESPYVAGMGVTTPQDRSISSISRHRERTLAGRVNIRFKRSIGLCNPLKESAWIYTSWA

SEQ ID NO: 1022785 - protein, 180 aa, Homo sapiens
IKENPMRELRIRNQLCLNICVGESGRQTEREQPQVVGKQLIRADPCCFLKTRYTVRLLMASGDNEKIAVPCTVRGAKAEEILEKGRKVRASMSEEANNFSDTGNFGFGIQEHIDLGIKYDPSIGIYGLDFYGGAGYGQDFSSAAQPEAQDQAALGPNTRISKEEAMRLVPGRSITSVILP

SEQ ID NO: 1022786 - protein, 1032 aa, Homo sapiens
MNCYLDARNAHNCCMVCGSLDNNPDTVNLMFSEYPDGSVCADYTADHRHQGYTGLLHGGMTSTLLDAAMTHCLFMQGVQALTAELTVRFISPVCTGDKLMVCARLLGQRRGVYQLEAWLAKGQQKVARATAKFIVPSQDIALAHGYVWQTPGVTGYYKNMNACFAQTGKNNGISYIPLKQCEEVVMSKQIIDIGIPESSRVEIADGLSRLLADTYTLYIKTHYYHWNVTGPMFNSLHLMFENQYNELATAVDDIAERIRSLGCFAPGTYHEFSRLTAVNEDKDIPAAKNMIENLVQGQETVVKTARSLFPVVNNANDEATADLLTQRIQLHEKTAWMLRSLLEECKPVAAEKTVCQPQAIAVSAVTIRAAVAVFSDRNSIKTDEINKLNSERVSDKYSPDRHYRWVYPDHCRFPVIISRYRPGSSQPDRVNAAMIKRFAWKAGSHYSCYGFLYLCLPAGSRDHTRYLKRHDTVILNTVIYHFTCPSGLDKLQAAHYTQLLRQGRLSDTDCSFQLGHIRFPMANWHINSNRSLLASPRKTSAAPRAAFFISVCRFVSSFMGIAGFSHSVFLYNVIYYTDGAIILPPCSPGLQRPAGLGNKLYLADILPRVNREDVMKIVIVGGVAGGASAAARARRLSEDVSIVVFERGSDVSFANCGLPYHIGGKIPLRQSLILKTPEDFKSRFNIDVRTCHEVTSVDPVNKTVTVKNLTSGEIHTEVWDRLLLSTGAAPVVPPLPGLQQEGVFTLRNLTDMDAILAWIEQHNVAHTTLVGGGFIGLEVMEALSERGIRVTLLEMEEQVMAPVDPEMASALHQEIRNHGVDLRLRTALTEVLRTETGFRVALSDGGFVQTDMVILAIGVKPENSLATVAGLEVGKRGGISVNACMQTSIPDIYAVGDAVETPDLVFQEPANIPLAGPANRQGRIAADNMLDHHSLYHGSQGTSICKVFSLSIGSVGANEKQLKAHGTRYEKVYVHAADHAGYYPGATMISLKLLFSPDTGKILGAQASGKKGVDKRIDVLSVAQRAGLTVND

SEQ ID NO: 1022787 - protein, 125 aa, Homo sapiens
TLRSCGSGHIKLRQRLYIQPHLSGTGEMTGEETQASMGTGVTVDTGVGCLSTSSHYANRDADTFRCLCRKRCQRLLKSQRGGVKKSCISDPHKTAVSGFSSCERHIRALGTVAGRSLRVAPFFST

SEQ ID NO: 1022788 - protein, 34 aa, Homo sapiens
MDGILSHSFLVGLYTSTSAESSLTKYMSPFRVAA

SEQ ID NO: 1022789 - protein, 117 aa, Homo sapiens
MRLSMHSRPDNILTLNKSSIIENGKNYLEQRAVGEFAKVGSRFGPVAENQFWRTASLLVMEYLHNALEHDMSIYVVEKPQCPVLNSCDHCAIAFYSNTGIKVQSMIEWKTTIKETST

SEQ ID NO: 1022790 - protein, 72 aa, Homo sapiens
NLNEEPQRFLGHFRVMPDLINLAGETGIIENGKNYLEQRAVGEFAKVGSRFVTCSREPILENSLTSCDGILT

SEQ ID NO: 1022791 - protein, 303 aa, Homo sapiens
PTRTPTRRGRVGRPTRSGEKPRDRPCAPGCCARRRLACPEARASGSACTSWDPGGAPCLVPASHGAALVARTCHDATVRAGAARPLVNPEGVPTPSWRSQAKVTTLTREGSTKMRRIRWRRVGSIETNLLLAQWCASKRLLPLVYAPRFLSGVLDAFGARDNRPRVNEISLYREHSELDMRHQTQYKTKPGREAAALGVEESILRPNSRWGGDPPKGVRPRGEHTLQGSLCVAVRTDQFRVRRTKRRDPNTQEKGLPQKAPQRGGRPCFTHNLVTAWVLNRVGLRPKRGGNIRLGAWHLRQNG

SEQ ID NO: 1022792 - protein, 73 aa, Homo sapiens
THAYAHASRTRGSTHAFRTHASADALGRGASCASTDSCGSNQHSGPGIVELETRLCTLLNSTQCRVSVDKVSI

SEQ ID NO: 1022793 - protein, 394 aa, Homo sapiens
RRWRAVMAAGDGDVKLGTLGSGSESSNDGGSESPGDAGAAAEGGGWAAAALALLTGGGEMLLNVAAGGSGAAGGLPACAPGGPGLTGLSTACLGPPELDARKCAGQCCLAGVLDDACDLCVRQGPKGPVLLTTRSLCCLHQALCATPGGPFRGEQSFKEWEPGPLNLAWVAREQAKWETQGNAPSPRKATTRSTGRGAALKDSKRRQVPHGPLGLVPNQFHHGCGGSNEFPPSGTSPYEFRSFYGGSLGTMTDPHRALQPLLVFPKPVDPRSLPLETAGSRKETWPKVPRPSWSMAPFEIPLGEGQRKQIFAMGVGPSFRFAPSEQQGNLPKEPEGFPAFLSLTPRGRDSLRPEARFPGPRFLPRYAFLNRDASNSKSAFACYTHEKNGLAVEP

SEQ ID NO: 1022794 - protein, 227 aa, Homo sapiens
RRWRAVMAAGDGDVKLGTLGSGSESSNDGGSESPGDAGAAAEGGGWAAAALALLTGGGEMLLNVAAGGSGAAGGLPGCGLRWVAAGSGGRGLVAGEESPATSLPRMKKRDFSLEQLRQYDGSRNPRILLAVNGKVFDVTKGSKFYGPAGPYGIFAGRDASRRTWATFCLDKDALRDEYDDLSDLNAVQMESVREWEMQFKEKYDYVGRLLKTKRRTIRIYQSEREST

SEQ ID NO: 1022795 - protein, 121 aa, Homo sapiens
KAKELNMMHLAGKTGQAKALARLAFIRKREAARKKEEERKEKTVPHFQENKRNSPISNCNPWEKMPGTWAALPGHLLYLAHPVTWRRCNSPSWPGAPHAWGLLFILEQKLFGGWGGGLGEG

SEQ ID NO: 1022796 - protein, 121 aa, Homo sapiens; identical to SEQ ID NO: 1022795

SEQ ID NO: 1022797 - protein, 363 aa, Homo sapiens
SRLPGLKGGGGWGQFIQKVALRKLGGQPLGVGLALLRGAFTEGLVGPRIRIVDLVPALASFERVPTSSGRGPSSRVCAFGCAPEVSNSVPGFQLASLPANKCATEREFGRSHVGRVETGVASTKDISGERVDRRLLSVACAPTRTQGPAGRRRPCDSGGAHRCGAGQRDVPEGALAAQRACGPTCPNRVRGTVWGHPVVEKKHTRGVWAKTGATTGCDKGDQSVGCGGGPREGAGANTTGESTGRGARRHHCGDTYKGDTGGGRLRRRKTKGPGTQKIPSGWRVETHHEGWTSTNANGGQAREWGRAHRTTRGCNALWARDTKGGKPPRGGDKSTTMRSLGGRPSPNDPGKSPGKTREGENST

SEQ ID NO: 1022798 - protein, 308 aa, Homo sapiens
SRLPGLKGGGGWGQFIQKGGSEAKVHPVAGGLLQGKGDGKRPVRLGGSVKGGRKSPRGGSHSSNAERESFPVAQSPELTTQAGPGAQAEACTALRVASWAARGLPKRGRNPRNAWGAHRASLPSPMGRGLENTGQRTAQLQGLTPGPRESPDPGSGSLPDGASLQWSPQSSAGAFSKLAWVAPRSNMSTRQGLSGKKGPEKSGVHWRREPGATTVWEGGAGPLMAQGKSPGRTAQHLGHMWAPRMPKAPQGGPAPAERGAVQNLVGKTPDEYVGAQQNATPQAGVPQYTTPPAHLLTNEIQSHRATRL

SEQ ID NO: 1022799 - protein, 69 aa, Homo sapiens
MREPTSMSSGRIGKMKATPMAPKQAMKQYMQKLISFEHHEIFSYPEIHFFESKAKKHQGRPNNSSYDDD

SEQ ID NO: 1022800 - protein, 118 aa, Homo sapiens
MGGYCIEFPAGLIDDGETPEAAALRELEEETGYQGDIAECSPAVCMDPGLSNCTIHIVTVTLTEMIRNARPKPKPGDGEFVEVISLPQNDLLQRLDALVAEEHLPVDPTGSIPNASST

SEQ ID NO: 1022801 - protein, 88 aa, Homo sapiens
MVLNLIVYPSVVLWNVFPERCLSGGAVSRYATPEGWMEPKGRCRSAWCFSELGAGEATYTAASRGRSTTNKNHDRRRLSSYNACSVYT

SEQ ID NO: 1022802 - protein, 112 aa, Homo sapiens
MTVGKSSKMLRALLTIGMRCILRRMGRDLQIVQPLRALDKQYDFDPLVICDEFMNRSRPKNCESKQSVKKSGFKGLSVAALRRNLVIHDCRTGQPPKILALLGYHLLGAAGG

SEQ ID NO: 1022803 - protein, 38 aa, Homo sapiens [sequence omitted]

SEQ ID NO: 1022804 - protein, 311 aa, Homo sapiens
GELSSGEPAAAAVMARVAWGLLWLLLGSAGAQYEKYSFRGFPARGPDCLLASGVTGTLCDACTRERDAWPLMMLLLLPWMGWRCWAAPGSCCGQARPSCHCQLQRPRGPAVQCPDPRTAVLRKNDVGLLSCGSSGRCPGAEPGCLRAAAKPDCCPPFQSALPDRGQLLRDFQSRLPYQYLHYALFKANRLEKAVAAGYTFLQRNPEVTKLNRQVFSNYYQGDAWTSPTRSLNGTLEAQPYEGRVPPGCKASYKQRGSSRKQHWGHWPGLSEYLEGLAGPAGLMGLSRGTQGFTGAKIFWSPRGGGVAIAPC

SEQ ID NO: 1022805 - protein, 106 aa, Homo sapiens
WDVVSVVAIEEVKLGVLCEVLSVVVITEVKLRGLCEVDSVVVIKEVKLGGLCEGVSVVAIEEVKLGGLCELVSVVEIEKVKAGGLSEVVSVVVINEVKLGVLLRCK

SEQ ID NO: 1022806 - protein, 119 aa, Homo sapiens
PTVKAWTVWDGVAISPAELSVSLWAQGCSDSGSQVLVSALRRRTPPPVCSRADRSSSKVSMAWLQFALTAQELLNGGLKALDPTIFATCNCSREVKVLFARKGLLLGFSNLSILGLYTE

SEQ ID NO: 1022807 - protein, 147 aa, Homo sapiens
LSGGPHIFNVFTLYLRNVSGALNTKSTQIRFPSGFSVHLCCFQAISCWDYATYNGGIGALVRIFLWAFVLLGRVVSSCFQLNSWVKKFWFHAYSGARNKTNNKFRVLLSHSNRCSSVVPSGQGAGGAHFRNAPPMQRQAHFLAFHNS

SEQ ID NO: 1022808 - protein, 47 aa, Homo sapiens
MKVKPMPSPAVTLRSVDSIHSVRKPGYKPGVFRRTTALSDSDGREVD

SEQ ID NO: 1022809 - protein, 149 aa, Homo sapiens
RQSLAAGERNRLDFGAASDGHWAYTLYSLLQEPLFCVQTPSQLLAPKERFLKKHLAVETRTNGTCGALVADRSRGHYNLTSQIETFNPTLVQNPAGLEEGGHFDYIQVQTQIVANCVVNFCTYNLGVELLRWEEKVGGPPGKKGTICPG

SEQ ID NO: 1022810 - protein, 271 aa, Homo sapiens
MGLLNTYFTGDLSFGPGRDRYTVLTVEKRLRWRIKEEKTGKHQIRGEKKNVDSKRPATHVVAGDKVPSGGSQEQKRRATWQWKRWATKGHTPQGAHKQAQGRPGEQLGLRPKSLLIIRAIVNRLEGLSYEHRHLPGAGRNHFVQAMRCEGSTRRGYHDADGILVMMTGASRQNPRSAGKRVIGIRGPVGRGQKCHVGASNHSGPHAPGNDKALHVTQEQVREQQGTLGATLSNPGLENLVPGRTGDGGHVKRGRNPGAVYKGPGGGEKNRD

SEQ ID NO: 1022811 - protein, 43 aa, Homo sapiens
SGWSVYGFRWRDAGPRTREKLPRCPHQSRRNARRTGPAQYRPE

SEQ ID NO: 1022812 - protein, 284 aa, Homo sapiens
GARPSDSCSTVMFLRLSRDLDGLFQLPEALEVARVDVSSKVEVVWADNSKTIILRPASLYNIEPDDLRRSDYDFALEGSTTRGILGCNGNDDSDRVGDGSMELVDGRAPQRIEEPPIPPLEQAVEALRTTGVVIRGTRHDSKHDVQRRLAAQMDIDPMETRLMETGWQRTGQPNELARVVNRGHHQIPRHQPLSNIDYVEPAADGARATSPTVGSLSKPNSGEDCLLACTSRSSLDKPQEDWTNGRAIGTSTGRRSAAVPDDPSVGSDSDGDGSTRIAVLPGKP

SEQ ID NO: 1022813 - protein, 190 aa, Homo sapiens
GLRQWSRGCSERASGVSRALLQSAPGTPATVGISVGELWPFARCCSHSYVRSLRGLSVSTHLLCFTIYINESQYEQKQEEIKENYTRIVLSPRENSEDDSAFCIWISCWKEKMSCPQGLVPKGTIGIDPLNYLQISSPGVIVPESSGTLNTLGGSHPRSHLIFMNSKKIHPSQYGKDVAEKREKGLYEAL

SEQ ID NO: 1022814 - protein, 236 aa, Homo sapiens
GLRQWSRGCSERASGVSRALLQSAPGTPATVGISVGELWPFARCCSHSYVRSLRGLSVSTQEVGKRRQEVGTQGRKGTKVSKETRFPSGQPLKPGPTCDSCRARGLVFCASPSTYMNPSMKQKQEEIKENYTRIVLSPRENSEDDSAFCIWISCWKEKMSCPQGLVPKGTIGSDPLNYLQISSPGVIVPESSGTLNTLGGSHPRSHLIFMNSKKIHPLSNGKDVAEKREKGLYEAL

SEQ ID NO: 1022815 - protein, 86 aa, Homo sapiens
RVMGGLLALDAVFQIILTVVIDPVKYTQTFTLHANRAVTYIYNWAYGYGWAATIILIGCAFFFCCSPTTKMTFVGNAKPRYFYTSA

SEQ ID NO: 1022816 - protein, 90 aa, Homo sapiens
YWEKFEDENFILTAYRGPGHLDPMGKLLVSNTNGSQFIICPAKTEWLDGKHVVSGKVIEGMNIVEAMERFVSRNGKSSKKITIADCGQLE

SEQ ID NO: 1022817 - protein, 335 aa, Homo sapiens
GLSTGYFIGWSLTRCGSLRPLPLLSEGLYCGNVVREGQNSVCVVWVDVSVVAGNLPSQVKGSLFFPSVVLSCGVEAVVWSPGGFYTLLFGVPMCVAPCGVVPPTLCVCCVYAKDSRVCVIYRGTNVSLFDNKSVVLVVREGTKCPRPPRRFKECVERRKWRVFAVYVKSLREERHPTRGVSSSVCKPPRVLPPLEEQWGHPLPRVDAHRDDIQTQTPLCLFEMCSYTLPMIIFVRTTGFLSLYYDNARDEGSYKGFSTSLKLLGNRVCVGAPKEWGKKHKRAKQRGLTNVVHQMSGRRCLFSPAVIYHRTTSEGGLILEHLFWRPQTERTPFVWT

SEQ ID NO: 1022818 - protein, 47 aa, Homo sapiens
MIPFTAVAIGRHEVPADPRGAHLYLTHYEEAERRGGGGAPLMALASG

SEQ ID NO: 1022819 - protein, 60 aa, Homo sapiens
NLATLDSGLNKKFFSVCISATSSSGNDFRSFFFLCFFGKIITSASAMLPCTAFVPPGPQP

SEQ ID NO: 1022820 - protein, 242 aa, Homo sapiens
TRQACAGNMAAPGERGRFHGGNLFFLPGGARSEMMDDLATDAAGPGRGAEMTLAASDLDSQPRLPEPPILLVAEDASRRRPVPGPCFDFKERWIAEARRRPGHQSLGEDFARLDRRGTWDLHNSMGLSSRILAVLHNPDLPNPRNSSKDIGPKFQTLCSKVLTPCEECAEDPKKKGCAGNHPDTGSPGMLHTVAGHVHNEVNPHSWAERDFECSKSGERGAYGWKDAPVSGGGQHSFPGEQQ

SEQ ID NO: 1022821 - protein, 111 aa, Homo sapiens
RQQVSDPQAQPCDVVLYSHVSGPGRDLGMEPTEPRAFAAADFRPTFPSGGYYTGNCAGEDFAIVCFWILDVSERVSQFHTAEIAPKCYKFYQTKNSPFGMPAGSQWRLSYA

SEQ ID NO: 1022822 - protein, 289 aa, Homo sapiens
AVLRGAPFRLTAPGGGRQPWLLAGSGGGCGGAMASGGGGGNTGAGGWAVGLGLMPGPGSGSEAYGSDVTAADVTADGVTAATVLTAVGRLATTVCGCALLRLGWQVLAAAQAVAGVGDTPLRQAWVTAAALKRLSSGMLSYIVPSEPFFLLSCLTFWPSFLRGSLAASLISLTFQQSFPRGAITLTIHLQELLQYKTAESSSASAFESALGCAVLAVLGHYVPGIMISYIVMMSLLLWPWGVYHELIPEDVHSAWSPWFIALGLRLKAESMPASTTDQGTVSGKWPPRL

SEQ ID NO: 1022823 - protein, 321 aa, Homo sapiens
AVLRGAPFRLTAPGGGRQPWLLAGSGGGCGGAMASGGGGGNTGAGGWAVGLGLMPGPGSGSEAYGSDVTAADVTADGVTAATVLTAVGRLATTVCGCALLRLGWQVLAAAQAVAGVGDTPLRQAWVTAAALKRLSSGMLSYIVPSEPFFLLSCLTFWPSFLRGSLAASLISLTFQQSFPRGAITLTAEGCGVRRPGRHLLSVPEFVPDTWLRRLVTFPIHLQELLQYKTAESSSASAFESALGCAVLAVLGHYVPGIMISDIVMMSLLLWPWGVYHELIPEDVHSAWSPWFIALGLRLKAESMPASTTDQGTVSGKWPPRL

SEQ ID NO: 1022824 - protein, 35 aa, Homo sapiens
QCVCFIFLQYGLIGNVVLMNVRYNFPFETPAILRR

SEQ ID NO: 1022825 - protein, 334 aa, Homo sapiens
EKNEIAPHQLERQNKEAWVKLHEMEGTVHVQVQGPPSPSSKAKIAQLEEQLEDEDRRMRQADCMKVRRTEKKLQDVLLQVDDERRNAEQYKDQADKASTRLKQLKRQLEEAEEEAQTGQRHTRQELQRELEDATETPDAMNREVSSLKNKLRTLGTIDVMSCPGEWTGKARGWLRRKQVDRKEAWGMRPTHDDLNPLSPEDLRWMAQNDCTAPETQEPSRKEHTNPGRPMRTDRENSPTQGATNTKNQEQEARHGRNNRETKTRVRPHATRTPPRGPGETTQTQHRTGERENTTRGNTWEQSKREKRRKTEKKRRDTAERKKKENTRDKQHREN

SEQ ID NO: 1022826 - protein, 290 aa, Homo sapiens
RWVPERSPCPEAAAPPPGPAGLSDNFTKAPSWECELPLPPPREDCCGTHGVCCAGLAVSVAVSPMSPQDGAGGSAFSFHGGCLRAPSPPSRRDAGLQVSLGAAETRSVATWAHDTSMPACCLPCLPRMCWVAVPWLSAGGAVAPPEPAEPVRDCDAGTEKGIDCGDGILAAAMEVEVLGMAIQKHLERQIEEHGRQGAPEHAPPPVPGPGGTGSVRTWPPDWCLRGVSLACYARCCIVCAGGVLLGGGTQGDVICPHLYAEFLTSQGPFLITGPRKGPSGATGLEGGVQH

SEQ ID NO: 1022827 - protein, 95 aa, Homo sapiens
RLQALAPPRGPPLSCCSEGSKYPDNRSHSPAPCSPLAAGCGERKRVREKKPKANPLSTSPLRRPSLGSSEPSGFSSERPLVSLPISILGALVPPV

SEQ ID NO: 1022828 - protein, 270 aa, Homo sapiens
AGSSPLLLAAGRAGRLLQRPRWLRRPERSRWQAAAGDRQQQQQQQQQPLASCPAALAERSPTSRVTPAVLRRHDLTSDGAPSRPPAPRQTPSGGPPDSPSAFRRQPEPQPERHPGATATATSPPGIDLRHSPGFRTPAASFLWATGSLCARKSWKVGNAPCPKIKLGCAQPAPAAALQRPAEPTTAWAARAQEDRDAPWEVRQVTKVGRFHVARAGFELRSNSDASWVIPKTLPGGPSKHVEQGPRFPTGGDSANEHSACPLEVVLLPDR

SEQ ID NO: 1022829 - protein, 308 aa, Homo sapiens
FLLGGSRKRVLVRVERATVYSVEQDNDLELADAYYLGGVPPDQLPPSLRVALPHSEAVRSRGVRFKGIERPWDKYVDHRSGVNERTGREPPVLAPHGTCVVVARHALFQLGHVSFPSPGVVSENVDTAPLDDTYYIRTYGRSHSDVSGTDARGSYIPVTSPGWAYVQVSPASRDRVSHTVSLRTECEILNAGFADGAPPISVAFYSNATGVWLYVDDQLQQMKPHRGPPPELQPQLRGPRGSSWELAESGTIYNFSGCISNVFVQRLLGPQRVLICAELGASCEPVCPPGANPAGLGGAAGAPRGAGL

SEQ ID NO: 1022830 - protein, 35 aa, Homo sapiens
TSSRPEYKVLFCRPQSSRLSRLSVKKRIGSAISSD

SEQ ID NO: 1022831 - protein, 402 aa, Homo sapiens
AWPALRTLSSLRAAPRECPSMPWVMECLPAGACCLLLRTAGTLRTLENGWLLAGAWSLDPAQTWAPAWPEPLGMSGGRKGPDEAEESQYDSGIESLRSLLLPTRVHLGSSLRALRTAAPSPAPILRDTVKEPQEKEDADGERADSTYGSSSLTYTLSLLGGPEAEDPAPRLPLPHVGALSPQQLEALTYISEDGDTLVHLAVIHEAPAVLLCCLALLHQEVLDIQNNLYQTELHLAVHLDQTGAVRALVLKGASRALQDRHKKKLSCGLPAPLACARCLLEGRPEPGRGTSHSLDLQLQNWQGLACLHIATLQKNQPLMELLLRNGADIDVQEGTSCKTALHLAVETQERGLVQFLLQAGAQVDARMLNGCTPCTWQLAGVSWLITLCSDSCCGCGDEPGLT

SEQ ID NO: 1022832 - protein, 172 aa, Homo sapiens
IRDRGVCGRRLIRIIASSFSVFLFNTENKLLLQQRSDAKITFPGCFTNTCGSHPLSNPAELEESDALGVRRAAQRRLKAELGIPLEEVPPEEINYLTRIHYKAQSDGIWGEHDIDYIWWVRKNVTLNPDPNEIKSYVLCVKGRTKRTSEKKQPGGEIKITPWFENYGSDFSL

SEQ ID NO: 1022833 - protein, 123 aa, Homo sapiens
MYVIVVYDVEQERVGKVCQLLRRYLRWVQNSAFEGELTESQLERLKEDLKAIIDSEKDSAYFYLLRDAKWMTEGDNRAKQGILLTIFVIAPSKTLASSGINNEIRWLSFVIALSRGLSCSLSF

SEQ ID NO: 1022834 - protein, 358 aa, Homo sapiens
GGGCVRAAAAEQRSRGAAAGTRHPPPGAGSVLSSTATMTANGTARGGCRSSSASSTAGNKYLTAEAFGFKVNASASSLKKKQIWTLEQPPDEAGSAAVCLRTTWAATWRRTRTANVTCEREVPGPDCRFLIVAHDDGRWSLQSEAHRRYFGGTEDRLSCFAQTVSPVREVELCDICDAPSGSTSTASPVKRYAHLSALAGDEIAVDLDVPWGVDSLITSAFQEQRLQRADRLSTVSAATKALGGGPEPAWYTAGVQTGRAFGMRGGLGRRDQGAQRGQGTRLARKRPLAGPKCAQYSSRGHNAGSSPGSAADTMRQGSKPEDMPDHVLSTADCVGPGATERVDWGATVQSYPSSAEKH

SEQ ID NO: 1022835 - protein, 171 aa, Homo sapiens
GGGCVRAAAAEQRSRGAAAGTRHPPPGAGSVLSSTATMTANGTARGGCRSSSASSTAGNKYLTAEAFGFKVNASASSLKKKQIWTLEQPPDEAGSAAVCLRTTWAATWRRTRTANVTCEREVPGPDCRFLIVAHDDGRWSLQSEAHRRYFGGTEDRLSCFAQTVYKKRSGE

SEQ ID NO: 1022836 - protein, 386 aa, Homo sapiens
IDFVWITIIKLVALAKSLRQRRAQASYAGPPPTVAELVEAHTNFGFQPDTAAAGWAQRSGALRASEAGALAHGAEEPRRPERMTSLRHRQDCWTLIESRQVTGDAIVTLSPCPPPGRTRDCTERAKTVCPRGLTVWCPLQRVGRVALQGQQLVSFNREASGNWSVYWPRALYESTVLVHGCRNKLYLTPGFLTLVPYLSLILVLNDPIGNTLIHGGRTTDHSQVTQSANHNPPRRRRTQRRGLRPIVAYTITLTHSSPQHLDTSLETATKRMDGHRRHVDTGATTTDRNSETTMATKHAATSLDVSASCANENHRGHDKNHSEQANKKNKEHQTTHATGRHSPTPRFARHHRNTRRRRTSTQRQARRTHTPAAHRGPPHATHRPTR

SEQ ID NO: 1022837 - protein, 217 aa, Homo sapiens
RLAPPDDLDLFPTPDPHYEKKYYFPVRELERSLRFDMKGDDVIVFLRIQKDGLATTFWPATFVQNRTASQVRVLTAGPGQEEVHAAYPAQAAAKNLSVFLPASPPVLDACWALHCRTWSRSSDKHDVARACVDRQRDSCLLLRHAPGSFYYIDACYETPVSRYLSELAACAERVPRWQDRRSHYCVMGARPTPEELCACYEGTDWSGCTLQEFMDCP

SEQ ID NO: 1022838 - protein, 143 aa, Homo sapiens
PARGEPQPGQLERIWGKEENGGSQPLSSFPPPPSLIGCASLEPNFSRSRLHLSPEGVGAPRHGAGGAATNPGVSISGPLGGGARTGSAPAASARPISLPLAASASLSPRPFLPSQQAASLLPPPPPRTRLPARHLPPVSHSCH

SEQ ID NO: 1022839 - protein, 133 aa, Homo sapiens
MYGGSVGSQPPPCGSSSHGPVPSSPSQEPPTKREYDQCRIQVRLPDGTSLTHDFLGPGNRLAACRGSICGAPPVGTELRWRAMDPCACLSGFPMTGLLKLTLERPLQEPGTRALAVLICWQEMSQLRGLCPIV

SEQ ID NO: 1022840 - protein, 304 aa, Homo sapiens
VRRRRTTLKTALRPLTFRAPEMAPRTGMSVASLGNEQRRGPRRAQGSELVAANQGLISDDSGLSSRMVFSWDQTGTKVDLMSTSTSPAAMLLRRLRRLSWGSTAVQLFILTVADPVLGGPPLLGPLGPPPGSLSPDFYTLTSICAIGIMNQMSQEFLQQSLEEEGGGVASTILRSFRSAKWRQMPIVWQGHPPAWLVITIITVDRQPGFHYVLQVVSQFHRLLQQCGPQCEGQQIFLCNVERSVRHFDAKWSSKYCPGGQIAMQGLRLIWADETFGSNWVATGPEQGQSRRTPWNYNQKARWYT

SEQ ID NO: 1022841 - protein, 329 aa, Homo sapiens
GEAPAHDLKTALRPLTFRAPEMGPPRDELASLGNDQKAGPSARAGDRAGRRQPGVWILRRVGIWRLGVFQVLDVLFSVRAEDHVERSVTRHDALQTCFQACPVHSVREGMLVDLSLLRGKQLADLSHLSIRNTVGERSQSHDAPPWTVIDRNVSNNIYSIHHCSSLWLLLRSHNWRRTRGCPARHKAWKRRVEAALHYFEELPSAKWRQMPIVWQGHPRAWLVITIITVDRQPGFHYVLQVVSQFHRLLQQCGPQCEGQQLFLCNVERSVSHFDAKWSSKYCPGGQIAMQGLRLIWADETFGATGWPQDPSKGKAGGHPGTITKKPDGT

SEQ ID NO: 1022842 - protein, 123 aa, Homo sapiens
IGGRVDPGSVIRVKGFLISYTATGSGICGKGFLISYTVPGSVICVKGFLISYTVPGSVIRVKGFLISYTVPGSVICVKRFLISYTVPGSVIRVKRFLISYTAQFLKCKRKTRVLKKESTRPRI

SEQ ID NO: 1022843 - protein, 200 aa, Homo sapiens
MRVEYKSRCQSYNRRPRVAELMGQGPVAKGLLPRSPPGSGVFNVSASFDLCLHAILQLVTRAFPDEIRVETGGGPRRLGYRADLLVDCAEGRFPLQAGAGIILKGLQPPVSPLTIGALWLGDFSASSSSNGHGASLNNAGLRGTEVVQVKAGTRGVRDVKLATGPHRVKLLNLQEGGGRDTQDAEDRPGIRARAAYKTRE

SEQ ID NO: 1022844 - protein, 97 aa, Homo sapiens
GLQKALFPLGPGLVRIVKKAAYWAWRERLRQKALLLVQRGPFRKSRVGLKKGLYSSVLEEGEPFQKKNTRPAQPSRATQAVVGGVAQVWSPPILSVK

SEQ ID NO: 1022845 - protein, 228 aa, Homo sapiens
GLQKALFPLGPGLVRIVKKAAYWAWRERLRQKALLLVQRGPFRKSRVGLKKGLYSSVLEEGEPFQKKNTRPAQPSRATQAVVGVCGSGVVSTHSFCEISLTLLLSIIGEGGVSSQREELSQREMWGAPGCGQRTPQGACERYPKRGAVGLKLFSPPRGPMWPELFSCGASRGGVYTPQLTFFSGVGFSWKCLRGKEETAAAHALVFALLQGDRLMAPRAFLPSANFAE

SEQ ID NO: 1022846 - protein, 136 aa, Homo sapiens
DDGGDLTNLIHQPSYPHGFCQAIRGISEGDHDWGSTSLYKMMANGILKVSAINVNDSVTKSKFDNLYGCRESLIDGIKRATDVMIAGKVAVVAGYGDVGKGMCPGPAGVFRSPAVIYHPRLSPINCNCRAANGACY

SEQ ID NO: 1022847 - protein, 215 aa, Homo sapiens
EDPPQKKKMKKENKIIVEAKLRATQEQEAKQKLEEDAEMKSVEDNRCECLLANFRGAFSMIETCREDLHHTFLEIMVDNKMDRLRSEEPKAGDQFSFQQQTSQGSHWVKPKHATNGNPTIKEQSKVTWEVTSTGAGGNKASHCKHNINQQAPTSNPSNTMAQSTKVDQHFNRHTQAQGSMKAAAAWVMVNRQQVTVCRAKNNEIVLSACMNMNEP

SEQ ID NO: 1022848 - protein, 102 aa, Homo sapiens [sequence omitted]

SEQ ID NO: 1022849 - protein, 56 aa, Homo sapiens
ASARRAPRPRPRPPALRLDRVDRPRVCDVVYSLALLRSTKKSDFVHVIIGEYTNRS

SEQ ID NO: 1022850 - protein, 251 aa, Homo sapiens
MDARDSTTCDEARKQGEMRSRDTRAISMEGTSAIAVDEELEKHGIVYQATHRKQLGRVYETWVITEENLRWLTLTKLFDDAFQGSDSTCESLVKDFYSKLGLQYRDSSSEDEIFPAYQTIIEIPDDTMTDCSSVIDFRCMLGRTHTSTTDQNVREGFWLGLNGNVPGSQNVQEKLLGMLFDSADDRPTDSGPKGNLDTPVRTHPQTADLDITQAISGSTEPKTGHQRNYCLTKRARNQLSHLDPGSTRADK

SEQ ID NO: 1022851 - protein, 36 aa, Homo sapiens
RIPNRLRNPSRRVGACVRALFSHLFDSPSPGCQPQS

SEQ ID NO: 1022852 - protein, 175 aa, Homo sapiens
KGPILPTHTLLSQPCPPGPCPPSTQELLHGNPGFPPKVAPSSRATARVSRMPTVGSLPSSIPTACPWNPSCESLGSWHGWTSSDSRQEDAEEKEESSIKRCTSTKLSHPKYHKHGKHSSSFRPPLPAVILTDTGRWTLPLKFSQIAALPIQLEDAHVVLGRNVAPVHPPPPYLPP

SEQ ID NO: 1022853 - protein, 293 aa, Homo sapiens
PPPAPAFPPERLGLIPSPANPFQTSSLGGTPPRQPASPPAPALPGFPSHGISSRSLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILGFLVNHDFTPLEILWDLLHLPGVSGILPQLFMGEQDRQRRRPSPATTCLAQGVSPHALSLQLWIWRYHFEGFFDLIAIVGRPGPDSPLLRFLLPSIITKVLKGKKLSMAGHNPGSFSFSLLGSSGRQRKAAEDEELIQG

SEQ ID NO: 1022854 - protein, 122 aa, Homo sapiens
SAPLIASRLHITITVITFIITITTITFITIVITITFITIITIISTLITIITTTTIITITFIITTIISHYHHHLHHLIITITFITIIHLITSTIIITIITITTIITIFTMTIMIITFIITIIF

SEQ ID NO: 1022855 - protein, 30 aa, Homo sapiens
MAGLRGAGLGRMWKGSELCPPSLKVFMSRV

SEQ ID NO: 1022856 - protein, 52 aa, Homo sapiens
MAVPNWLYLKWLHLNGCYLNGCYLNGCHLNGCYLNGCYLNGCYLKGHRARLR

SEQ ID NO: 1022857 - protein, 559 aa, Homo sapiens
TRLGSAAPFWVPRPKPLDSVCEWKGGHCYLSAAPAALCPRWIPADCGSFKSLSRVTLPHRSAPLAMLGCCGPGLTLAFGLLGLGAVCRGAGVLAVLGVTAAGAGCLWTCLCAWLPCACPVCCAVQPEFAPFVPCVVTPAVLGELGQCTVACLCGLGCMLNEPAELYCACATDPAAPCCVLLLGVWSMLADPELSPAVLTVLTRAAMCEFLLRSDSVHSCSTVPPNGRLPAAVASTAGNLAATATTVEPEGMDDHGFYLSKLRPGAHLTECLTTGEYKPVGPEYQHVMFEWASTARKGVELRNPGSNTEANLKGTGNGYHLYTVHVEMCVLFRRGLLNRSKQQSKETNTNNRHIKHQNRRVRTRAGQEREEARSEDKRRRDPHEEVEMRRERGESREEERGRRAPKVRQSGRERTAEANRRRRRRGKKEEKQETQEGAKPEKRATKEKGSQSSNERRRGEREAERRSKTRRSEGGEDRESRRGEEKRTRRDAETKRGQSKRDGRRRGKNEGRGAAAISQKRQSTTRKSRKEESRTGARDERRETEEDGARHERQRRNTNT

SEQ ID NO: 1022858 - protein, 321 aa, Homo sapiens
GGENGPALRSDLTARMRRGAPRSCGRPVVGAAERFRARTGTELVLLTCGPACHHPARAPVPMLPMVEEPWRRQPRRCLHDIGTGPQGLPLLLGLLLPPPAPQATQSPSPSPPRPTLARENEEDEDPTTETSGEQLGISDNGGLFVMDEDATLQLPFCESDPESTDYLSEEPAGPPTFSVPPSLSPPTQQYAKSLPVVPVGFKEKGHRSRSSDEENGPPSSPDLDRIASSMRALVLEAEDTQVFGGPATAAAYTSDFQKLKRKYVGGSARAASAPSTLRPAHSACSEAIGTGSVSIPRLSALQSRVFSQTAGERDCPFLVLF

SEQ ID NO: 1022859 - protein, 269 aa, Homo sapiens
QNILLLLKTLIPPVGAPFGHSMTLDLGGAELDAMGGCGGSRRRFSDSEGEETVPEPRLPLLDHQGAHWKNSGGLLAAGPFATNFSYVVMLSARPDILSPQEDIGKPEAMWTQAQRRSPHNSSSRFDLQPPVSYGCCAPWRTSLPHTRHQIVGLPPWPFHPAPYSPPGSSVQWRFCACEASVPGLPFSHFCGGPACCCGSSLASSSGLVGGHLPLPHCLLPQGRDLLVVLRDWGSWAAGGPAYLGLTQAGLSPQQTLLSMLGIPALLLAY

SEQ ID NO: 1022860 - protein, 330 aa, Homo sapiens
MPPKQGCKLVGGKHATGGRKPQRQSWAHAKKAWTYFSNVGKVCNSVLQETRPGPRWITRVTELELGYVMQQLGIANLAEPTRGNLCGHPPGSENAKLPRGIIKHFRVATLLPWSNTCWHDQPKGQQGDASFEQCQPRGSTGSHLASRLDQLPINQDPHGALEIPAVIPYSLEKRRLTRAREQVCRPGQIDPHGAMAHDAHTLALMATTMSRFRRPPATPKAHYPPRYEHSLPETGRSTRAPGSAYPKGFRPKTQPSRETKALRLSVRPHCGPHEPGDPTADHAPHQHAPPDTSNSDRPQQSTRKTPRAERSHPTDTQNTDHRAPHARTHT

SEQ ID NO: 1022861 - protein, 157 aa, Homo sapiens
MPTLTVATPCRVFCKYGFYEVFKVWYTQYVGEENTYLWAHQYIWLTLAVGEFFADIGLVLMESCLKVRIQTRQVMANTWRDAVPQGIRRRLKAYSKEVALSGEQVTYPRRRCLVGRREAGSGAKPRRKQSQQRALGRHTGGAGPRNGNGNKRGPARK

SEQ ID NO: 1022862 - protein, 146 aa, Homo sapiens
MPPESSQVPAALHSKTWGWMVPPSWFGTKTKVLSYEEAEVRKHFPVAQGHVSGTLGSTTKGVWHCLDHRNGSLELGKDLKAGDLVQPLPPGVWPEPVLVVLLCVWPCPGLQGVAAVKVFKIPVGSQMAETPGTLHSPQLWQESPQP

SEQ ID NO: 1022863 - protein, 101 aa, Homo sapiens
MITGIPHRNRMSMARILSILSVVSSYVLSGSVAWGIPKVRQSLSSFLCLEQFIKVDIEGHPLEQQALSVAAVYNDRPCVGIVASERTGVGKSLNVKRLHDQ

SEQ ID NO: 1022864 - protein, 39 aa, Homo sapiens
MAQSDTVHQHVGVHQVAVDLLQEYLELCIGVDIFIESLE

SEQ ID NO: 1022865 - protein, 86 aa, Homo sapiens
GLIDLQGAHPNGQTLGERPFPVSGTAPLGPTGAPAMGFPKEHSDLEGELKPEGPRMYKNGRPRSLVNIARSMPRRQAVSNIDARTL

SEQ ID NO: 1022866 - protein, 393 aa, Homo sapiens
GKPRHTGQIGGARKQGAFVHESLQRAQFTTAHPLLAAGQEGVCHISKPWSVEGRKKEVVHEVTEIHRREAENLPSEGAAVGEPPKREAETLCGEQVSGVHYPYIGLHIHKRDVALAEVDYTSLYAKIAVARGTKKMFPQGDSYTHLQTLCVFSIMWTPSLIADYPNLGASHVYHSETTSISPVRGTLVARGTRGPPVYSNLPPKRERSQCGDHVKRRDTTTGGGVVHITHTERPHHHVGEERGTSTENPTYWARNAPWWAQDPVAPHPNTGQDNTYTPRTLDSNTSRGVTNPRGVGPTSGTPTHQGPFNTHRPLGSSSPSKHYHGSPTIERTTRGPRVFPPPNSGERPPQISCTRKHLPRGQTTARHNAASDKEQDTTVRGNVLANTPLLGRR

SEQ ID NO: 1022867 - protein, 155 aa, Homo sapiens
CREPIYLPYTCTVIPRKGKRDARAVCHTSRLRYCARDGSTVAAAVGAGKRGTGPKKCPIDRAGRVADLTEQYNEQYGAVRTPYTMSYGDSLYYNNAYGALDAYYKRCVLTGPMRQWQLQLPPGIITQKQTLSQVPPVKNTCMAVTSPPTLSILHK

SEQ ID NO: 1022868 - protein, 298 aa, Homo sapiens
LVAVRALVRMVECMYIEKPCPGEATEQEIARQLFEPVCGRVLECDISYRITGFVHDEKTMTGELTDAEEQRRHVIAFTTRSVEDEPIKRWKPSERIRAKPSTKLHVGNISPTCTNKELRAKFEEYGPVIECDIVKDYAFVHMERAEDAVEAIRGLDNTEFQGKRMHVQCVTPSRLRYCARDGSPERLLSVRERGALVQRVSIDRAGRVADLTEQYNEQYGAVRTPYTMSYGDSLYYNNAYGALDAYYKRCVLTGPMRQWQLQLPPGIITQKQTLSQLPPVKNTCMAVTSPPTLSILHK

SEQ ID NO: 1022869 - protein, 82 aa, Homo sapiens
ADTDLQRLGSSAMAPSRKFFVGGNWKMNGRKQSLGELIGTLNAAKVPADTEVVCAPPSAYIDFARQKLDPKIAVAAQNLLTK

SEQ ID NO: 1022870 - protein, 198 aa, Homo sapiens
MVWGLTAEKRRSVVTPARVQFKTNPGVMHSSRPQEMAAVKEFPEKLLPPGLTSRMANQCSTPATWGGLSKAERGTILDLSRSSPCPHPSMTLVRFPHRPLGAGGNDLAGPSFLALSHLALICSRRQAAFLSISLEAGPQGSSIGGATRQTGERGTKPLTQLTQDLTHLAPLWAPNCDLMGLDPLGTTQAPCPKLILPK

SEQ ID NO: 1022871 - protein, 283 aa, Homo sapiens
ELQKSRIRINSLSAQLSQKQLAAKEAKLRDENARERTSRRLAEKEREMYFFLRMQQLDEYQELLDIKLALDMEIHAYRKLLEGEEGGYACPPALPRSAAVAVLPLTRSQTQGGGSVTKKRKLESTERPHAGFLTSHRIVTSEVAMCPLSTRSDEIVWHARQGYCYRVCVNEVTMMDQSMGKSGRSSCQNGDDPLLTYRFPPKFTLKAGQVVTIWAAGAGATHSPPTDLVWKAQNTWGCGNSLRTALINSTGEEVAMRKLVRSVTVVEDDEDEDGDDLLPITTT

SEQ ID NO: 1022872 - protein, 269 aa, Homo sapiens
ELQKSRIRINSLSAQLSQKQLAAKEAKLRDENARERTSRRLAEKEREMYFFLRMQQLDEYQELLDIKLALDMEIHAYRKLLEGEEERSTPVPQPYLAAQPWPCSPLTRSQTQGGGSVTKKRKTGVTLRDRSISQNARTSGRVAVEEVDEERVRCVNEVTMMDQSMGKSGRSSCQNGDDPLLTYRFPPKFTLKAGQVVTIWAAGAGATHSPPTDLVWKAQNTWGCGNSLRTALINSTGEEVAMRKLVRSVTVVEDDEDEDGDDLLPITTT

SEQ ID NO: 1022873 - protein, 175 aa, Homo sapiens
MVAMAVGPSGCLVPALGVRLLLAIVVHEAVSDFGAEIFIGGMQRVRHLLGQLALQLLVIFSGQLNVVKVGFRMAERVGVQEEGTILKPERLYAGDYFLKFVDEQVGRFPQVQALVRSDKPKLCRGLQNQVCPVVTDPVVNSFGDGQWGTWLKKLSILRMEHRQCEEFLSEKLERI

SEQ ID NO: 1022874 - protein, 253 aa, Homo sapiens
MACWRTEPVSGACAPPPPLKDESGRRGQEPTEARLNTKRPDIWESSAAGGRSVCPGDRYAQPYMQGIPKTDISETDRDKPTGEQREQRHHYHDEVTHKSRQEKQTQKEEDGEPPKETGQQMRGETQTKKGDNHTRGEGKHEINHTEKHEEESEKRQDRTPERDKRERTGEQNKERQEEGYDRDKMGKYKDTQYTRTHRHRQKDGEITYKRHTPEHQERRQQQKEKEKATKEREAKTENDVEKHNTENNRINTG

SEQ ID NO: 1022875 - protein, 305 aa, Homo sapiens
GRAARALGKGGKGAGSRQGGVRPPDPPRLPRLARNKGTEMIEMACGRTEPVSGACAPPLLLKDESGVSGGWPTGATCTNEACLCVELLLAGTELLVLGRCCAICGVPSRCGRSGKPLGPRAPPPVVPRLQQHRGGWPQAQSAGDGPACRIPLWADACSPGRGGGAAGEGGLGPELGSPCSSSTPAMAISPPDTWGAGGGQEEKYLLMYGGGDTRLPHIRDINAAPAALKSGTCDPAIHPPNIIAGARKILRLTITADFGNTGSYAIYTETYLKEDRPLRLNPHDSDTGGTIRVSDLNTRKYYSTT

SEQ ID NO: 1022876 - protein, 204 aa, Homo sapiens
LLHIHQHWCSINTDLFEYKFVNCRLINSTFLRNKEGCPLDVTGTGEGAYVVYLGSSWGTTGSASCANIGGLPCIMDKIGKASECLLASSVNVPGVLRVSLCLEGTVSRLCSRLLCLFGGVSDCILECAGRVSVELYPSEKMRPQFVELPECTCVSLADCAGDQDLHILRGESTKAAPILFASAALALGSSLALKLPETRGQVLQ

SEQ ID NO: 1022877 - protein, 213 aa, Homo sapiens
MRFATHNHCFSTIYFKSMKDSINTVLLVSPQSAFQATSIFAIDIISGYPLFVFKPVVQKNSPRALTQRKATPRFLFIRFFIRSLSLLHISIFSALFYFHFISLRRSSTLSPGWSEVVQSWLTATSNSRVQAILLAQPECWDYRRVPSLVETGFHHVGQDGLYLLTLSICLPQLPKVLSMTGVSHQTQHFSSPLFHLNFFHFLYTRHIGPVTVA

SEQ ID NO: 1022878 - protein, 35 aa, Homo sapiens
PPDESVIPEMSIHIPGSHLHYCSSGQQSVTLPELL

SEQ ID NO: 1022879 - protein, 62 aa, Homo sapiens
SRAGLMTFNLYEEWTQVQVCRIKTKNFKTVENMSEVPPQNYVNFSYLIKFLAKLAQTSTNSL

SEQ ID NO: 1022880 - protein, 326 aa, Homo sapiens
HASADPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLATPCMSSQVRCMVQFVGREAKYSGVLSSIGKIFKEEGLLGFFVGLIPHLLGRCGFLVGAVNCWATSSMLTWWMTAVSTPGGLGNDQNPGSQFSQALAIRSYTKFVMEDVSMLTYP

SEQ ID NO: 1022881 - protein, 97 aa, Homo sapiens
GEVPEAAEVVLVSVERSVGVLLPVGRGLKSFLRGTSLCEEMMSLALRSELVVDKTRRKTEEENCLRNRNPRNYKMLLNYCDTDKDEAIDYHELKGGK

SEQ ID NO: 1022882 - protein, 354 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKMLSLSSRGMPELRLGLNDKVLFENTGRGKANPVELEDVNVPPVCAAITLREMIRDHLLRSHPSGEFELMSYRLDSHVKTFDMDRVGDREAFPTAEIEYMIQRPNSQCKRRSTANNVEIQHSRAQVMPTHPKFKTDGGELKWVPENSEIVWSIKSF

SEQ ID NO: 1022883 - protein, 354 aa, Homo sapiens
MSASAVYVLDLKGKVLICRNYRGDVDMSEVEHFMPILMEKEEEGMLSPILAHGGVRFMWIKHNNLYLVATSKKNACVSLVFSFLYKVVQVFSEYFKELEEESIRDNFVIIYELLDELMDFGYPQTTDSKILQEYITQEGHKLETGAPRPPATVTNAVSWRSEGIKYRKNEVFLDVIESVNLLVSANGNVLRSEIVGSIKDAESFLSGMPELRLGLNDKVLFENTGRGKANPVELEDVNVPPVCAAITLREMIRDHLLRSHPSGEFELMSYRLDSHVKTFDMDRVGDREAFPTAEIEYMIQRPNSQCKRRSTANNVEIQHSRAQVMPTHPKFKTDGGELKWVPENSEIVWSIKSF

SEQ ID NO: 1022884 - protein, 77 aa, Homo sapiens
LTGTEMGDIGALKVEVTLSNCFLGNEKESKIGVWSSAVVDFCCLPLKTVTEKQPSFHLCNTVLLQGTYCPHNTTTNI

SEQ ID NO: 1022885 - protein, 71 aa, Homo sapiens
GGHVTEMRAGLRGLHCGGLGVLEAPLGALAGTCTKTVEVLQQAGVRRRRLPGTGKAHKGPLAPLQEEVGVT

SEQ ID NO: 1022886 - protein, 69 aa, Homo sapiens
TFFVSLAVPISLSIDCLDFDLLYPAIKGDTIQFYLGAKLLESQGKVTKWFNNSAAYLTMPTLDNIPFSL

SEQ ID NO: 1022887 - protein, 109 aa, Homo sapiens
RKLVKLRHCPLTTFYQNVGVQLMMDPQLEMLGMQALMDRYGHQAMAGMSMNHGAMGGGDMKGMDHGNMKGMEKGGMQGMDHGNMKGMAHGKMAGMDHGGAQGKAKAFDF

SEQ ID NO: 1022888 - protein, 62 aa, Homo sapiens
LWFTTIPPLYEILQQCDGKLDMLVASVGTGWHHHVCIARKLKEKCPGCRIIGVDPEGSILAE

SEQ ID NO: 1022889 - protein, 274 aa, Homo sapiens
ELEVVESRPSLGQKRYTWSMWFESVMNDTNGTWTADFCVIDTGELMVELLLVCRFPGWRTEVRAECWWSQWISPQLPGQDFHPGPGCPFLSFSASRCGGSHQRDGVGGAGSQATHVALDEEVVPLGTPRFDSVRDIFFSIPSQYCMVFIWSFMAGSTGVDARSIHHEVLLKGKAQRVVGHLRFLVIDCVGYILDKDGLSRLELAINILALGVGVFTHDPLVVQDILRKPGWGDPLAAVIIEVLGSPAAVPPRTASFRLRRSQTPGPQWWRKSSN

SEQ ID NO: 1022890 - protein, 84 aa, Homo sapiens
MSEMAELSELYEESSDLQMDVMPGEGDLPQMEVGSGSRELSLRPSRSGAQQARGGRPNGGGGGLANGVRHEGKLEPSIGQRSGA

SEQ ID NO: 1022891 - protein, 403 aa, Homo sapiens
MSEMAELSELYEESSDLQMDVMPGEGDLPQMEVGSGSRELSLRPSRSGAQQARGGRPNGGGGGPANGWRQQGNTEPCITGPTLAEPAQARWQGAALRAAQDEVLMEFDAWEDDYRLSRRSEHAQWLPATEYQGRSVKKPTRCSENTENSPGWRVSDAIMRRTQTDQISFHRRAFITDGCQLVCPKNSDVTDDLYDSKSTEMAVTTSEGTYSTEGPKCTGYLSGDHPNKNGPLCTHQEPPTTQYEQQEVEPHKQATSSGHRCDNTHANTTKATRKPHNETHERSNTRHYPDTASKERKNEENEKKERRRQQPHTEDERDKQSDKNGEKQKQGRSTKTKRDNDDRQKAERREEDTDKQRARRHKKKTNEKITSNERDCTTQRETTTEPDPPKAYDTTRDQIQEKK

SEQ ID NO: 1022892 - protein, 162 aa, Homo sapiens
RQPELGQPWSWTDPAIITGIPASSGNSLDSLQDDNPSTLAKIPSGPHRDETAQRCSITRSSHSAPFSTQIPLHRASVESLPSSFKPFQLPSPQTPGLSDGFRPPDKTPTDLLTEFNDWTAIMAKEEQPLEKMQDLSHSVVSLYSPPTTSSLLISYVREESST

SEQ ID NO: 1022893 - protein, 41 aa, Homo sapiens
AWFRVPCTKCPAKTKKPVPATEQELPQPQAETGVLEQNFDS

SEQ ID NO: 1022894 - protein, 177 aa, Homo sapiens
GSQLSAQGPVFLHNVYCSGNPVRSSGMDGGSLYTPKCILGRVKAYTNFDAERDCFEHLNTAIKTKGVDEVTICEHFDQLAGNAQSTRTIAIRTYQRTDQNRNVASDTERQAFIWPPGDGDLLGLLKTPAQYDASELKASMKGLGTDEDSLIEIICSRTKQGAAGKFNTSLQGNMYQN

SEQ ID NO: 1022895 - protein, 450 aa, Homo sapiens
MSEGFSNCSSRRVSKHLKSAVFNVVRQTCHFALRRIVLQSRKDTTGKLVYCTLNKHMSHPYNTQNEQKAIDTITDEQKEDESHENVGDKKGKIVDAEIQEHQPSVLLELGAYCGYSAVRMARCCHQGEADHHRDQPRLCRTSPSGWCDFAGVKDKVPTLVVGASRNHPPAEDRSMMWTHWTWSSSTTGRTGTCRTRFSWRNVACCGRGQCYWHDNVICPGAPDFLAHVRGSSCFECTHYQSFLEYRGGVWTVLEKAILTKGPKAAEAEGPECPPRGPPSRALSTQPWVLKGARNVLPAEPSGRSGLCPKNAKQLSAEGPCAPDQCLTSSGTANTWIGTFFKDFHIIDFFYYTNWLRLISDLFYYYLQYSVVYTTYKLTTHSGPPKQDARTHAPTADVDNTTVVRRRRPWKRLLPTSQGGGRAPKGMSTGATARPQKPGDKQSRHPPKKRR

SEQ ID NO: 1022896 - protein, 320 aa, Homo sapiens
MSEGFSNCSSRRVSKHLKSAVFNVVRQTCHFALRRIVLQSRKDTTGKLVYCTLNKHMSHPYNTQNEQKAIDTITDEQKEDESHENVGDKKGKIVDAEIQEHQPSVLLELGAYCGYSAVRMARCCHQGEADHHRDQPRLCRTSPSGWCDFAGVKDKVPTLVVGASRNHPPAEDRSMMWTHWTWSSSTTGRTGTCRTRFSWRNVACCGRGQCYWHDNVICPGAPDFLAHVRGSSCFECTHYQSFLEYRGGVWTVLEKANSYQGPQGKLKLRALYCRASRDPPARGRLLIAMSVRIVQWLTTTLRRVPEPVLASVPGVVMSHT

SEQ ID NO: 1022897 - protein, 38 aa, Homo sapiens
IVVPFYLKAAVPKSLQLQLQAPVGTQFQLGVAFLSPSL

SEQ ID NO: 1022898 - protein, 105 aa, Homo sapiens
MKAELGVEDRSGGIVYACVWRPGSSRTPDRRPSMASNEILNSMYDTILLVKTRMYPTEGGGALEKRTCRERWSVCGDQKSPSWMDWMAELRWTYETTVAFTGWLR

SEQ ID NO: 1022899 - protein, 279 aa, Homo sapiens
SGVRRCLKMAAEEPQQQKQEPLGELTPGRCLTVVAYDEAIMALSRTEFSKRFAVEKPSVCQSGWKLPRSLYQGVLLKMTNFLSNQERIQGPSTKGNSEPFRKTQGLRGKLVSIGLRNSPHFGGQLLGLTGQRDVARRVPKGCVLPGSKGKTLLFPKGFNLEFTKLDGFPNKTTFHVTLIAAGVEKQTLCLPDLCWASFQIDPEELSRKTFGGSYTWRGWFHPSGANLGSRERPKVPSGQLPSEAWDRACQRSFLASRAVGPPCGMGDADPFQIHLCFGP

SEQ ID NO: 1022900 - protein, 429 aa, Homo sapiens
QPLINDGGRTWQMEEQEHLRKLEAERLRENAWKRMMDEKCSETQNTTVTQTDSELTGFAATTTPTDHGDLLSIQTTGHTTDTVDETRLSQDRRNSNGTPVTPDDATDGHERETVHGGDGHRRRRDHAQTSHLDLELQRGSVRTANRDSQQQEHEADSCGPGQHHTAATEQSSRNSYQKHELDLTQYADPESIMRNRDLTPPGQIDGRRRHSRRRAHPPRSNTTDNLATRTRRNNTHQPEGYTRANTKERIGNSMNQQEPHRHTRTQTRTRAPTPHHTPKKEPSTSARARNTQIGTPAHETAGQSGRKRRGNSETREHRQSSEQENKRNENTKATHKTAKRRQATRVITKATGPHSAPNRKKSTQRKTRRPARDHRRENNNCTECKEADNRDNDETNADARSEDSTHRRRNDILERERRGEQPRAPEESN

SEQ ID NO: 1022901 - protein, 112 aa, Homo sapiens
MRLHCHLYQVPKQQRGQLEQDALCVCEPGKFSLGERPYISWCLGKERHTGLWTGRECCMPDMAGRLRPWWTVVPPVAPKTHSYVIILVLLLLWGVHTGYIHFTWARPCESSM

SEQ ID NO: 1022902 - protein, 96 aa, Homo sapiens
DLEDLCGYCWRPGGEPSPEGTTGQSYKQYSQRYHQRTNTNVNLANLSGSCLYDVQGLAEEDSRRSKSSFPIQRNKALSTLPKGGNRSLGTLRYIHG

SEQ ID NO: 1022903 - protein, 242 aa, Homo sapiens
MRSNGPADHPGLRQRGNHSGCASDTMEGGRGKRRIKKPQGDVAGFVRKPAEQVYSHADLAGVPLDWYEALCSSLFDMWLHDTSCQDTDELYFTLPELTKNPGQDLELALSLRLGAMLHDMALAVVVQLNGLRLGLNGNPGTMAWFQTKKCYRLSDTLADLGNGGHFVVLTTSRFLWAFALIRALLVAIMGRKTTKVQKMTLEHQVAAGNPMTGLLSQLSRVVLRRDRPEVVLQDYGYQPLAY

SEQ ID NO: 1022904 - protein, 143 aa, Homo sapiens
RRLLLIGEAPLSSGSFLLRILSLLLAFKEQTRLVYHSSISHNNSLVISEVMDVEITSSSYTLPRGLCVAPNSPSDTHLPRWWKAPETDHEHTPSESSASTELRAAARNQELVAEIPSAPGTWKGTSPLLHACHSGHLLTDSLT

SEQ ID NO: 1022905 - protein, 172 aa, Homo sapiens
VVTVEKRVPPPTPRLSPHFTITVRPKNAALGPGRAQSSELILKRCLPIHQAAQVCRPSPYVESEDAPPHEEDKESRRPHVRVNECHPPKRLMSLMPRETRDFGGRSEASAEHHNYILEGQRRLSTFGPVFLTAQGTTCRSWVERTDDRPVNGRSLLNKRPPDVVSDSAPCAE

SEQ ID NO: 1022906 - protein, 190 aa, Homo sapiens
VVTVEKRVPPPTPRLSPHFTITVRPKNAALGPGRAQSSELILKRCLPIHQAAQVCRPSPYVESEDAPPHEEDKESRRPHVRVNECHPPKRLMSLMPRETRDFGGRSEASAEHHNYILEGQRRLSTFGPVFLTAQGTIVPEIRVKNEKCRAKVVMCDDKATEYVHSPPRPEELPKLLLVTGKDRRQDSGSR

SEQ ID NO: 1022907 - protein, 226 aa, Homo sapiens
APGATETRRGRLERCSPRDFLFVKSAFPTWRSLLTSRSLNLPQLEMLNEPVWTRNVGVLVQRSIWLELKVGTDPRMWTAKDCLNVAEQEQRGGTELLVPLNESYVCPWASCIDCATGAHRLWGPGYLCSRRTAEDAKALLSRRTDRFSNQGTMAKIQTSSSGDSTPLKQGVIGNDRVRQIQPVHSPGGQPQAYCYGPEEFFGRNLGAAGTPLWAVATLVLRTGLEV

SEQ ID NO: 1022908 - protein, 39 aa, Homo sapiens
GAHSILACDGPSTEKPIVPTSSPIASATKSADLPTTTTT

SEQ ID NO: 1022909 - protein, 113 aa, Homo sapiens
NSRPRRPIEELMVSPVSPHTILIGYTLGGVLRGLMVGVVVTLLSLFFTHLQVHHLGVTLLVVVLTATIFSLLGFINAVFARSFDDISIIPTFVLTPLTYLGGVFYSIVDAAAN

SEQ ID NO: 1022910 - protein, 317 aa, Homo sapiens
VSCAQEDGRGPAARSSGTLWRIRTLAVPLPGTHEPAACLLCLLRVSLLCCAPGQGGLWDACWGDGLALRLAAACPLALRGCETGGGRAKRLCPSYAGRMLESSGLQSAEGGRAGEAQRTGMLQAPGEKNVLQSSPEEGAAELSLPNASCNNTAGSSKQQAAACTEQQALGMGARTDASAHSHVVPRVVAKPQMPPCQSSKEAAVTPNMKERGLVWKRKGQCTMYFTVVMAEGKEIDFRCPVRTRAGTAEIMLQMVQYKNRQAILGVNPTRQDSSSTWSSKKPPSQTKRNRELRHETEEDLGGNQAKNNPSSSHNQDN

SEQ ID NO: 1022911 - protein, 185 aa, Homo sapiens
DPAARQDPWRIPRPHCPCGKAAPRAGPSAPRRAGSRSGSESEEAELSLSLARTKTRSYGSTASVRAPWGAGVIERHVEHRVRAGDTLQGIALKYGVHDGPRIKGANKTVYPVMCIFSEENFETSQLLSEKALGGFNGLTSMVDFLQKIETADTQFFSGTEDASVWPGKTSLLPVLKNLMFQACAA

SEQ ID NO: 1022912 - protein, 215 aa, Homo sapiens
HPGCCCVLIAPPQGLHLCAHPTHSGLLPFRPRHQGPDSWGHPKSTRPPYTRVMRSRWPRCIKGSQPLGDSPDIPVRLTPPAHGECLRDTSHQVPTNRQRGVSPLLGNCQDGLLPQSTTCQILWLPGTSLSLAQRRGFTQTYTVGCEECTSVSLCYPIPCKLQSGTPWLVDGPSSSQALKRASQSRHLACLPREPGLCTWQSLRSPDSLNPARSGS

SEQ ID NO: 1022913 - protein, 105 aa, Homo sapiens
MTMDKSELVQKALAEQAERYDMLAMATQGHLSNEERNLLVAYKNVVGARSSWRVISSIEEKTERNEKKQQMGKEYREKIEAVLQDICNDVLELLDKYLIPNAYTT

SEQ ID NO: 1022914 - protein, 77 aa, Homo sapiens
DPEITLYEKGHTTRNVSTHRDLMRTQTTHTRRLRPSVYSRTSTHTHLEEGSPRYTKRATRVQTHTSQTLTHYTEAFP

SEQ ID NO: 1022915 - protein, 156 aa, Homo sapiens
VQLVDGAKKEAKAKGVNLQVQDASDDAATQANQLANAVSTSAKVVIINPTDSDAVAPSVKALNKAKIPVITVDRSSSSGDVASFIASDNIAGGIDAAKKLAEIMGDKGEVIHLQGTPGASASRDRGKGFSEEIAKHPGIKVVAKQTANFVDAAANL

SEQ ID NO: 1022916 - protein, 383 aa, Homo sapiens
PVSIRPGDAAVESGRAVKNLRSCPRPGLSIRPPEYDEVPRLPTAFPESPDLVVDSEAHKILRDQRTGMKAPVSARAHHPVLRWSSHAVYILAVLLEPACTLCLATCLDQHFPTGSRPTVPGPLSLQMDIAGVPDGKPLVREPCRSCAVVSTLRARCWAQAWVHEIDQCRECVFRYEPGRPPWALRRMWASAAPCVSSHNTMRAACCMRKLFTLLPGRPETRLYMVWGQGEAHGPGMLGRRDLTGTLAEGITREGNPRAVQGCTAFNVRRIDGPYGEQDLPREEERARTRLVMRLREVHEANVMPIAEPGSSGRSLDSRGTRTELEYTGAVLLMLFPRAGPLDEERSLAEARTHHQGVVDPGSVIGEPVVRDWLGWWVRFSNLA

SEQ ID NO: 1022917 - protein, 123 aa, Homo sapiens
GRGLCFLLRLTYSQAVSRQEALLSRHAVKHGALGQLAGSMCAGTYVPCELQVYPRVSHALALCICAHVCTHVCTHVYCALAQLCAVGMLTCVCVCVCVYVCVCMLWQVLSGRLPAREFSSSSR

SEQ ID NO: 1022918 - protein, 268 aa, Homo sapiens
MAPTQGPRAPLEFGGPLGAAALLLLSARHHVPPAPGGPVRAPARLLGPPASLPGLEVLWSPRALLLWGRLARPAGGGIYPTAGRKVAEGQELKDKSRLRYPINGFQALVLTALLVGLGMSAGLPLGALPGNAPALGVCRTPHHRHFIFERSFLYMKGAGSPSFGPGTWGELTAVRFATLFWDEKLNPRICFFELQDIACELRPGSSAGSSSELALVDDGGQVRGGPHGLWWPGPGASWGVPLGQEPPPHHGFPAGGSRVGHAGAPSRA

SEQ ID NO: 1022919 - protein, 246 aa, Homo sapiens
MAPTQGPRAPLEFGGPLGAAALLLLSARHHVPPAPGGPVRAPARLLGPPASLPGLEVLWSPRALLLWGRLARPAGGGIYPTAGRKVAEGQELKDKSRLRYPINGFQALVLTALLVGLGMSAGLPLGALPGNAPAPWRLSHLRSSSAFSTEGGAQFGRTGDSAPLHFLERLPLRLDQFRNGRPCGLSLLCERSREPQAGAVRHGSRKGAHRTKGARRERHNEHGTTGRATRTGQNNYGQRGETRTRG

SEQ ID NO: 1022920 - protein, 157 aa, Homo sapiens
ERTPRRANGPPLSSRHLLGVPRDFTLFLSNGHLWVLPPTPDSPPPRARLPRPLDPVPAPALPADHLPLGAEEGVALEALVVLALGDVCKHLVVHLVCCAIGDPVYGHVLNELVGEVVCQNNSPWRHLQSHLLQLLPTGLAEATVNPQATVNHKPRST

SEQ ID NO: 1022921 - protein, 120 aa, Homo sapiens
DATSMHQYQSLGPYLKKKDESPGRPATPYLASPIEEPEKLDGLYECHSSVPAVATQLPPATGGTETKYLGPRQFFMQAYRWMIDSRDDIPPEERLAQLPGPPSLYTRCPPPIMNCHQDLS

SEQ ID NO: 1022922 - protein, 313 aa, Homo sapiens
PAAHPQENVHLLGSWEDLTRHEGALLQCHQVVGVDVEWTPVFVAGGRPRPSLLQVAVEGHVFLLDVLALSQPPTGQGAQAFSRLVAQLLSDPSITKLGYGMVGDLQKLGTSCPALAHVEKQILGGMDLLLVHRQMRVASVPAPAVEQGQELRGLSLLVQQVLGTALDKTQQLSNWDRRPLYEEQVIYQLRRLLPVEVHQALCREPARFHLSEDWLEPEAQAQERDQAHGEATRLAKRQHRADQQVLWLGRAEGAPFKFGRASGGVVDLLRVAEPRAGGHLALGTRGADRTDTLELGTTARGAISAKGDRHYAR

SEQ ID NO: 1022923 - protein, 158 aa, Homo sapiens
MQPHCWYWQLAPPLGINFARFCLSRWRSGDPEAHPLRYLLRGCGGAGQSTFVRSPRTQVLLSDPVTCDAGYYCIGGKLDESWLVSKIAFSDESFAPSPLPRPLAPMALSSLPSHPSVSTQTLVRPMPRGGVLSLSWEAAMDGPGVKRQGLARGGGPLR

SEQ ID NO: 1022924 - protein, 106 aa, Homo sapiens
ELSKKEPESYNDHTMQKEEPSSSFMLHGVVIVRLWLLLGRNSLKRNSLDLDGGQRSPKIDCTAERNICSKYSVRGYPTLLSFPRREESQLAQLEAENLDSVTPLLS

SEQ ID NO: 1022925 - protein, 264 aa, Homo sapiens
ACRSVKWPGGGNNLEEPRGLALCHWRELTCGGREPLLCFLDLPNSVWGGPSQEVSDNNCVFAPADCDLCRRMCNTALALAKGKFGRVDVAVNCAGIAVASKTYNLQKGQSHTLEDFQRVLDVNLHVAPFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSPLGDPAEYAHLVQAIIENPFLNGEVIRLDGAIRMQP

SEQ ID NO: 1022926 - protein, 297 aa, Homo sapiens
ACRSVKWPGGGNNLEEPRGLALCHWRELTCGGREPLLCFLDLPNSVWGGPSQEVSDNNCVFAPADCDLCRRMCNTALALAKGKFGRVDVAVNCAGIAVASKTYNLQKGQSHTLEDFQRVLDVNLHVAPFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSPLGDPAEYAHLVQAIIENPFLNGEVIRLDGAIRMQPLLCFWTCPTRVGRPKPFPGVLLSSLGGSPVAIL

SEQ ID NO: 1022927 - protein, 296 aa, Homo sapiens
MASAMKAVTELNEPLSNEDRNLLSVAYKNVVGARRSSWRVISSIEQKTMADGNEKKLEKVKAYREKIEKELETVCNDVPVICLTTFLIKNCNDFQVMQSKGVYHLHKCKGDTTYTATLLGGPFISRGRFWGEDLTGGPKRSERCLTRRGFALVSKEADDSPRILIAVGLASAFSVFYYEDPRIAAEASLPLQANHAFDACHKLRQENPKTRDTYKEDTTLIMQTAENNPPPDKESRMKGRQATRGPPSRDISQRQPHQINTAQPNDKTQQKARRATKHAERAKTTTNAGRNNNQRY

SEQ ID NO: 1022928 - protein, 166 aa, Homo sapiens
MQKVVLFFFFFFLILLDQFGSRYPRRNVKGEKQRGLTGPDLDLVQMFSKASGYNKTTKFFLTVQMVYNKLTSGRGIRSYPDPLVSLSVSPSHFCPNSEYRVGGENLAEAASPVTSKKPGRAVLSHSTGRRVLGKQAGRRSGRAWKLLSLKPVAAVLDNLRWTPGSG

SEQ ID NO: 1022929 - protein, 363 aa, Homo sapiens
MSPRCATHESLGPRPSGVPKGAIIVERNSDKVPPRGGGRKFFNSRSVVVVAAVARYFEKGEFHERDPPCGDMFCCPPLGGGPPSFLFQQEGIGQRFYLEQGMLYRPPQMCSKINAPKKPPPVCPSGPHQSCAATTQRGLFLHRTHQYFGVGRIILGEGAYSPHGAHRSRVLLGWCKQVGLPHNKERLGSNTPPQIPTLGGPQSQNPPGAHKSVLSPTFWVSHRWPPQRGRKLVVGEHHTEILGHIAPHTHGGSPLCHKGGTHRAPTCPGFSVSLVIRPLKFPRHTPQGATLCALCVFPPHPGGPIREAVPSHRDVAGDIRDETAYTHLNSPAGLHTGHTLGHNCAPKATLLNATFYKNLTRYT

SEQ ID NO: 1022930 - protein, 285 aa, Homo sapiens
PDPSPAMLALRCGSRWLGLLSVPRSVPLRLPAARACSKGSGDPSSSSSSGNPAPCTLDVDAQRGKPGYGPPLGAWKPEWQIVRPQKNKLKKLSEAPVPLGLTKGLSATNRPPSFPHGVDSPFLSLCQVRRDYHQTTTWPPGGEVHLRKPAFLKSNFTLKHVGPGVLSTGLTAGPNTNASQFFICTKKKDWLDGKNVVFGQVKEGMDVVKQHYAIFRLLRVPGTSKKIAPHTTCVPVEANLCATVLALLAAAKLSSTQVAALRCSPAACNHTFAHSTVTVCPEEGC

SEQ ID NO: 1022931 - protein, 248 aa, Homo sapiens
PDPSPAMLALRCGSRWLGLLSVPRSVPLRLPAARACSKGSGDPSSSSSSGNPAPCTLDVDANGKLLGRVVLEQKVVPKKALCTGKGFGYKSSFQRVSFMCQGEFTGKSIYGSRFPEDNFTLKHVGPGVLSTGLTAGPNTNASQFFICTKKKDWLDGKNVVFGQVKEGMDVVKQHYAIFRLLRVPGTSKKIAPHTTCVPVEANLCATVLALLAAAKLSSTQVAALRCSPAACNHTFAHSTVTVCPEEGC

SEQ ID NO: 1022932 - protein, 78 aa, Homo sapiens
MYALKTGVTPDYMVTRGTTKPETNNRPRARRDGRGRKRHTTTDEHNRQNQDGPQKDTRQHRPTTKNQRNRNAAERGRH

SEQ ID NO: 1022933 - protein, 280 aa, Homo sapiens
GETRAQVTGGFLSFGGDGRMWALCSLLRSAAGRTMSQGRTISQAPARRERPRKDPLRHLRTREKRGPSGCSGWPNTVYLQVVAAGSRDSGAALYVFSEFNRYLFNCGEGVQRLMQEHKLKVARLDNIFLTRMHWSNVGGLSGMILTLRKPGFQSVYFLGPPPDVDQNSSEASPNEYFLVHLNSDIELAVRPHSDPEYEDETMTVYQMPSTQEQRRGKHHPGQSPEQDPQKAQASSELQTPSRMTHEPHTAPGVSPRRGSGIIPGRDPVCQLTYERKLLVS

SEQ ID NO: 1022934 - protein, 86 aa, Homo sapiens
MVFNRGPVTSSTSHEPAESECKDRTRADPEFSTMTSNPITWGQIKKTTQEAEKLLERQVQAKTPDSMFLAMLAVVSCASIGSGEPP

SEQ ID NO: 1022935 - protein, 48 aa, Homo sapiens
MSRRGPWQEPGDAGCPNGLTLKSAPKKESPTWLPTILVQSRKAGKHSG

SEQ ID NO: 1022936 - protein, 269 aa, Homo sapiens
GTCLAAGRTISVVFLVHFVSRRCFLESRRSYLFAPFPATLCPLEARRHQRLRLCYSLFGTEQSGTAVQRCWPGQKITSKDILALTVVICSKKDKQSVRTEETSKETSESQDSDKGKYDTKDLYGIINGHDTLKLSTVHCTNNKGPPKEDHLTSWEAYTLAGFEELQNMLQRERIGALSPELGGSCICCGQILSLWIGNTAKVRAAEPAPAALTDDVTRHRETASSSHLSFTYTYFSHLASCPICLTSRVRHDQKPVRNPQLGRTGTDDT

SEQ ID NO: 1022937 - protein, 327 aa, Homo sapiens
MASGGGGGDTGAGGGPGIGLSLGLGLGLSLGMSEATSEAEECVLATGLRLVVTACATDACVLAVLLLCLGVLVLAGGAAGLLVWEKAAGTGLVSLAVPVAQSGLFWSAVIRSVPPGPFFLHQGPHIVAYFLLDLLAVLAFSLDVSGIIPRRSHTLSSEVVLVVMCATGRHLLSVPELCRYLWLRAGSPFQIHLQELLRVQEAGIQLSSAFESALAVPVLAVLGTLCSRDYDFLHLSVESILLWALVVIIEADPEDCTPAWRPLLMQLGLQHEGQKARVAVDQKTRTRTEPSRDRMQPQGSVMKPLGADRRVKRGHLGWASPQCACEE

SEQ ID NO: 1022938 - protein, 293 aa, Homo sapiens
MASGGGGGDTGAGGGPGIGLSLGLGLGLSLGMSEATSEAEECVLATGLRLVVTACATDACVLAVLLLCLGVLVLAGGAAGLLVWEKAAGTGLVSLAVPVAQSGLFWSAVIRSVPPGPFFLHQGPHIVAYFLLDLWQPRFLPGRFRHHPQEEPHSERIHLQELLQYKEAGIQLSSAFESALAVPVLAVLGTLCSRDYDFLHLSVESILLWALVVIIEADPEDCTPAWRPLLMQLGLQHEGQKARVAVDQKTRTRTEPSRDRMQPQGSVMKPLGADRRVKRGHLGWASPQCACEE

SEQ ID NO: 1022939 - protein, 77 aa, Homo sapiens
NEKVDLWCIGVLCYELLVGNPFESAPNKPPPKVDKSPPGQPPHPPEPLVPPWLRAPPPPPPRWPLPRVRVFVCSVYV

SEQ ID NO: 1022940 - protein, 137 aa, Homo sapiens
VACLVGPRPALVRGILSLHSLGGRCFRLRRGYILVAPRPPPSPPVGGEMAAVRCDHPATGESLLFCFATSYNVRKSAPVAGATDHTSGLLVTAAKEDSTCAGIHHRAPRSGWFPTFVEEGNICLGDHRRWGVLLKNG

SEQ ID NO: 1022941 - protein, 59 aa, Homo sapiens
MLSGVLRCGWSLLILAKEAGGRMAVMASWFCVVSAEDHHLGYHYHPGVSLGVLHEELSG

SEQ ID NO: 1022942 - protein, 251 aa, Homo sapiens
VTSSASGLNPTSAPPTSAVRRPVFLLFHSRQYLPYFRTQIFLDNGFLLGKPALQFNNSNVDISKINEVLTAAVTQASLQSIIHKFLTAGPSAFQHKVSDFFKGCSSSLKKAKHYYNYESPSVFNIVVRHPTKIMMVSPRISTPQIKHSPYQNFVISYSSCFITAKVSTPVRLSKDPGVTVSHTAACKLLTSSKVMNRVSPRKSSGLKVAKRSPINLVPINNSNSQSMAQIGTSVSQQEFSFWPDPSGSIKG

SEQ ID NO: 1022943 - protein, 114 aa, Homo sapiens
QSGSSLCSSTPPAPRPWRLPPHQPPSAPSKLSGNVNGVGQPPAPGPGLLRISASAPSCRAAGPTPTPSALHWDDCRAWCTGRSPVGRTLVGATFLNVLGTQTREAPSSKSLTHS

SEQ ID NO: 1022944 - protein, 296 aa, Homo sapiens
GARAEGAPAAVGADGLAVHGLAEPPARGRIDRVDQHLRAGQRLVLRADRAAVEHHVGLANDLQAAWRLAREELPGRREGRGRERGLAVVHARQHDVGRALERRAVEADVRRLAGRADPQAVGLGELVVVVRAQREPLHAGRHLVAVRALGRVELPHEGRQPRELVVLAQARHGPDAVRRIAAEHHVADDGRAAAVLHVVADGVAAARVADQTTLAAPVARRTARPVLEEGGRFGRGAAPGLGHADDDGAPSGKGGPKRQQPSGGSRRIEAQEVAPSTDNTVGGRNKRRHTPRMGAT

SEQ ID NO: 1022945 - protein, 120 aa, Homo sapiens
YLEAQRQKLHHKTRKWAHHREKTWLSWMFEKLVVVMVCYFILSIINSMAQSYAKLNPAAVELRARQTTSSRESFKTADNWRGWVLPITFGQDSKPRKAPLPIFQPVINSLNKLFLSCKAV

SEQ ID NO: 1022946 - protein, 73 aa, Homo sapiens
KVVSTSVRALYLNLHAYVRRALHRQYGDRFINLRGPIPAHLLGKDLTLPPHVPGSSSSCLAFQSMAPPTPRHV

SEQ ID NO: 1022947 - protein, 272 aa, Homo sapiens
PRVRDESCTARDKSPDGARRSRRESMELERIVSAALLAFVQTHLPEADLSGLDEVIFSYVLGVLEDLGPSGPSEENFDMEAFTEMMEAYVPGFAHIPRGTIGDMMQKLSGQLSDARNQREPGKRKRLMDVTNGQGAHHPQKPHDKRNRNGSQKRLGLSAACMLKTPKMRQQALRRSYLPGVDVTPWKVFPNCVAGSRPQWVLAKARGDLEEAVQMLVEGKEEGLQPGEGPNQELPERLRGPPKDELKSFIRQKYMRVKRKGSKITGPGPKKP

SEQ ID NO: 1022948 - protein, 270 aa, Homo sapiens
PRVRDESCTARDKSPDGARRSRRESMELERIVSAALLAFVQTHLPEADLSGLDEVIFSYVLGVLEDLGPSGPSEENFDMEAFTEMMEAYVPGFAHIPRGTIGDMMQKLSGQLSDARNKENLERRRLSVCSRCSCAYLHAEPAAGGPMIAQKRRGRFAVVVVADTQDEATGAEEELLPGVDVTPWKVFPNCVAGSRPQWVLAKARGDLEEAVQMLERERKRGLQPGEGPNQELPERLRGPPKDELKSFIRQKYMRVKRKGSKITGPGPKKP

SEQ ID NO: 1022949 - protein, 149 aa, Homo sapiens
PYLRILNLYRNGFPLVTQVVSVFLPSCSTRLVICKEKRFNWLMALQALQKAWYWHLLGFSGASRKLIVLTEGEGGAGTSHDKSRYKTQSKKSLITKGMAQAIHEGPTGWAPNTSHQAPPPSIGDYNFNLGFGREQIVKLYYPSTWFSFS

SEQ ID NO: 1022950 - protein, 44 aa, Homo sapiens
SQSTFLAILGGAKVADKIQLINNMLEKVNEMIIGCDMGVRILYR

SEQ ID NO: 1022951 - protein, 69 aa, Homo sapiens
SSAMASLEVSRSPRRSRPGAGRCAVHDRTNIRCFEPTYNERENLPLIVWLLGEKLLREWQSTYDNYNHR

SEQ ID NO: 1022952 - protein, 180 aa, Homo sapiens
MASLEVSRSPRRSRPGAGRCAVHDRTNIRCFEPTYNERENLPLIVWLLGEKLLREWQSTYEIIIIDDGSPDGNNGMLLKQVGRRSMGQTEFLLRPTKRTKGWGLGHLAIIFTGIETHCHRKIYYSSFMAADLSHQSKIYSLTFTSRKAQQERVNLDYLVFWENFVYHKGHRRRCILAGVF

SEQ ID NO: 1022953 - protein, 85 aa, Homo sapiens
AVIGATAAGYATATATWDLSCICNPHHSSWQRPILNPLSTARDQTRDLTDTSWVRYSWAITGTPHQRFKLQWESHCCKPASLIKL

SEQ ID NO: 1022954 - protein, 298 aa, Homo sapiens
MKLPDRGFSYTLGSRLPVLASATHRDGYPAVYGTNRYYIRNTEVFESKFFSPLQRSDATRLIVFKETWHSLLGEVLALVKGMTTLLSSLGAQCVIASRKMDVLKATAEQISSQTGNKVHAIQCDVRDPDMIQNTVSELIKVAGHPNIVHKHMQQGNFISPTERLSPNAWKTITDIVLNGTAFVTLEHGKTLIQSTERKQHIFLLTTIYAETWFRFEEVPSASAKTKVWSHEASLIAADMAVNHGNATHLLTQTQGLYKTKVALTTARDPLEHKTTEMIGNIPRDPGEQTEEPQTGDPR

SEQ ID NO: 1022955 - protein, 162 aa, Homo sapiens
MTNEKALKNPPASLPHSNHPLIEYYRKRGIHSAIDGIPEPRCRVRKHTRQLLQRPIPSIRRAGETGRLFINPGSDPWSNVLEQKGTGGKRTRSQERLATGAQGNRGPTARDGEAGRHTTHRTLNVSGTTHTNTRSERGNHTHTSQQENGGAESSTRARHARL

SEQ ID NO: 1022956 - protein, 267 aa, Homo sapiens
MVVELIEKNLETPLCEKWLLLDGFPRTVEGRQKMLDDLMEQRGQDYSLILSIEFSIPDSLLIRRITGQADTTPRVAVPTTREYNPPKEPMTQMTSPGEPFDPSIKMTNEKALKNPPASLPHSNHPLIEYYRKRGIHSAIDGIPEPRCRVRKHTRQLLQRPIPSIRRAGETGRLFINPGSDPWSNVLEQKGTGGKRTRSQERLATGAQGNRGPTARDGEAGRHTTHRTLNVSGTTHTNTRSERGNHTHTSQQENGGAESSTRARHARL

SEQ ID NO: 1022957 - protein, 44 aa, Homo sapiens
MPTLNSGGSFGSVVRTANIQMRLPMPSSRSSLSAGLQVHSDRLR

SEQ ID NO: 1022958 - protein, 481 aa, Homo sapiens
EFWFAVIKVVAILAMIVLGVLIIATGLGGGPPTGIGNLWRHGGFFPTGISGMLCGFVVVMFSFGGVELIGITAGEADDPRRSIPRAINQVVYRILIFYIGAISVMLCLFPWNQIGKAGSPFVTIFDKIGVAGAANILNVVVLTASMSAYNSGLYSNGRMLYSLAAQHNAPGIFWKTNRLGAPWVGVLASSVVTATAVLLTYLIPGKVFLYIISIALISGVINWTMIIITNLKFRRRIGPEGVAALEFRMPVIPSPVRGVGFLALVVVIMAMMPSYRVALVVGPVWLALLWVGYDVSCLVRRRHACGDERTAPVAGRTEPRARAGPARFPMWVIDPGCARRFCPCALDMVHRNGTVQLSGAPCWLNVSATGWPLVPVVVVRLSAVMCLRFNSLSPPPPPPVACVARSVFSEMSRNGDRLVGVSGLAGPRERQDGDSNRGRMRSMADNFPQLSDVLRCPQAPVDVNSINTDATPQAPGGKRET

SEQ ID NO: 1022959 - protein, 275 aa, Homo sapiens
MFKKFDEKENVSNCIQLKTSVIKGIKNQLIEQFPGIEPWLNQIMPKKDPVTNSPSVNVDIYRIFSEYMENYSFRRQGERAFFIHIPKDSFHKFSFLSCHTSRYDKGAIKLVLSGAQYHVVQAYTFYLKAKALPCCSRYHMCYHGTKENSMLYVLQVMKTVWQTDIEKVHQGMGIANIHYLMMGWAFDDFTELRGWLGLLMVWRNRSGRVWTHDDMPGYGDNPPLQTTKQTTRRRPKLNHGAAHIAVRQKGTGPTTRAQQVVVSKRPHRTEPSVPP

SEQ ID NO: 1022960 - protein, 188 aa, Homo sapiens
TCRLLFYFSSRGRDFRHTQVGGSHDVIVSQAVPVYDTNPHFFAHGGKHGRQCDVLVPLRVGRLLQDLAAQHFPRKADLHKGVHQVLLVTLEAKDLFHVVHHGIVHLRQVLGPEDLQAEVGSSQGYACGPEQVAFNVLLVFRGVFSLQTRFVPRPQHTKACFQVASGPSKRNSSGLRAGNQLPEIGRSG

SEQ ID NO: 1022961 - protein, 173 aa, Homo sapiens
MGTPKPRILPWLVSQLDLGQLEGVAWVNKSRTRFRIPWKHVPTAGCTAGRISESSRPGAEATVCHIVPGRGVSQDRAKPGKRNFPALALNRREGSRLAEDRSKDPARIHEYYIYEISERQELGDVFPVRHLSGHQWVEAVLLNPGRQFVDELLGNMVLGPVPDPGPPSLCCIP

SEQ ID NO: 1022962 - protein, 167 aa, Homo sapiens
MVKTRMQLEQKVRGSKQMNYTPVCSLRLPDRRHSGFYRGLTASYAGNFRNYNLLAIYEEFKRSYLEESSIKPSFCNGTEKNFPPVFFVGLMAGCCLFQKGGPPGFVNPHTKVKGPGPGKRAQSSLFVQRGPVVPEEVPCFIKDVAVFGIPIAWVYLRVVFENTQKAK

SEQ ID NO: 1022963 - protein, 79 aa, Homo sapiens
GCVGLQEKMAVSTGVKVPRNFRLLEELDTKDNKRTYGDRYQLRWWPWSMMQDMHTYKVAQHMHHGATQGTNYEQPEYIA

SEQ ID NO: 1022964 - protein, 591 aa, Homo sapiens
GCVGLQEKMAVSTGVKVPRNFRLLEELDTKDNKRTYGDRYSYAGGLERLNYTTTDHLTNGGTSALNLLGDQPKGTNTYVTQPRQYYYGRDKGYENVLGHVKIYRADTGRFPVQVYDFGYSTNTLYTYVTRGHYTLHFPTVGNGVELPREAITKVDLATKWGKKCQKSAILTGVVHFKGRLKERYYMDVPKENILGTGLSQQGCNTEETGDQITNTHNPNSPQLVSTGGAVPSNTAVGALLKESQQKDVIINLHMCVNVGHSGRSNLLSPQTWQKLITTPFYRVTPKGNVPKDLGVNTTLYRVMAPILCDYGTLISFTFTYLGETHAQFNWVCPEGTTGEGTNIGRQKDSVYLALEKGALVSLEQQLNQCGEIREQLEHATGVTKQTYNAVCGATTRHNGDRRTQAACPPKENSPPHTTGERGSPHYDVAEPRRTQCHNTSTQAASGDSIQPARDAPHQTARRTADNTGETKPQCMKDDRYKYLGGCLFVVLLCFIRTRTTGARLTRKDRDQLGDKERIRRKEIGNDKKGRTKISVKECTYSIEQSENGQSRKRIETGQRIKQIWILKIVLTISEDEDADDWRKRRKCKERA

SEQ ID NO: 1022965 - protein, 154 aa, Homo sapiens
LIKRIPFSTLVKLSWIWEGMHRLEFSPNPIEFTLVNLAKKVPYRYFQPLGLGPRGCAGKYIARVMMKAILVTLLRRFHVKTWQGQGVESIQKIHDWSWHPDETKNMRGMIFTPRNSDRCLGTQEEGGSVPTSGAFLIRSPHTNHPSLPIVSSSQ

SEQ ID NO: 1022966 - protein, 215 aa, Homo sapiens
RSGGAGGAVESGVKEGGREPESRNRSRSGGNRDPCAVREGGGAPTLTRAGGGPWGRSADLDRQDRGSLVAEELIKESEVKALCPKGRERSVVEEEQGGEGVDSPNVQQVVRGTSMDNSIDLKRSWSRVGGRRPLENQITFFSVGGLCGGTVVVSIEVENCSSVLAVTTSGVPVIPGSHSTIDPGATIEEVAKEFTAGLSGFIQNGFALRKVRACG

SEQ ID NO: 1022967 - protein, 251 aa, Homo sapiens
RSGGAGGAVESGVKEGGREPESRNRSRSGGNRDPCAVREGGGAPTLTRAGGGPWGRSADLDRQDRGSLVAEELIKESEVKALCPKGRERSVVEEEQGGEGVDSPNVQQVVRGTSMDNSIDLKEAVQSRVADVPETNYLFHGGFVDVGSIASKRSPAVGLKVRYDRITLIRGDHEEEIKCVSTMSVREYGSVSVWRYCTEIFDYLSGAIIDGKIFCVHGGLSPHQTWIIDMRKQSAHDGMCDSLSEQRTQLG

SEQ ID NO: 1022968 - protein, 65 aa, Homo sapiens
MPAPLGYVPGLGRGATGFTTRSDIGPARDAHDPVDDRHAPPGERTVGDPMKKNQAAGDDDEDLSD

SEQ ID NO: 1022969 - protein, 116 aa, Homo sapiens
DAVRARWCYLELKKLQQSCKPFCRRNNCWRQKDNVFQQIGQESNIKEGPKSRDLYVYTLGQPKNPHFKGLKTHNSQKPKLPQITRISAQNNTHLMQHWKAQHKGYTPGRIPHKKRV

SEQ ID NO: 1022970 - protein, 233 aa, Homo sapiens
PAEHRSRPGPPPASLLASSVSSAGRRDAAGPEDRGVGLLLLCAAAAGAGKAEELHYPLGERRSDYDREALLGVQEDVDEYVKLGHEEQQKRLQAIIKKIDLDSDGFLTESELSSWIQMSFKQLMLCKEAKQQFVEYDKNSDDTVTWDEYNIQMYDRVMDFDENTALDDAEEESFKKGFNFKGGQKEGEFEKANQDSGPGWSLEEFMAFEHPEESGLYDGICHSRSLEEHEKNG

SEQ ID NO: 1022971 - protein, 114 aa, Homo sapiens
NTHSHPSAGDGNRMMALSRTTPTRRQQQQGPPPPQEKPQGPPNRKAIPFLFKKGKRNNPNSEAIPGPPPGKATKNNPKQCGHQQGPPPPTPGKPQVPPPQGGRHKDLHRGSLLK

SEQ ID NO: 1022972 - protein, 128 aa, Homo sapiens
DLPGLRSQLRFSADPLSSPLPPPQVPKMSTGPTAATGSNRRLQQTQNQVDEVVDIMRVNVDKVLERDQKLSELDDRADALQAGASQFETSAAEVEEEILVDRIARCGQVGITVLVIFIIIIIVWVVSS

SEQ ID NO: 1022973 - protein, 240 aa, Homo sapiens
DLPGLRSQLRFSADPLSSPLPPPQVPKMSTGPTAATGSNRRLQQTQNQVDEVVDIMRVNVDKVLERDQKLSELDDRADALQAGASQFETSAAEVEEEILVDRIARCGQVGITVLVIFIIIIIVWVSLHEEPAELKTAVQETSSRLWNLEPAILSSLPTVISKHFGLVLTCKVAQFAEEDVPCVGVHMRLQMRRPGPSDIYAQVPLADFTYGLTEEACFKFQSAINLDVMFVTRLIAITPS

SEQ ID NO: 1022974 - protein, 81 aa, Homo sapiens
EFVLLLKGIMLVLMAEERREHVAKMKKMEMEMEQLFEMKVKEKVQKLKDSEAELQRRHEQMKKNSGSTAQRIGGKTSSVRG

SEQ ID NO: 1022975 - protein, 94 aa, Homo sapiens
AAASTFPASGDSMEPVIPDGATVAVDTGNKRVIDGELYAINQGDLKRIKQLYRKPGGKILIRSINRDYDDEEADEADVEIIGFVFWYSVLRYRR

SEQ ID NO: 1022976 - protein, 78 aa, Homo sapiens
KRRQRGKMAAAVPQRAWTVEQLRSEQLPKKDIIKFLQEHGSDSFLAEYKIIRKPLKYVAKTANKDHLGLQPYNHLLET

SEQ ID NO: 1022977 - protein, 112 aa, Homo sapiens
SAEAIQQSSSLTSVPPTTFSLTFKMESAQQSMGDFSKCKGKGVSSTSTAPPIATGVSSRASGPGTANYNTFSSASMPQIPVASVTPTASLSGAGTYIPLLEHKITVGDPLGH

SEQ ID NO: 1022978 - protein, 323 aa, Homo sapiens
MGAQFHGVTPCGHKSPTTQTFRVRKCFEANNDINAYQAFGTCGRVSRPRTMLLAIGASNPPNDPGSGTLGGFIGPSSQLRPASVKGTTASNAYSDPREQDPHRPSSVPLIGAMSDSPGETLCPSASGHSGCPLCKPLRRTLRADRGPVTRRPVRRSGQRYDDGRSRLPILRYGKGDRTARVSQWLMLMAAGLNLYPLFQSKMWDLESKGSMPPFAPPLIISHWALVSPPVRSNDLPSRLQPLDPFGAGPGLSPSAPNEPPQGVGEHCLYALQSNNTIFIFGFGQGGAGTWGKSRGPEPLAVQRLYFNVYMLQRETASWFKPFG

SEQ ID NO: 1022979 - protein, 188 aa, Homo sapiens
TPSTHNTHIITTHTHTSRGCHTTAWAHRVYGYGVGLRPDEWEEYLEGLRDVVGVDSVYLYPLFQSNDVGLGEKGSMPPFAPPLIISHWALVSPPVRSNDLPSRLQPLDPFGAGPGLSPSAPNEPPQGVGEHCLYALQSNNTIFIFGFGQGGAGTWGKSRGPEPLAVQRLYFNVYMLQRETASWFKPFG

SEQ ID NO: 1022980 - protein, 84 aa, Homo sapiens
AEVLVIWSLFPSDTSFLQQRRRWSLRPVEGVKLAGILQFICRAVCFQQDPKLEKEEEETDPISARSHVYSKKNKQERNRRKDER

SEQ ID NO: 1022981 - protein, 81 aa, Homo sapiens
AEVLVIWSLFPSDTSFLQQRRRWSLRPVEGVKLAGILQVGVNVGVWGFLVWGGLRQRVGVVRSVPPPSTSRSTGTDPWERD

SEQ ID NO: 1022982 - protein, 112 aa, Homo sapiens
AEVLVIWSLFPSGYQLPSAAQAVVPEARGRSQTCGNFAEVMCIQRRISKKETEGRTRGRQIQDEILSKTWKENQKMRVNQSMRKSQSLRKKPEEEEKLEEEAKAKRNFLEKG

SEQ ID NO: 1022983 - protein, 348 aa, Homo sapiens
GWYELALNRQRARCRWLLEKHYGVCAHNSELFGEWKTIFDPPGIAGPARMLLKHIYVIQRARSNPENNVCLITLANDCEVLTTLTPDTGRLCTKLHTVQPKGKITFCMGIRVDHLVSEAPTMDKNHKMRIIAFVGSPVEDNEKDLVKLAKRLKKEKVNVDIINFGEEEVNTEKLTAFVNTLNGKDGTGSHLVTVPPGPSLADALIISPILAGEGGAMLGFLVPVTLNLESIPVLILSWPWPFVYLWKSSGSGRRREARRAAAASAAEARIATTGLKTQINALLKMTISQQEFGRTGLPELSRMTEEEQIVCMQMSCMEQSWQGGISRNVQVKYDTLSQQRVLQLGPES

SEQ ID NO: 1022984 - protein, 244 aa, Homo sapiens
GLCIQSYIRDEVVFGEPRIVCDCEVLTTLTPDTGRLCTKLHTVQPKGKITFCMGIRVAILVSEAPTMDKNHKMRIIAFVGSPVEDNEKDLVKLAKRLKKEKVNVDIINFGEEEVNTEKLTAFVNTLNGKDGTGSHLVTVPPGPSLADALIISPILAGEGGAMLGFLVPVTLNLESIPVLILSWPWPFVYLWKSSGSGRRREARRAAAASAAEARIATSGTEDSDNALLKMTIASKSLAALGFLN

SEQ ID NO: 1022985 - protein, 176 aa, Homo sapiens
MAEEGAGLSETVTETTVTVTTEPENRSLTIKLRKRKPEKKVEWTSDTVDNEHMGRRSSKCCCIYEKPRAFGESSTESDEEEEEGCGHTHCVRGHRKGRRRATLGPSPKLHHPQPPDPSAAPSRANAALNSLSPPAFLCLSGPKVYPCGYFSSPLLPSLLPDRGKRKRRTNTEILKF

SEQ ID NO: 1022986 - protein, 110 aa, Homo sapiens
AELYRVQLRRKTMLTLPNDYRPVTLTLVIMKCFKRLIMVHIKDSMPDTPDPLQFAYHCNRSTEEAISIAINTSGQEENLQYVRMLFIDYSSAFNTICFPPSSTPSSEPGS

SEQ ID NO: 1022987 - protein, 260 aa, Homo sapiens
KNVELNIHLTMNDFSVHRIIWAQGGVCAEVYGCRKADTGKNVRHVNAWYNTASSNTEVSGGDPWALKLRRIMLSLVSAGDCPFHCLHCHYAFQHRQDLSSRFSPGSLSEPGVVTCIQQLSAGTGSSQRPDIALLCGRASSWALGRTCTHRVQWFYRVSLRCHVASIRSGRSMATCRISEPGPESLWLRPAKKPHASVGTHGYMAPEVLQKGVAYDSQCLIWFSLEVHALQVAAGAQPLPAAQDTKTDRDSTSMTLTMAVT

SEQ ID NO: 1022988 - protein, 151 aa, Homo sapiens
GGYEPSSLRDRPNPAWRPPLLFPRTIQRAHTEDEWGYKHPTTAQCRKLPWPLEKKRETRPLLDHSKPTGFLPRHRSTPIFSVTSLGDITFLDEEMKAYPERMGGATLEPHTSTTGWVAREGWAVAKYSSSKRLNFSSTDYKKPFEAHSETF

SEQ ID NO: 1022989 - protein, 122 aa, Homo sapiens
IRGRVDLCLDLPLFSLPPAPLCSVCPGSKSLLLSLILMSLSVCCPSPYLAVCPSSLCTSSFSLHFSSCFSPPALLSFVFSLLLSLGKSLTIPYFAICYGSFSFFFYLSCCNWSCCNCPFWTW

SEQ ID NO: 1022990 - protein, 70 aa, Homo sapiens
VAAASSLFRSAWSCEWSVRCARACTMSVPAFIDISEEDQAAELRAYLKSKGAEISEENSEGGLHVDLAQD

SEQ ID NO: 1022991 - protein, 70 aa, Homo sapiens; identical to SEQ ID NO: 1022990

SEQ ID NO: 1022992 - protein, 46 aa, Homo sapiens
MSSQEQQEFSRELQEFSREQQEFSREQQEFSREQQEFSREQQEFSR

SEQ ID NO: 1022993 - protein, 56 aa, Homo sapiens
MDPIILLLLLLLLLLLLLLRWWRRRWWRQQQEFSREQQEFSREQQEFSREQQEFSR

SEQ ID NO: 1022994 - protein, 76 aa, Homo sapiens
MLKNLLLISPGLSPGNLSAILRGLGPLRKLRLFFPNRLSSPLGFESQTKQQEFSREQQEFSREQQEFSREQQEFSR

SEQ ID NO: 1022995 - protein, 70 aa, Homo sapiens
SVTGMAHFLAPTNAVSLAAEEGGEFCGEIVGRIHVGIGKSLSPHYKIGSDAGYSYSRTGGVKVVISSLNY

SEQ ID NO: 1022996 - protein, 179 aa, Homo sapiens
MAKSNGERWAARARGGESLSGTRESLAQGPDAETTRQNSALLGSDSEANGIRPSAESSKIAASSVGLAGPPEGAQSGEKVTPWRVLEGKREAQGGWTMLNEAGTKWIGLGTRQKKDSALRVARRVHSRPCHQCGGRCCGMYRCQGGQRLNVDTQEPLGKVMTEPGPCPAGGTHKVDVRR

SEQ ID NO: 1022997 - protein, 88 aa, Homo sapiens
MSVCERCQFQLLKAREGHTWLAARFQCACTSFVASLMSERQVLGTLPPYFTLACPRTPPPRQRDPGASGRHSAVPLVLAPCPRAPRAL

SEQ ID NO: 1022998 - protein, 303 aa, Homo sapiens
AASGRFLLLGRRVLGWREANSRYEDAGNGLLHALDDRVGRQRYKYEEAERRFYGTAEVQLQDETACRRHASMSSSRGRADEWALARTDPEDADEAGSLPVRRQHGVSPRKSLGTMQEGPCREKRKRVPPKKRARGPVGPWHLLRPSRHERVWLDKSRFRARAGVCSLCVQKSGQMVCCPGSLASCLVPLGVSATHGKQVAANHVTWGIWVNKSSFDQAERAFVEWSQALLLAPEGSRRQGTPNTGQAGGRPRTGPPDPTHQVNGTAPTGQAAGTGYRRGVAGRSPGMMQPKRGILTRTCFDGH

SEQ ID NO: 1022999 - protein, 43 aa, Homo sapiens
VPGSPRKTGSPRKTGSPRKTPVVPFQFYSELLRLGGLPVLRGL

SEQ ID NO: 1023000 - protein, 73 aa, Homo sapiens
TRQPPQDGQPPQDGQPPQDGHPQQDAAIHVKLERDELASCGGCRQPPQDGGVCCFLPVPAGKLQCSVGLRLAG

SEQ ID NO: 1023001 - protein, 303 aa, Homo sapiens
MAMGTRPHSPIRASSICRKTPGVYPVEGSKSKSGLPSDGPSKQYQNNLKMTVRGLSETRCHLAPPSSCRASCSQIAKKLEATCTVWPEPQLDERLRWVALYTSPLKLMLYYRDSGDGSTQKAFICNSCLASDWDKLLSLLLSWKEASSGFDPPSVAEPSRSSNPKSGTAAKTPYHSKPPGTWISGPLVAMTNFVCVFNLLLQAYVAGPAPRTLLPLFEETVVKCWVPSPEQKRMMDILALGPSPPPLTSSLAEAITDGRRPCQPRPPRGASLKLPGPEVQTLDPIAGGLWCQKPGLGLVSIPG

SEQ ID NO: 1023002 - protein, 128 aa, Homo sapiens
SKNGLGRDEANGREREVSRRERILTTAFGEIRRKTTGCGQVASSLFRGEHHSRGGTGRLASLFSSLEPQIQPVYVPVPKQTIKKTKRNEEEESTSQIERPLSQEPAKKVKAKKKHTNAEKSWQTGKAL

SEQ ID NO: 1023003 - protein, 285 aa, Homo sapiens
GYIEDQKLVLSERALTRSLSRPSSLIEQEKKKKNKTSRSQPGDGPASEVSAEGEEIFLLTLFLSAEAAASCSWPAHLSCCPRVHKSLTLDAHCSSASSPPGRPQVLDNKQRSLEKQRQDLANLQKQQAQYLEEKRRRERDVGSSERELREREALLAQREEEVQQGQQDLEKEREELQQKKGTYQYDLERLRAAQKQLEREQEQLPPGRQSGSASGKTERGPVSGFPSTYQADEGSHRSPPVLRSPLAICTFHSQIKGHWHSELSVSPQRNSISRDTTKNRGLFTY

SEQ ID NO: 1023004 - protein, 263 aa, Homo sapiens
MKHSVQKQACKISYKYTWLFTMQVSTSLKAGYFLGAQAKAKAYENKRKTGGSGKKVGHDYSIVTQSFSKTQEESVDEQTLLMYWNVDKEFQSEFNSFFKPEDPYKKSHKMLLMCGKSFFQSSNLIQHRGSIRGKSPTNVMSVEKVSKESNLIQHQRIPYWGKIPISVMQWGRVQPESHLFAAFEDPHWAETLTVALNVATCFTRGPNWGRHEGGSKKDRKHGDNQGGLTLGKDRQSTVGAHKVDSGLSQKKQKIAGGHKIGRK

SEQ ID NO: 1023005 - protein, 251 aa, Homo sapiens
MPKRGHTRDARGGKTADELRTEPEAKKSKTAAKKNDKEAAGEGPALDGGSPPHMKTHPPGETARTSHNVRARVVWDCGSRRLDEEDRIRVGNRKKPQIYCAFKRPNVQRTNYQLNFRSCLDSLINTGQLLLDKEGYSGVGLLSRQCPLKVSYGIGDEEHDQDSGDVAAFDSVVPGNQHMLLMQGESGRLGYRALDEPSESGGRFRKPCVVGPCGLDLLASGTDVVSNPGRKGRGVAPPSLFCPGGFALSGA

SEQ ID NO: 1023006 - protein, 251 aa, Homo sapiens; identical to SEQ ID NO: 1023005

SEQ ID NO: 1023007 - protein, 293 aa, Homo sapiens
MSNPVRFRSGPATVRHPHAVQPDALPDSCRTDRQARVPEENHMNDATSRTLFGVGVGPGDPELVTVKTVRILREADVILVPYTEATTDGPGRAESIITAVVPEITGRIRRIPFSMRERSGVGEKRKASWQVSSDAVVTAFDEGARTVALATVGDPTVFSTFTYLRANVEERLPDVTVELSPGITAMQALSAASGRPLVEGKEILALVPATVGINKLGQVLDLVDSVAIYKGGRKLPDVVEQLRSRDRQAVIGTDVTLTSEQIITLDEVADAQTLPYFSTVLTTPERTTTGGKL

SEQ ID NO: 1023008 - protein, 42 aa, Homo sapiens
SRLFGYFKQPKLHGCPETSDTGSSFMRYLQFNPVIYKHNLPI

SEQ ID NO: 1023009 - protein, 114 aa, Homo sapiens
MGSNGHWGPTENVTFHSGFIGDHQVFWRMISLKRGPINRIGFLNIPNSFYIGVVVEVSVQHGGEYVEKLELNVVIQGMLSGVGGPLLVMGVCKVVEKMSVCGVCSCMLGCYVRG

SEQ ID NO: 1023010 - protein, 114 aa, Homo sapiens; identical to SEQ ID NO: 1023009

SEQ ID NO: 1023011 - protein, 111 aa, Homo sapiens
KCLAAAIVLTESGRSAHQVARYRPRAPIIAVTRNPQTARQAHLYRGIFPVLCKDPVQEAWAEDVDLPGELCHRMLALSRGFLQEVEMWLIVLTGWFPGSGFTYTMRVAPVP

SEQ ID NO: 1023012 - protein, 85 aa, Homo sapiens
ALLVLPRWSIQIGDTPAGGEAGMVLYCSASSGVQSSRACVGCNPGPMTLQGTNTYLVGTGPRRILIDTGEPAIPEYISCLKQALT

SEQ ID NO: 1023013 - protein, 345 aa, Homo sapiens
FESPLGQWDRGGRGHEQPLPVPPLLSVSPCPVFPGTCEPLPSTVLFSPSSPLPLLSAAPPRGVGAFFSFFFFSQGGGEEEERRGDSEACPKEGKAGEVGGGAKSQGPAKVCTFIRGIVGGWGLRPVNIAPNWEKSCSRGKSQGEPGGRAREGQKAEKKGRSKGPGVSRGVPGPSKVVPWGQGDMQPGVPFTIFTHPDHSPGSWHIYIPSSPRTETKCVALAMSSVIIVSLGLYHNLHPALCENAFHQHLPTQTHRRQRQHNHTTQRPHTTPGGQRNRRGRTNDDHNGTDRPPRRPRTGEGARIKPRQNRKEAREKNNRWAPSTHPRRGEEQRRPQPAPERRMNYK

SEQ ID NO: 1023014 - protein, 342 aa, Homo sapiens
MERRRITSAARRSYVSSGEMMVGGLAPGRRLWSWHPDLSPGLRMPPSTSRPWVDFYPGMVALNAWLQVRPWASERAEMMELNDLLLPATSRRFASWNSKTRLLAAELNQLRAKEPTQAGRRLPGMSMRELRLRHRSNSPGNSARLEVERDNLAQDLDTVRQKLQDDTTLRLEAENNLAAYRQEADEATLGPLDLEEEASKSLEEEIRIWRKDPEEEDEDTTGSTLADKQAKVEHEEAQAEPTEALEENESRRGTGAQNKHEAKRGRAKETNLQNEAANTARADQNPDPRLRRKNNDRDRDTRQQPRKTPKKEARGAPSRQGEQTQQGRNTPKRTKEQEPRTK

SEQ ID NO: 1023015 - protein, 233 aa, Homo sapiens
MAPVSLDTLYERFGKSCHGYQRSARTVPGGRWSSQISLKNYDPPKDQRFSGTLRLKSPPRPKFSVCVLGDPSSHCDEAKALDIPHMDIEALEKLHQDEKLVQKLAQKYDAFLASESLSQHEFPESSAHGLNKARKVPFPAHTPTETLVAQVDEVKSTIQFPMKKGVMSGCRLLVNVKMTDDELVYNIHLAVNFLVSLLQKNWPECPGLIYPEHPGPAPAPILRPPLNKFYYPV

SEQ ID NO: 1023016 - protein, 188 aa, Homo sapiens
MASHRHSGPSSYKVGTMAAQCDCHYCRDPLQGKKYVQKDGHHCCLKCFDKFCANTCVECRKPIGADSKEVHYKNRFWHDTCFRRGAKGGLSPPVATETIVWPRDKQGSVCNTVCNQLGEDSPQRATGGVAFPQGPFCVGQGESKTWTSQGRTGLAQQTCFTCSNVQGSHRDVKLSSLKGRTSTCVTVH

SEQ ID NO: 1023017 - protein, 169 aa, Homo sapiens
VPIVLSGCTAEYEDGFSLPYGWTPGVKRNGFPVALARAVSNEIVRFPTDQLTPGPGALTHVHAMGQLLDHDLDFTPEPAARASFVTWRPDQERSLMFMQWGQLLDHDLDFTPEPAARASFVTGVNCETSCVQQPPCFPLKIPPNDRRIKNQADCIPFFRSCPACPGSNI

SEQ ID NO: 1023018 - protein, 183 aa, Homo sapiens
LRVGLKPKFKDGGRGANYSTAIPMKFIRVKTHVPGIKGNANDIGMDYDYALLELKKPHKRKFMKIGVSPPAKQLPGGRIHFSGYDNAPRQFGVIASVTCKDETYDLLYQQCDAQPGARGSGVYVGVWGGRRGRKIIGIFSGHQWVDMNGFRAQDFNVAVRITPLKYAQICYGIKGNYLDCREG

SEQ ID NO: 1023019 - protein, 103 aa, Homo sapiens
MLPFLSITATFLLSPKWIWLFLEAAMVGRWYQRACLGSLSPGQGQGPSASGSLNLSSARTRVISSQGSNWEPENCPSPSQCAPSLCPGPPAAMCNADVKAVCI

SEQ ID NO: 1023020 - protein, 186 aa, Homo sapiens
RRRRKDACVGESRILVWFFRSELVKRFRVADVSSPPGAMKTSEAQQRLSELRATVQEQLSIRGRSAWTQNGTIIGGHVHICSPSVFPRVTETRVVYIWIEACVEETEHGWQSGTVRIRPGSKASREKDNNLVPIGKPASEHYDDEEEEDDEDDEDSEEDSEDDEDVQDMDEMNDTDEFSGCMDECH

SEQ ID NO: 1023021 - protein, 54 aa, Homo sapiens
SLAPMYPFLPSYTPVCLLSEQYLRRVWCLTPVFPLLGSLMRAYHRTSGVRDPPV

SEQ ID NO: 1023022 - protein, 375 aa, Homo sapiens
RQRKQNPISLPGEQNGRKATPQAGALGALGIRGIPSLCQSEGTRWSRRGRRWAERCPPGVLGAGRSLGAQGSRLHSRPPPLSPLRKPGGSNQPRSAAAAGTQEACLQASGTTRGWKYHALPLRLDSRSGHSGSAFKAGSCPRLGGGGRGRGEAGAPYPLWAPACVAAAVAKVNPGMRTCKPSSPDPRHTRQQAENLRKGRWVRGSGEARNSAVKQGSPQLLDFWITDVDILLNSGLAVSTAHENKSWEQKQTLCHARRGKRKTDKQQEERREHRREEKKGGRKTEEGRHEDEHEDKRGPKEGAKKTGGAREEAERTSGGTVEEQHGGGQVNTHRKRASTREERRDTGRRDKKERKDEESGGGETDDGEASDRPSV

SEQ ID NO: 1023023 - protein, 238 aa, Homo sapiens
TDLPLALRMWCSLSSIPKNWFFQSMYFLEETLEPSVYFKKERMGENHNRLNAHRLLWVAFLTGKSQCGIRTFHGLCLLARNQYYRKSSVSSDKVLKLALILCNFIDEDKPQQGLPEVAEFTSVCVKLLRFSILNLCSSMCENTEDAVLLPGMNSVILTIKILCLLQVVPYMNKLPLQSPELFQELFSMCTEDTTLCLENLIYEDTDHRQPLDITKKFRPFFSNTKTIVEGGTGYLVHL

SEQ ID NO: 1023024 - protein, 243 aa, Homo sapiens
GTVSQLPPRLGAPSKPPGEDIPGWVNLPALGVEVVKAMAMQKIFAREHLGLQGNPTVEVDLHTAKGPDSRAAVPQWGFHTGIYEALELRDGDKGRYLGKGVLKAVENIEQYSGTLLLTGTKREEALRIKEEKLTKFMMELDGDRRKYKSKFGANAILGRCTWAVCKAGGSSQRGIPLDRPDRQILARETLEPHTPQGQPSTVSQPGALQCWKQAGPGRKCNESGMLGARPVQGGPCASEPKAD

SEQ ID NO: 1023025 - protein, 240 aa, Homo sapiens
EHRHLGLCARTVTSHSSPVRRDTPLKSRKFPRALEVQGCLFRKDDGVHQMQNLLKHRWEVRPYCGDQPFFPCHPLLAVPVPASLRATEPQSLVLPDDGAHEVISTTSTSFRGMYVPGPSKSHSSPATTLSPSLSSKSSSAFRWRTVLARTTCRGVMSFSSTSPGYRGKGSWASRISSSAWRSRTCPVTSICHTTLAPRDKGFDHLLSSNWANAHQCAMRPTSTRHSPARIRYRARVVSCH

SEQ ID NO: 1023026 - protein, 111 aa, Homo sapiens
MELNLRRTEFAVRPSPAPVPAVRLEKSGPYRASVVTSLYVGVARGPGVTLREPPLPANSVQAFTLLSSLRVNRSIVEEAAEPVVKKGISQLGHLCASQYTNWLSGKGYSQN

SEQ ID NO: 1023027 - protein, 184 aa, Homo sapiens
MVDIPDDHRVMVEDEGGLLADVALLAGEPRFRHIYTRRPDEVAQRWRRVLGDRAQVVIGDDAVAADLFGPVDVSTRSRFGDVLAITRGDWAIMSRATPKELTLVGMHGSLTPCEMRIPLLAQICEEMRMAELVFHTGPMDSGKSTLALQMDHAQSAHDRQGVRYTMHDRSGGDRITSRIGLSVE

SEQ ID NO: 1023028 - protein, 108 aa, Homo sapiens
SCVRAVGCVGLQEKMAVSTGVKVPPKLCACGKNFEGGTKTGVGRRDTDSLGALKDDEDMTSDTGGTGRDLLRPRKEQIMKTRIYGRKVECGTYITARSSSVSSDCVDQ

SEQ ID NO: 1023029 - protein, 102 aa, Homo sapiens
SLFGDGVLLCVTQAVELQGYNSCGSHCEPSVPSWGPEGFLSTFSSPNVVWDYSVLGHHGLGKSFGSDGDFGQCWPRLDSGTLGAQANLFLSLSLPKFGDYRA

SEQ ID NO: 1023030 - protein, 296 aa, Homo sapiens
PATRGPVPPPGGGGLPPGGWRSWAAGAPCGRPVPGFIGMMRDAGVCWWLAHVSVAYRACKLCELLHLPFAVRQIRTGTFKYQTVRYDITYPFIFLVSRNRLAQVKRKILVLDSGMRHLFTPTMIGVLKAHKVAGPGTAVLDFILKGEYIDTTFWSVFWITIRRAHCGFTSCESGESQWYEAGGVYTQALEIYGSGVADKLDNSRSILKEEILHDTDWNLEVGETTSRTSLVGPKMELIPDIVILDKSPGGLQEAFRQWHSHQNLGSVNPAKQTFSKLVPMLDGLRFTGDVRSVVSA

SEQ ID NO: 1023031 - protein, 113 aa, Homo sapiens
AQLRGEYKGEIEARYSTGLAGNLLGDYIYTTEGIPVLIVGPSYSCYGENHSTFEKTFLQSFVKHTPWGFRTVDELWSPRLCTRVPWVNRHFNTKNKDPSFQKPAPQGPIYHPG

SEQ ID NO: 1023032 - protein, 103 aa, Homo sapiens
LLNRFADGRRVNDCKHLLNMLGKEAEIQHLIAVMHVVEVQVLGKVIRLRRILCVDPLELISDCHDTRRQQAGETKRLSLLDSEGSAPIGQRVRQHLLATGRNP

SEQ ID NO: 1023033 - protein, 211 aa, Homo sapiens
MHLLQQAEAVKLRFPAEEESPTLRRPATSHMAKDADPRDCYAELRAKSTAERHTTLDDRYNPDRRGQTGPHRYITDQLGCRWTETHAEFHNEADNKDSHVDPRSVEDRPPADYEGPTLDEHQRTRPLNRRNRNPCNGARLKNRTHGETPRNVTVLTEAISQRDASHIEAQKGKITRVSTRRPYPPRPTYNAPDGGGKRSSTTNNTPYNRAE

SEQ ID NO: 1023034 - protein, 90 aa, Homo sapiens
ACDEAWMFAQTSLFLMGDRSWIWDQQSGRYSSWHNWQKALESNCQALLLLLADDDAQAAALQLNGAVPLGGLTPAALTALSPALKLSSQV

SEQ ID NO: 1023035 - protein, 278 aa, Homo sapiens
MALLFLLPLVMQGVSRAEMGTADLGPSSVPTPTNVTIESYNMNPIVYWEYQIDATGSLSLTVEVKNYGVKNSEWIDACYQNFSCIIVIFLIMLVSPSNSLGVRVRSQGWTKRNCLCKVRRICCMPRWKKWTTVEAGYQKRRSKQNKIDIFHPSVVVNGDEQEVDYDPETTCYIRVYNVYVRMSGSEIQYKILTQKEDECDEIQCQLSDSSILTEFSDTGVARTKEAYMVWGVTTEKSKCITIFNSSIKGSLWIPVVAALLLFLVLSLVFICFYIKIIH

SEQ ID NO: 1023036 - protein, 102 aa, Homo sapiens
MAEPQPPSGGLTDEAASVAAPTRTPRTKDFLLQQTMLRVKDPKKSLDFYTRVLGMSANPKMCDFPIMKFSLYFLAYEDKNDIPKDKGCKNSLGRSPEKLHLS

SEQ ID NO: 1023037 - protein, 326 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPAEIKDYSPYFKTIEDLRNQDHCGHHMRMRSPIWQMDNARLAAMTSGTKYKSRPWPGGKLWRQNVNGLEPGERKKLNAGKDMTVKMQIQKAALEGRNVDLPMRKKHTAKTGEVKGTEDGSTPERTNETREKMGELKQDEGPRTRKS

SEQ ID NO: 1023038 - protein, 299 aa, Homo sapiens
MTTCSRQFTSSSSMKGSCGIGGGIGGGSSRISSVLAGGSCRAPSTYGGGLSVSSSRFSSGGAYGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPAEIKDYSPYFKTIEDLRNKILTATVDNANVLLQIDNARLAADDFRTKYETELNLRIECGSRHQWPAQGAGRTGPWPERDLEMQIESLEEELALLKKNTRRAMQCPERPGGCRLSTVADWTRDSWRWTINAAFLNREFVDH

SEQ ID NO: 1023039 - protein, 169 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSNFALAFARARDMRCAAHACRLPALAHCACLARIMASCSKAEMPASLQQLPCAPKHAHKRLPLPPAQRSA

SEQ ID NO: 1023040 - protein, 330 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRALAWRNSKHRENRLTRVPYFKTIEDLRNKILTATVDNANVLLQIDNARLAADDFRTKYETELNLRIECGSRHQWPAQGAGRTGPWPERDLEMQIESLEEELALLKKNTRRAMQCPERPGGCRLSTVADWTRDSWRWTINAAFLNREFVDH

SEQ ID NO: 1023041 - protein, 327 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSSINGSVLVLRRADMSGGLACLAWVEGFAWWHLLVEMGVLVGSEKVTMQNLNDRLASYLDKVRALEEANADLEVKIRDWYQRQRRAWMINDYSPLTYKTIDGPAENKILTATVDNANVLLQIDNARLAADDFRTKYETELNLRIECGSRHQWPAQGAGRTGPWPERDLEMQIESLEEELALLKKNTRRAMQCPERPGGCRLSTVADWTRDSWRWTINAAFLNREFVDH

SEQ ID NO: 1023042 - protein, 321 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSFGSGFGGGYGGGLGAGFGGGLGAGFGGGFAGGDGLLVGSEKVTMQNLNDRLASYLDKVRALEEANADLEVKIRDWYQRQRPAEIKDYSPYFKTIEDLRNKILTATVDNANVLLQIDNARLAADDFRTKYETELNLRIECGSRHQWPAQGAGRTGPWPERDLEMQIESLEEELALLKKNTRRAMQCPERPGGCRLSTVADWTRDSWRWTINAAFLNREFVDH

SEQ ID NO: 1023043 - protein, 433 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSFCVKLASVVTDIGGVAYVVLVLTGSVGAMELLGYCVVGFELSRSDWGFMVGARSKTGVDRIARRPSIDSALGTRYLVTNGALLLERSVNGRGLERCTDPSTLVPNVQLGSQVADREALTHVPLTMQQNTLLEGPVTLNLRNQLCGATNLRKLQQSPIIAQTFDRIGQGWRQGRDDLSGDQGSVTAFASVARVRVHELFALDHDGPIGPLQPGVAFGMKARDPLGTSVLDPCNTLPQSDKLALQHGKGQRRARHRLKRDQETQRKGQELMGRGAHERHGKSTRGAGGEGGGSAASGRSCEAPSEQSGNPGAPAIPDTSKSAEEPGEERRSGETT

SEQ ID NO: 1023044 - protein, 168 aa, Homo sapiens
SLPEHLSFFQPTAHSLTSLLCTMTTCSRQFTSSSSMKGSCGIGGGIGGGSSRISSVLAGGSCRAPSTYGGGLSVSSSRFSSGGAYGLGGGYGGGFSSSSSFGSGFGGGYGGGLGAGFGGGLGAGFGGGFAGGDGLLVGVSGVYLIGGHCPEFSWVAGGWSSTKPTDQH

SEQ ID NO: 1023045 - protein, 307 aa, Homo sapiens
QREDIAAGGCAGGVKMSTKNIRVSDGDWICPDKKCGNVNLARRTSVIDVVGEKNEAKMMKAGGTEIGKKLCRKERGLFSANDGSVNTLQHCDCGQKIRVYMCNTPKYAKLEERPGYGGGLQLTRANLSQYLSKEKQSDEVNMHEFGKTQHKKKNTKICGSAWPPKNRFLEHFVVEGGTQIWIRKSGPQGVSKKTVDIKKGWVSPQKKNRRRNTGGSGNNPRGGSGRDLAGHQNGAQGAGKNTPARREKNRTTHQNNRSEKPRRRTYQPNSRPEPARASSIQNTATQIQETNKNQTTSETTKNTTHKR

SEQ ID NO: 1023046 - protein, 367 aa, Homo sapiens
SKQEHKDVMCGRTHLVASAASHEGPEQKQDSAPPLLAHFPRPELPTSPGAPLPPLSLGQVAALGSVSIRPARRRPTQQPATPSNKKAHPQGAVWRGMASSLRYELRRTERRGGGRGGTYYIALHIPDSCCDWKTGGQRLEDIISDYSGNCAIGAFLRLLEETPETQTGQGKAPTDKVALAQRLEIVIKVYIMRWDIPMLPVLTFELLGSSKTTPTSELHGVSWRYIESEATKPRTDGDDPLNRTWTKTKKRERDILANRDQNNLSKTRHDTPDPLDTSGIRPPGAARQRLHQRQKRGAPWPQYPPTGRTRRTPHGKKTHSHNPPVPRPAQQTPNKAHHNNNYNKTQNNDETAPREKATHRLPNHPQQ

SEQ ID NO: 1023047 - protein, 142 aa, Homo sapiens
MAAEITKRMALCRMPLMASCPISRSQHPCKAGWLVAVARKGTLKWDTEGAPSPDDSPWRGQEVPHHLPLHGGIKSHVALGVSWAPHLLLAHLTADLSPGSVRVPKGGHSGAVDRAGRRPAVLLALGDFPRCPPTNLSYGTQG

SEQ ID NO: 1023048 - protein, 73 aa, Homo sapiens
ENAGKPEVLRMAGTGWWLERLWWMRCRILIKVMKPLVCGKRLQRWWSEETRRYRPTKNYLSYLTAPDYSAFEI

SEQ ID NO: 1023049 - protein, 187 aa, Homo sapiens
ENAGKPEVLRMAGTGWWLERLWWMRCRILIKVMKPLVCGKRLQRWWSEETRRYRPTKNYLSYLTAPDYSAFETDIMRNEFERLAARQPIELLSMKRYELPAPSSGQKNDITAWQECVNNSMAQLEHQAVRIENLELMSQHGCNAWKVYNENLVHMIEHAQKELQKLRKHIQDLNWQRKNMQSQVDLN

SEQ ID NO: 1023050 - protein, 48 aa, Homo sapiens
MEYSASAAGSIAGVSKGKWYLLHQDYLPLSPYWQEDEAYTRLYGSALG

SEQ ID NO: 1023051 - protein, 107 aa, Homo sapiens
QLRPFLPEEEGLVSPPPGRKGLPCKTPQFGGSLKSCVLLSGKKKYRRGLVLMAAHRSRALKQPSAHFCWEKYSWLCGTWGWRVSRCQVLQPVWAHFPMLVSDREGLN

SEQ ID NO: 1023052 - protein, 199 aa, Homo sapiens
SFRSAVFLRRSRRAVGRHGAQRNVLVLEPHIPQRSRARGVGATMVCSQHGGLRIHHDSTVHGGQAKRRAQLDRTRSRSGSGPIRPIGALAQRYRYQKRTVQRTAAGLQTWTEPQRWPEFSKQGGPGPSRFHVDPRSAEQVTRKSLQAKRAAAEGVPLQNIILFPRKPSGPKKGDSYLLNELKLDTQLDGTRIMPRPERL

SEQ ID NO: 1023053 - protein, 136 aa, Homo sapiens
MVRCPPGGWLQTSGEKAQGWPWCCPQDGERHHPKILGSSEGGGTTPTGVPGQCKSSQEREWITGTKIHPSSPGSLGPQEGRSLLKDWRGHQGDGRSGRRTYKREGPVIRGETQLKRRARCRHTGSGWKNRTRRWKK

SEQ ID NO: 1023054 - protein, 69 aa, Homo sapiens
LLFDGCNLTRESWKALERASFSKLKLQHIQAPLSWELVRPHIYGYAVKKCELAVRELNGSKNLKLQFYI

SEQ ID NO: 1023055 - protein, 69 aa, Homo sapiens; identical to SEQ ID NO: 1023054

SEQ ID NO: 1023056 - protein, 92 aa, Homo sapiens
YPQGTHSQQVNSPFPKQTKPGKITDSLLTAPLSRPPSSGKAVRRFKLFGSSSFFRSLIWSFSISRAIGVISDAGKSSPGSKIFPMIFRYGSA

SEQ ID NO: 1023057 - protein, 270 aa, Homo sapiens
MKWLSLSELLLSLLLPALAPAASLPSSPSCTPEAIYSLDAWARAGGLGGAGADPLGTLRASSGAPGRWKLHLTERADFQYSQRELDTIEVLPHQVSPCGKHVVSVHDMFACSAMVARIARIHLSQHGQVPCDLGQDEQLTTIGPGASLPSTCHTSFVRTDYIPDYQGCTASGAALFREGYLYCQINLTSDTGQSPVGILEYRHQARDSDQSWYRAGASGTCAHTWTLASALTSVPTVVASTQPVTSGNARRHSPDTKEDLLLQTRFPKHR

SEQ ID NO: 1023058 - protein, 105 aa, Homo sapiens
MALARAWNRCPGSTTSTCCHGLYMLSPGSGRCQFHAGSIVGMALYTGYVFMPQHNHGDIALLWKSYNDQDATRIRGSLGKDPPYEVGMRPSDVIRNSSRCQITNL

SEQ ID NO: 1023059 - protein, 55 aa, Homo sapiens
MEVAAGTSGGEQRSSELSLRPSPTPSSPFPPPLGFRPLSPPSLSDDDLRGMVGST

SEQ ID NO: 1023060 - protein, 83 aa, Homo sapiens
YRTDAFYWVTIAVTRHRQSDQSIAVITKKKEEKPLAINTDIFVVSLYKKQIRVFMWGYSYVPAVTSRFNKLIWIHHSSHMATH

SEQ ID NO: 1023061 - protein, 99 aa, Homo sapiens
MRSPGTAQSVLEAISTYCEQKEWAMNCGRQDRQDRGRRDSGGTSPPCCWTLGAYCGYSAVRMARLLSPWAMLITIEIKPDCAAITQRMVAFAGMKDKVT

SEQ ID NO: 1023062 - protein, 273 aa, Homo sapiens
MLPNTGRLAGCTVFITGASRGIGKAIALKAAKDGSKYCYCCKGAPSHIQNSRHQSILLLKKLNAVWRKGLASVIVDVRDDPAASVLQVEKAIKKFGGMDTRGSIIASANLVCDQYIWNTPTKEMWICMMDREHPEATYLASKRHCIPLFDNKHATVAHILNISPTTEPKSSCDSNKHLWLNNQFAKGNWDCPMVIVPCDWPDTHSTVHLARQGIMGLKQAYTMDALDMLGGPGSAARVTKLLHAPAAIHSKAKFPGTLTAQSHTRLTCLLPHL

SEQ ID NO: 1023063 - protein, 150 aa, Homo sapiens
EGLPLSPMTSQNLRYSHQHACMTERFQWTLGSHFYIRLRSLSMSWDLQGRKVSDNAHVVVWCPSSPLYTTSYLFFACILDGSLLAIFPNTFCGVRRKFIHPNKAAKPFIFHLGTLAVAFERGGAHDGSTGGAVRPGPGLEKLEHPRVAAH

SEQ ID NO: 1023064 - protein, 152 aa, Homo sapiens
KDSTFSYDYQNLRYSHQHACMTQISVLGCDLLVDGIYREYRRHSNSLITSSTGIPMQCEGNGCARSTRHCVRLECTLSISAFLLYYTNVNALSIGLVSLVVAYLAIFLNTFCAYAESSSTRTKQRSPFIFHLGTLAVALKEVVPMMGVQVGP

SEQ ID NO: 1023065 - protein, 46 aa, Homo sapiens
PALPGHDTTLDKITVTGSLIPQTQVETQTPVMTISAEAIQSRGFNS

SEQ ID NO: 1023066 - protein, 462 aa, Homo sapiens
RDAWCQSPGLVVRTEPGDGDSGSAGRRRGSWCKDYYQTLGLARGASDEEIKRAYRRQALRYHPDKNKEPGAEEKFKEIAEAYDVLSDPRKREIFDRYGDGRPKGEWLLMMAGTLRGGVVQIGSLLFELQQFPVGDRSMPMVLLDVSYRVAKKVPFELSLFAGAAETSGGGTRVDHLHDPSSAGFRYGQWSGFTKLWTFGPLTESDPRSPAQKRRAKITPRVQPTKPFGGLALNEESSSVLVSNEAGTILTKSGLKNRGRENSSPVPKQVQSKHTIRGTQPECGTTGGLGHRKGKPHNRTYPDGPRETVAPQQRITHRENTGTGSTRGTGPTQVTVKRRRMGTCSDTIPVAGITPEEGPRRHDHDRLPTEEGADNALIKHVKHRKSGQNLRQRPTTQNARWTPKGGAYQRGEQKPTTIYKKQPTGRTKTDDTRSEGGDGMRSTVTCLEVRVHNSYNPPTISKI

SEQ ID NO: 1023067 - protein, 221 aa, Homo sapiens
RDAWCQSPGLVVRTEPGDGDSGSAGRRRGSWCKDYYQTLGLARGASDEEIKRAYRRQALRYHPDKNKEPGAEEKFKEIAEAYDVLSDPRKREIFDRYGEEGLKGSGPSGGSGGGANGTSFSYTFHGDPHAMCAEFFGGRNPFDTFFGQRNGDRKALDIDDPITLASLWAWVASHNVNFGRSRSAQEPDRRKQDPPVTQDLRVSLEEIYSGCTKKMTISHKR

SEQ ID NO: 1023068 - protein, 40 aa, Homo sapiens
AGAVSRPERTNVSAGARGAEAVAGGGGTGSRRVSRKIKKK

SEQ ID NO: 1023069 - protein, 477 aa, Homo sapiens
MTPTGAGLKATIFCILTWVSLTAGDRVYIHPFHLLYHNKSTCAQLENPSVETLPESTFEPVPIQAKTSPVNEKTLHDQLVLAAEKLEDEDRKRAAQVAMITNFVGFRMYKMLNEAGSGASGAILSPPALFGTLVSFYLGSLDPTASQLQTLLDVPVKEGDCTSRLDGHKVLAALRAVQGLLVTQGGSSSQTPLLQSIVVGLFTAPGFRLKHSFVQSLALFTPALFPRSLDLSTDPVLATEKINRFIKAVTGWKMNLPLEGVSTDSTLLFNTYVHFQGTMRGFSQLPGVHEFWVDNSISVSVPMISGTGNFQHWSDAQNNFSVTCVPLGERATLLLIQPHCISDLDRVEALVFQNDLLTWIENPPPRAIRLTLPQLEIRGSYNLQDLLAEDKLPTLLGAEANLNNIGDTNPRVGEVLNSILLELKAGEEEQPTTSVQQPGSPEALDVTLSSPFLFAIYEQDSGTLHFLGRVNNPQSVV

SEQ ID NO: 1023070 - protein, 57 aa, Homo sapiens
RVRCRARAQMGCMMPCVRIDSASSPNAPSSMRVRGWYLPARIFETGKVDGRPSGLAG

SEQ ID NO: 1023071 - protein, 90 aa, Homo sapiens
LQPHWHYLRAPQSQSTWCMGTWLPEGRVQGLATFSEGEGGISIIHSLAKFLEQGISLALQLLSFWHVIFSIVNRVIKSELGSPDISAAAG

SEQ ID NO: 1023072 - protein, 248 aa, Homo sapiens
AEQARQWVDANSTITSALHTLFLQRWRLSLIVQATTLNQQLLEEEREQLLSEVQERMTLSGQLEPILADNNTAAGRLWDMSAGQLKRGDYQLIVKYGEFLNEQPELKRLAEQLGRSREAKSIPRNDAQMETFRTMVREPATVPEQVDGLQQSDDILRLLPPELATLGITELEYELNRRLVDKPVGSPIRLHGESWRDNSDRTFRMVHKRLRMNSRAGRIIVCVGILPGSHGRTLMNQCCESGLAGLMR

SEQ ID NO: 1023073 - protein, 172 aa, Homo sapiens
MNQGLLNYWAGANVSSFSRSGGGFVAAGWAPQGVPHGGAAGGRSTEQHHGRGAVQNPESLYRTLSCLLGLPLRVQKIRSRPEHARAESLNIYLDWTYDFEICVMGNLEGGTKVAQTEINPLPARRRSKVEIHTAEYQDSKGAVCLLMQVSCRVCCVADFSIRTSFEKVEPKC

SEQ ID NO: 1023074 - protein, 107 aa, Homo sapiens
MTSSARDFMPKTVGIDPMSIYLCCKPDETGKSVLGNKSNREEAVLQRKTGSQRPCRPPARRLCPAALRMTLGLIGKKRALSTSALHSREDARCRRQCQSDRRMRNKP

SEQ ID NO: 1023075 - protein, 90 aa, Homo sapiens
GWALGSCARGRTRGIMEADKDDTQQILKEHSPDEFIKDEQNKGLYDEITTEKYSAKEGDPKAVKRSSKEATKEFQIKRIFLKQKMKFLSV

SEQ ID NO: 1023076 - protein, 43 aa, Homo sapiens
GSVPLKRHAGVAILITLLFHEPGILPVGTHARLKVSAPLFHCM

SEQ ID NO: 1023077 - protein, 125 aa, Homo sapiens
VCGRRLISCSRTDQTFVMMPEINTNHLDKQQVQLLVRDVYPYDENDNKIGAETKKNCHLNENMRKDYRIAALDVSSYLTHRTISFCYSKDQMLQITFPGCVDEYVSYVIHLCKSSRAVRKVTPLE

SEQ ID NO: 1023078 - protein, 217 aa, Homo sapiens
AAAGKMADGKAGEEKPEKSQRAGAAEDLKKKLEKPVKIRVFLPVMAGDKFQSQRLKKRISEEEACRDFPKKALQEISKVVGIVAIGSSGGKKEGLQAIFHQNCGIKVGFKEKWFQILVFQKILSGQQQFLMKYEDSEPEEDASEKQSMQDEEILAQGYTKIKLEQNFFNKGKHGFLDNPEAVGKRNYKISSVPIFYDQGPIKHGCLEIGGVQGGVYS

SEQ ID NO: 1023079 - protein, 245 aa, Homo sapiens
TQAHFSRESGADGSNMAAPSLSREKRPGKLSFLRSTVGIAAAEQGFWKGICVPEPPAWLGLNACVASHGVAMKSMVSMEHGLYKPCTCMFDIVGTHLTHRDVRVLSFLIVLDVIDDHERGLIRNGRDFLLDTGDARAACDDKYFRTGDCKLLGIITRHDLLPYVTLKEETGLCALDLVDKYLEEKSNIDIVNPRGPQVIQNQGSPASKNSAPHILWVCCPHFGSQMCCSVSPRRATCGAAKTRSH

SEQ ID NO: 1023080 - protein, 132 aa, Homo sapiens
MIYEVGSLCHPKTNTQTNKTFWGAAWGPWEKKSFSETTFLVGARSGQSEERMDTAKLWRRKRCVPKEDPWGPSAAGVGLLPRNKKKGRGGTHRGVSSTDSQREVRQHYGVLHTGGQGSEYVRDRVRRKRSQG

SEQ ID NO: 1023081 - protein, 103 aa, Homo sapiens
GVPSDRWRWRLRLSDGRWRPKSPGLKGGTNLGARRSPAGYCAKPWGDGEVKTYRALVPSQILQSYLVTSRMYLRFIEVEMSAVKEKSISDALSCHYKLLKKLT

SEQ ID NO: 1023082 - protein, 69 aa, Homo sapiens
SSSSAHLIADWAYQDAILARLQSQLDRLLLQHHRQHQAHLLHQPTKTGALITVLVMNVQLRTLTVTGER

SEQ ID NO: 1023083 - protein, 165 aa, Homo sapiens
TVSNDLTYAHNVAAQRNYIALASTTVETTDPEKELEPALELLEPIDQKFVAISDLYEPIDDGCESQVFCSCSYDATTHFETTCNDIKDIYKRMAGTAFDFENMKRKQNDVLLEKSEHVIVAAPSPCLPQPVSVLLEGSSILCFPHHVPINQLIGPLDTISYTYDA

SEQ ID NO: 1023084 - protein, 268 aa, Homo sapiens
MLLRRPGGGSGGGGCGRVCACGGDGGGSKRCPRRAACGVAGRSQRCGGAGRTLSGQLRHGWHGVVPECRSESQKRGEAKPRSAWVALTHGKTPFPLLQAAEALSSAQNGSTSPKYGLQKLLHDDGPEPQKRGDILKGFEPKKCEQNLVQGQSLNGKRGLNPKNYKENKTHSVVFVGKIPRAKEKKIFANSGTMGPFFSRESESAPGDFSLSVKFGNDVQHFQVPRDGGREVLPLGLVTSILDAAGGYQQIYLCSRNQRFLGTHTGQGE

SEQ ID NO: 1023085 - protein, 142 aa, Homo sapiens
VSSRRRSAQRWVSRSRSREEDGLHTRLPPVPFPPGPCDRRGKMASGVQVADEVCRIFYDMKVRKCSNQEEIKKRKKAVIFGLKCRTKKCIMCRRRQERSVGGEDCVVLTIKDDPLPGHLVWGSASLKKRLCRLVFVVMMQSL

SEQ ID NO: 1023086 - protein, 250 aa, Homo sapiens
NPRRERRLEELLDAEALPLPDGADMSEQSKDLSDPNFASEAPNSYGAQQPWGFGGGSSFRYLCRASYPSSIARRSAPHAAPASPGPERRGRPRMALQPRAGRDGAGGLAHHQGSPRRCEPNARARHRQPRRTLVQKAHELMWYVLVKDQPSKMIIWFPAPLVEKMSSRSLHSTVVQEQSFRRTSLILARVIRAAPEEITSLHPMEFALVKALEPEELDRVALSKHACPMTGLLLHDLETHLTWKGRGAQD

SEQ ID NO: 1023087 - protein, 102 aa, Homo sapiens
MANSGCKDVTGPDEESFLYFAYGSNLLTERIHLRNPSGRSSVWPACKDLSLIVAFPQGQNKSNCWHGGIATIFSESWQMKCGEVVWKMNKSSLNSLDEARRG

SEQ ID NO: 1023088 - protein, 117 aa, Homo sapiens
MANSGCKDVTGPDEESFLYFAYGSNLLTERIHLRNPSGRSSVWPACRQEGVKSGMYVVIEVKVATQEGKEITCRSYLMTNYESAPPSPQYKKIICMGAKDKWFAAGVSREVKSNRTK

SEQ ID NO: 1023089 - protein, 38 aa, Homo sapiens
IKKKTIRNLSPAPSGMFRIEEIPLDQVDIDKENEMLVT

SEQ ID NO: 1023090 - protein, 103 aa, Homo sapiens
KRRAAIHRGGTLGPPRALGWQRGPLNSREAVFPGSRGNRWGNVGGKRKADGYNQPDIQASSDQQPTELGSQPIAQQPLQQGGDSGNGYNNDNQEFFTYGQQWK

SEQ ID NO: 1023091 - protein, 113 aa, Homo sapiens
TPSARADVTPCEHLLALWVPWILEGVHVVEEQPDHAIRLVQVPFHLPRPLWHFACSQQPDIRLQQGVGLVQLLLTQPRLHLQLGHDALKTLQPLKLAAELLLPRQDGASREAF

SEQ ID NO: 1023092 - protein, 43 aa, Homo sapiens
VLPDLSYERKVARDVIRRRRLKSWHDFAIAALTRRPMSGCSAG

SEQ ID NO: 1023093 - protein, 120 aa, Homo sapiens
MHLLLAGDSEVPYFPMGCESGRPFSLLTGLELALSPPWICGTCDVFPGDQNPIEAELQDMINEVDADGNGTIDFPEFLTMMARKMKDTDSEEEIREAFRVFDKDGNGYISAAELRHVMTT

SEQ ID NO: 1023094 - protein, 275 aa, Homo sapiens
ETGRVRCAVPVLQGVRAAGVRSAEACGCTPIVLGATFRDQCPKSLKKLVEESREKNQPEVDMSDAGHLRTMLDVERASLPYPISRDNWSVSHNKLTMVPANIAELKNLEVLRAFLSNQIEELPTAMISSASESQTTVNLGMNRLNTVATGYGSLPALEVLDLTTRTGAKILFLENSSYRDRPCVRLYLKVDNDVRDILAGRSLGERSPTVADTQGLGDYDLVSLPKNPGSLPSEGAPPSGKRYTRFGPQIRNLGLTGQSRIHSENTLVAPLGHLP

SEQ ID NO: 1023095 - protein, 127 aa, Homo sapiens
RPPSFSAAPSPFARSGCRLGGRLMPYRMLRPVLQPEKSEHVMLVDTALAVILDAVPDPLMCFITLGVLGRCVLSLSEQGQNTVSKHLIGLPRHQAIMPTVFMNGVAGVVHSSLDALVQRVAVGCHLV

SEQ ID NO: 1023096 - protein, 43 aa, Homo sapiens
MTEDPGCCRRNLKVISTMSVGIDHLALDEIKKREIRVGYTPRV

SEQ ID NO: 1023097 - protein, 486 aa, Homo sapiens
AEVGVTWHAQALGGEFPTGQDAEPTELSRALAKGGREADSGEEQSGTVDGAERRRCGSLNGAGVKGEANEGRSTLQTETGLTAEHSKRGVNLEYRHEKKVGAQMGSTSSFLPAQLSIVRASQAEKAFRGLSNCPAKFAIPLPPAVTPSLFVPARRAVLQCASGRGGGAAAWVVTNAGRGGPIRTFHFRVAAWRRFVRSDINGCCSAGCPPSCYLGALAWRSPSVLFCVQAFPSVPTRKATAEEARVDRQSEEAGASSRGSGPGYSRAMSYGDPPPDVSGVMTSRSKVDNLTYRPRHDTLRGVFEKLGRVEECTSRGSYIQGSSRGFAFVRFSTIERDDVEDANGMPWNGAVLERRELAGAHGALKVACGTHTRAPGDGTPLVTGAVATDAGAKPKQAVPAAEPELGAVKAPHRLAKRLEVRSRTGLTSGPQGHIPRRPVQLVDQFVRHSRSPRPPHVRGQPAVESSTLRRGLKSFAVQWRTDNSPV

SEQ ID NO: 1023098 - protein, 267 aa, Homo sapiens
SALGTLSALGARPRFSCSVDKFGYTLPGEFARLVEQIGLEEWLSFKMSTVHEDPGPSSAVEGDHSINPQVQMGSVNSRYTNFGLLERDALRHGYQAIERNQEDVALRCHHGPTFGTKRSKGTEDRDMACAYQEEGLTHKEACFRRLKVSLDRGLAVDDGDFGPSGKIMLLKYDRLSGLESFQWTGAGNPDEEPLHVRIICRETKQEVEEIEEKSTQEMYKNDLEKDIISEDLVNIRKLVVAGKGEEKDVMDGIEWWPDGGIYKLGGT

SEQ ID NO: 1023099 - protein, 105 aa, Homo sapiens
MTSGFSGADLTEFCQRACKLAFRELLRELRLRRDRERLTNPSALEVEEDDPVPEIRRDHFEEAMFFARRSVSDYDIRKYEMFAQTLQQSRGFGSFRFPPGNPLLG

SEQ ID NO: 1023100 - protein, 367 aa, Homo sapiens
RDAVVMAEVVSWKEPEPSQIKAHSEQADAHPVIELMKRPQCTLSRDTACMDLRAEWVSCFLKLFINDVYLAHLLQGLIEGLRWLKPRGGVRMCAGRCLPVWLKTAYEAADVADDQEEASYLLCIFVRILNSLVQKLLETTDRSDGHQNKLRSSVYESLMEHFEKQLPRNVTLLSRKTTLVIMERLQQVLQMESHIQSTSDRIQFNDLQSLLCATLQNVLREKCNIEDALQISDVVMASLLRMFQSTAGSGGVQEDALMAVSTLDGSVWVVNSSSTWRPFKTTSWAIGIKKLCQEITRFVVAAGVEHVAGSIFDAGAAAIPSSYLVCDEVMQLLIMENLGNEERSTGSGEVRRLLVSVGDIAWYGRRV

SEQ ID NO: 1023101 - protein, 296 aa, Homo sapiens
ETQRRTRWRRQLYRAGEAVVAEAVVGLVVLPTPGQEVAVAACWISGKIDDKPVKIDKWDGSAVKNSLDDSAKKVLLEKIQHMWTNSWSNLTGRLTICTISFFLCHSGLIRRLLCTPFQESKPVLAFVCHILIGDDGDSDHFIPHTKEKDASFSLGHKDDPTGMDPADTVTAVLSLTQVGLTNKTLKGDLHQVGSTNAEVPSASHRSTLKVRPQGQLARMTFEPNIQAPASCLAEQLGQFYSTPSRPGDTQARARAHKRHRAPQPQASRRGPPRGNRATTAANPHRATARPPPSTYT

SEQ ID NO: 1023102 - protein, 364 aa, Homo sapiens
MRVVRLSCRKRNSSSYMRFDDPGLMLMGCTPLVLLKARHYLSPSLFVYPEESLVIGSSTLFSALLIKCLEKEVAALCRYTPRRNIPSLFCGYGATGRRVGGPENIRLTPPGFQIGSFYPYADDKEDDARLLKNIMANPEQAGHRTEGYRLRSFAFTYRSDSFQNPVLQQNFRNLAGLDLGHLAWSRNNAVDRDIAQRVEAHEVKDWVSLVEDVYRSLVTHQDYKSCKWTVTKTKTRLLTRYLESNRGPKGRSTSTKKELEDPPSSTRVPLGPGSQLAHEFNHEGPSPEASPGLKEVGPKNTSNGQTWRGKETGYKPKARTQQEPGYHGEAENGYNSQDTLSRTQAARKGPGTLGTHKTDHTAEH

SEQ ID NO: 1023103 - protein, 112 aa, Homo sapiens
MPVLRKHSMSVTRQTLPSHGEYNSTRIKTTPRKMKKLRNHPQLNQQENSPKAVTNETDLCSLTDLDFKRETVKILKELREDMNSNSDTLRKELEHIRRSPEKLDHSFAYLGV

SEQ ID NO: 1023104 - protein, 68 aa, Homo sapiens
QPRYKTLEDRFFEHEVKLNKLAFLNQFHFGVFYAFVKLKEQECRNIVWIAECIAQRHRAKIDNYIPIF

SEQ ID NO: 1023105 - protein, 259 aa, Homo sapiens
MASNAGPPDVMIWRQGSGGIKLWCCGRGLCPRVCGVTGARVIITEIDPINALQAAMEGYEVTTMDEACQEGNIFVTTTGCIDIILGRHFEQMKDDAMLCNIGHFDVEIDVKWLNENAVEKVNIKPQVDRYRLKNGRRIILLAEGRLVNLGCAMGHPSFVMSNSFPNPADGADRAVDPSRQVPRGVHFLTKKLDEAVAEAHLGTADIEVDQANLEKQAQYLGNVPVMAPSSRITTDTETARSAVSTSSCLSIAQAQPHTH

SEQ ID NO: 1023106 - protein, 288 aa, Homo sapiens
SVPETQKRTRELLPHSWKAYAAGFGDRPRRILVLGLDNLNKITAQGQYDAPGGTCGTMGHDSALLSMTSSSVGDAKTRYKLKVEGYRGTGGDSMAYHNGRYFSTFDKDYSIRAITNVCSVLQRGFLVQELSPCQPDGEHMGTNNHSQGVNWFHWIGPSNTPIQFAEMKLDQAIFRNLKARRRRAVNSRDNWCERGIRPRARKGLLPRASNTNSPHHRSTPGHVVRVKADHGSWAEEQYVLTSLCFFFAQKIRLHMFRLGVSAKVPVKHRKLLPKGRDGQGRKRRCNTG

SEQ ID NO: 1023107 - protein, 58 aa, Homo sapiens
PWSEVSMMVNAHSSSWSSQTAAAKSPKFSIKFLRKSFLSVAKRQTPRMPISHVSGMLA

SEQ ID NO: 1023108 - protein, 136 aa, Homo sapiens
MARYLDLKVVFKPMAYRIYVFSQMHELRGLHNYHDLSKGNEFHSVMPGVCQNLAKRKWLSVELVLQNRSYFYTGSAPLMVLTSSGVLRTPGLPQSPLRVAQSAVCLFRDSRGLVPGLFSWVPISVWRRLPSPGLPE

SEQ ID NO: 1023109 - protein, 171 aa, Homo sapiens
MRSLSSQPVISCGPITLHSPSRCGSPPTLRVPKTFEQFFSDPYRKTPSPNKRSIYIQSMWLSRKHQNYQVKNILTWLTGYCKAYFYGLRVKLLEPVPVSVTRCSFRVNENTHKLQIHAGDILKFLKKKKPEDAFCVVGITMMDLYPRDSWNLSLDRPLGQMVWGIQFARYG

SEQ ID NO: 1023110 - protein, 42 aa, Homo sapiens
LGSCCMRRMAGSPISSTVTMAWMRNVLGSRVTNVKVTLRLDT

SEQ ID NO: 1023111 - protein, 179 aa, Homo sapiens
AKFFEDYGLFMREGIVTATEQEVKEDIAKLLRYESSALPSGQYKPASQNTPARMRVRHPNIYYPVTPPSRHLAEHSPYYEAMKKKDTEVLLLLVSSFDELTLLHPREVLDQGKEKLSPLCEDGDHKSVGFTYKGGDSLRTGPQPRSAYAEKETEELMAWMRNVLGSRVTNVKVTLRLDT

SEQ ID NO: 1023112 - protein, 168 aa, Homo sapiens
MCATYLTYFEETQIFSYFSQCGTVTRFRLSRSKRTENSKGYAFGDSGVLRIVAKIGGDNNEQLPVVVKRLWGGVILCHLKKYIKEFFKDVNIPFKAGIIFISDRVIIRNSDTKHKKLRREERFKKKERLLREEISKKGMDYDFPFLDITRKREVFQKINRQTSTKAVS

SEQ ID NO: 1023113 - protein, 235 aa, Homo sapiens
GRDPGGLGALQRSAARSVSVTALPPGPAGGCWWWRWRTALPGVGSRGGAPPELALGLPCCDARRGAVLAEIGAVTLVSARSRLSAPQPGLNPSSASKRRASRSRAACGKLSAGRPVVRELLEKDTEGQGAKKAETRTGFRGQLKPGGRLEPGAKEDETCDGQASGEQEEAGPSSSQQDPQWGSPLAQICSLCQVALQGSTGQGKALDWRVQSKRLAQRRLARAGYSITENCGSKV

SEQ ID NO: 1023114 - protein, 254 aa, Homo sapiens
GRDPGGLGALQRSAARSVSVTVCLPVPQEDAGGGGGERRSLVWGAEAVQALRERLGVGGRTVGALPRAPPELALGLPCCDARRGAVLAEIGAVTLVSARSRLSAPQPGLNPSSASKRRASRSRAACGKLSAGRPVVRELLEKDTEGQGAKKAETRTGFRGQLKPGGRLEPGAKEDETCDGQASGEQEEAGPSSSQQDPQWGSPLAQICSLCQLALQGSTGQGKALDWRVQSKRMAQRRLARAGYSITENCGSKV

SEQ ID NO: 1023115 - protein, 71 aa, Homo sapiens
DGQRTAGDPRFAAQIAGTQQGMPSAFTGPESSIRRLPGIHGKCVPPEREFQLDPTHIPRNMLLWHSTILRG

SEQ ID NO: 1023116 - protein, 400 aa, Homo sapiens
SRRSLLKKNVSINTVTYRVGSSCTRIKHWPGSTCRCYPREKQAVAGSEGAQYRKKQLAKELPGHDQDPSKCHELSPREVKEMEQFVKKYKSEALGVGDVKLPCEMGCPGPKHNVDISVRGYKQPHAADGGTLEGENTCLSDAQRASHIFLSICVTKMSMRRMVTQTIYAERAGYAEHCGTQTMYYVCSTCHELLVDMIHFWKNEKYTVADITVTGEKPRCAGCDELIFSNEYDQAENQNGTEHFCCFDCDSIYAGEINVMVNDKPGARPWLCEESPLLCVRMQHAIDQKAAERNYNNFSWLASPRAYQGTGEKCHIGQKYWRKRDEPGQEGKTRIKEEAQDGNKHPGAAHRKGSNKSATTPPKDSTRTEDKRKETDRHRQDTPKRTHDSQPPTDQREHST

SEQ ID NO: 1023117 - protein, 223 aa, Homo sapiens
MSKYLTFQGASHEVEKGFIWENLTPGGYWTLEVVGPKESFLKAGKKFFIPNFGGERFNNGPNTIFSIECVACFHTSHGGEDSYGQQGNWVKSLSNGGGHSKDEFPSNGVAYKLGERLVAMAKLLVLNDQWTAVFSFHTWAEADEFKQLGITILWNGLPAVQHIHVRHWSDVDLCVRKDPNSQIKVGGWKLWGTSRDKGAKDRGGLMYQAPIVSWGATKKLFQD

SEQ ID NO: 1023118 - protein, 79 aa, Homo sapiens
TVAMNSVGEACTDMKREYDQCFNRWFAEKFLKGDSSGDPCTDLFKRYQQCVQKSNKRRKRFLLKDWSSWAMAEKPENSS

SEQ ID NO: 1023119 - protein, 54 aa, Homo sapiens
SEDPRERGLIGIGRRLQLRFEPSLGTSVCRGSGPRNSDNNNNRQNNNNNNNNKS

SEQ ID NO: 1023120 - protein, 129 aa, Homo sapiens
MYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGKMFEFLYLRMN

SEQ ID NO: 1023121 - protein, 142 aa, Homo sapiens
MYGIEDTQDTVSLTVDGVVFHYRAATSRYTLNFEAAQKACLDVGAVIATPEQLFAAYEDGFEQCDAGWLADQTVRYPIRAPRVGCYGDKMGKAGVRTYGFRSPQETYDVYCYVDHLDGDVFHLTVPSKFTFEEAAKECENQD

SEQ ID NO: 1023122 - protein, 99 aa, Homo sapiens
MMVNDSVRGLIGISYQMNHPKQQNKLRDEDLFRLKEPVHVGVKAQQMKMCDKNCVWEKSGKEKWKLPKKINGLRRKSFHGSERTVDNDCFKEIIPDFVW

SEQ ID NO: 1023123 - protein, 68 aa, Homo sapiens
SGVWRGGEAVASSALVSSLKGVTAVGCPRPLLPSREMSLLLRCKCTLSLLFNSENESYRGYIKNTFVK

SEQ ID NO: 1023124 - protein, 86 aa, Homo sapiens
TAVWAAPVSYGSSQARGRIRAVAGLAYTRATAMPDRSYVCDLHHSSRQRRILNPLSEARDQIHILTDPNVVLYHCATTGTPPKTYF

SEQ ID NO: 1023125 - protein, 130 aa, Homo sapiens
VNHPLGRGVTIQMDFGSDSRSEECTRMDHKMEFIKALALLVKFYFFILKKYSANGTGLGLAWKLASFFFFSFFCGRKRCVLKVFSRGGCVNSVQCGEKYRGVPANFLLLFLQKNLGVIPGVCSNTLILSI

SEQ ID NO: 1023126 - protein, 94 aa, Homo sapiens
LETPRCADGEPSDPFIDDGPDPLVGGADEAGDVQRRRTLVHRAGRVVLQHPPLTEHQQTDVQAHRLMLIVRDVDSGEVDLLVQRQELIAQLVRR

SEQ ID NO: 1023127 - protein, 70 aa, Homo sapiens
QSRARIPKMAAVKDSCGKGEMATGMGGGVHLGIPEAVFVEDVDAFSETVWEGDCMIQYERERWNEQYQTV

SEQ ID NO: 1023128 - protein, 43 aa, Homo sapiens
GDVMAVNGHMYHATPNLLSQHMGRVTKQWSPRESGIQFAGVFL

SEQ ID NO: 1023129 - protein, 309 aa, Homo sapiens
SWCDRRGTPVVAAGRLGGTGPRRHHGGATGAGPRLQLGRALLLRFTGKPGRAYGLGRTGPGGGLCAAGESSEAVPPSDRAQEPRLRFEARGSLTVSVFFRQSVAGLAARLQRQYVVQGLGAAAEPFGGGPVLFLAFQARVWGLIEEKPGGEPAGAGLGLSRTIQAIYTQEKQAGADACGHDDACRVSVEEYLIGQSMVRPASAVVFEDTNAYLVPDTGVTKSTGLFHGGASTSGPGEGGATRGPASLAQMCDFRRSQRALEQWQNCPEQCLVEVDPKRSRKSAQTAPTAAGQLMHQTTPKGSPSYHSVL

SEQ ID NO: 1023130 - protein, 82 aa, Homo sapiens
PQYKVEPTHHYEKGVFKLEVIIPERYPLEPPQIRFLTPINHPNIDSAGRICLDVLKLPPKGAWRPSLNIATVLTSIQLLMSG

SEQ ID NO: 1023131 - protein, 108 aa, Homo sapiens
IIGPMTFSDSVGAGYSPGTCIWRHMEKRGHGEVAHTCNPSTLAGRGRKITEARSLRPPWATERDPISTKNSKKLARHGGMHLVIPATQEAEVGKSTVGKSTVGKSTVG

SEQ ID NO: 1023132 - protein, 117 aa, Homo sapiens
MDQVSRYFSLAQSIAVPLTASTSSLYHLFLVVVVVVVVVLRQSLAQVPRMVQMVRDLELICNASILLRFKRIAPAFSPSRVAGITGVYHHAWQFFGIFSRDGVSPCWSGWSRTPDLR

SEQ ID NO: 1023133 - protein, 151 aa, Homo sapiens
GFTGDVKRREWSDAFESGIVSYVSSKEPGTEPVSPPCHPQTPRQTIDTHTPGHPHVTRVSPTDTRPPCQPQIHGPRVSHRYTAPRVTRVSPTDTRPPCHPRVTHRYMAPVSATDTSAPRVSHRYTDPRVNRVSPTDKRPPCYPRVTPNTAT

SEQ ID NO: 1023134 - protein, 117 aa, Homo sapiens
MAMINFNRQGAGRTKSNPTSKNHSIFINRTHRMNDSSIAIQHNHNNLKPTNLHHNNTSNIHTINPQLSNHNFIPIPYMKQDTHHHKPNNSNPTLNRRPASTIRIYTKMNNHSRNNKK

SEQ ID NO: 1023135 - protein, 82 aa, Homo sapiens
DTHTDENTSCDALYDAELSQMQTHISDTPVAAIHGQQPQTVTCDSIIAEVKGPIRGDCSEEPELKADIQIPDQFIGAVGHSS

SEQ ID NO: 1023136 - protein, 69 aa, Homo sapiens
MRMRTPSTPEPSYALEFHAYLMLNALYFISSRGPCILNIILEFIRKYKALRKYKALRKYKREGILKVTA

SEQ ID NO: 1023137 - protein, 333 aa, Homo sapiens
LHCQTQACPPLSWPQRHGHPSGYSRAIQFLHQDSPSLIHGDIKSSNVLLDERLTPKLGDFGLARFSRFAGSSPSQSSMVARTQTVRGTLAYLPEEYIKTGRLAVDTDTFSFGVVVLETLAGQRAVKTHGARTKYLKDLVEEEAEEAGGGFEKHPEHTASRSGCRCPGLLPSPLQIYKKHLGPPGTRGPCTTMRLGLGAWAQLACCLPCTCRAQKGGPPMTPVCTETARRSCMAVGGVGLPWAFGRPPCCIPPFPGRRPSYRCPALVRAPQWGLLHVQPLGSANQEPSAQGSQSSLQRGPKQPVDEYDESLSGLSAALCSWHLNSKLASGTRNP

SEQ ID NO: 1023138 - protein, 309 aa, Homo sapiens
LHCQTQACPPLSWPQRHGHPSGYSRAIQFLHQDSPSLIHGDIKSSNVLLDERLTPKLGDFGLARFSRFAGSSPSQSSMVARTQTVRGTLAYLPEEYIKTGRLAVDTDHLQLWGDLVEEEAEEAGGGFEKHPEHTASRSGCRCPGLLPSPLQIYKKHHGPPGTRGPCPTMRLGLGAWAQLACCLPCTCRAQKGGPPMTPVCTETARRSCMAVGGVGLPWAFGRPPCCIPPFPGRRPSYRCPALVRAPQWGLLHVQPLGSANQEPSAQGSQSSLQRGPKQPVDEYDESLSGLSAALCSWHLNSKLASGTRN

SEQ ID NO: 1023139 - protein, 67 aa, Homo sapiens
DKDEFAPGSSLKIMITHRLRPGICYDESDRNKDEKLTKEQILENWNMFVGTQATHYGEDLTTTHDEL

SEQ ID NO: 1023140 - protein, 59 aa, Homo sapiens
AGHVSLSLVAAPPCCGQGYLPVNEFFGFTADLRSNTGVQAFPQCVFDHWQILPGDPLNS

SEQ ID NO: 1023141 - protein, 302 aa, Homo sapiens
GCRRRETKMAARVGAFLKNAWDKEPVLCSVLSSSGASNSADDTTPEVCSMMTRTASKRAHSMTNPLLPPPGPRYLCKFLEFMPPLSPLHSSISDHDQQGHAPTTTQCPSVTDGNMPDVPSHPQEPQGPERMEWREDTVSTSTDRGGSSQGFPLKQCENLIINPPVGNAQEREGLNVGEQNPKEASQTCWARIWENTVGTNIPAGAADPGMNMLSLHSLRKTVAYRGLAAPTKKHAADGLPLGHREQGRTANYQGPQAINITRGGGDHFWGANTSPRPDSLPPRSHQYHPLFGDTPRATTVED

SEQ ID NO: 1023142 - protein, 261 aa, Homo sapiens
LSPPGDKDGCESRRLPQEVPGTRSQCLCSVLSSSGASLEFMPPLSPLHSSISGHDQQGHAPTTTQCPSVTDGNMPDVPSHPQEPQGPERMEWREDTVSTSTDRGGSSQGFPLKQCENLIINPPVGNAQEREGLNVGEQIQKKLLRRAGRGSGKTQWGLTYLQGPLTPVMNMLSLHSLRKTVAYRGLAAPTKKHAADGLPLGHREQGRTANYQGPQAINITRGGGDHFWGANTSPRPDSLPPRSHQYHPLFGDTPRATTVED

SEQ ID NO: 1023143 - protein, 83 aa, Homo sapiens
TRETVATSQDAPGTVQHEQQLTLRAQPEVKTPLTANITRIRKHIPARGPPAAAAVGGAGHVLGKRPHDLSGSTQCLRHPASFA

SEQ ID NO: 1023144 - protein, 171 aa, Homo sapiens
MATNWGSLLQDKQQLEELARQAVDRALAEGVLLRTSQEPTSSEVVSYAPFTLFPYMVPSCPVEQAYACARMDFNLLVDAVSKKRCFLEQTLSSTIKQDDFTVVSLTFHKQVLKEGIAQTVFLGLKSSDFMFQRRRKMAPQALKTDRNQTPSLQLGGLAPGPQCARIVSVSG

SEQ ID NO: 1023145 - protein, 120 aa, Homo sapiens
MPSVLLSAARALPACCAVVSPATDLPAGTPESAAPPGPNTGQTRRGANGTPERDPAKERIQRILGDGDRQRHHRAETYGEAQKQGRAELECTESDTNAKETQKQAHGNTIADRDDQGAGS

SEQ ID NO: 1023146 - protein, 46 aa, Homo sapiens
MRTDKGCHIVGYFSKEKESADAYNVACILTLPQYQRKGYGRLLIQF

SEQ ID NO: 1023147 - protein, 123 aa, Homo sapiens
LGASNIIVCDVDEKRIAAREHPPGNEMYTRRLRLVFEIDGQRGSGTWCRNLCLLSKMFLDHKTLYYDVDPFLFYVMTMRTDKGCHIVGYFSKEKESADAYNVACILTLPQYQRKGYGRLLIQF

SEQ ID NO: 1023148 - protein, 70 aa, Homo sapiens
MSRYAREEYGALVLAQRCEEEPQRAPVEPFDHRIGTALQRVHVRGAPHVDARAQRREQRVIATRIEALRP

SEQ ID NO: 1023149 - protein, 196 aa, Homo sapiens
MGLELKCETWVAWRQVTILVSSSSFYPSGFVTTGPLLSSVNMPKNDCHACGGFSPVFFHPSPLLTVTPALWQGTVAAVCSCHVPRPCGAGRLACISLSTYSDATRISGTEFNQYPGEKLLLLQSFGYANLICPNHPKTTISDVTLPCDRLIRFPGTGLFLELQPRHLCLLAPLSLSFDAAVTHRAERRMSRGPALD

SEQ ID NO: 1023150 - protein, 80 aa, Homo sapiens
MPPTSAACTSLGVSRPSLREAIQQLNSQGVLISRRGDGTYIQQLPEQWPQQLIVNPISNLIEEDPLYRFDVQEARWALVG

SEQ ID NO: 1023151 - protein, 49 aa, Homo sapiens
KRSIAFLHSSTATRGLLLGYQHDDIGVVRLILPGPDNLDAEIATGRRMP

SEQ ID NO: 1023152 - protein, 137 aa, Homo sapiens
GGSMRIFDSEEILAGYKRERIDPTPYYWYTDQRKYGHVPIGGYGLGLERFLTWILNRYHIRDVCLYPRFVQRLHAISHFLQKHGATDYEHGTGSLQKKDKESRDNLPFFHVPCGVSLSCYTLSTTIENYLKITLNIK

SEQ ID NO: 1023153 - protein, 50 aa, Homo sapiens
MISSSIRRVCVELPPTAKMHAIIERTASFVCRQGAQVEVVVEAQKVKLGV

SEQ ID NO: 1023154 - protein, 100 aa, Homo sapiens
IPRCHLCVRAQYAQTMAYNITPLRRATVECVKDQFGFINYEVGDSKKLFCHVKEVQDGIELQAGDEVEFSVILNQRTGKCSACNVWRVCEGPQGCCSSST

SEQ ID NO: 1023155 - protein, 37 aa, Homo sapiens
FKWSTSSLEMLRAAVAGLCCALILGLWVVLEVQPDSP

SEQ ID NO: 1023156 - protein, 45 aa, Homo sapiens
SATSTNSPGDTETHFLPDDTINLRPRGGIYTHPHSTGYTLFVEVA

SEQ ID NO: 1023157 - protein, 58 aa, Homo sapiens
MGELGSQVLTLVHGWAGTTDGAPFSIPLTRQGVRAPGGGRGEKGAAFSRTNPHSNSPR

SEQ ID NO: 1023158 - protein, 136 aa, Homo sapiens
ITGSYYAQTLLRMMEALCSKGLQCCRHFLGPFPRSVPRHNPVSEVYGQFFRPHGLVFALTCTVNCGTLYRQVCASPNHVKSIECTTGGLQSSCQNISRMINGNRMHLRSILSLIAKGQNNYVKKFSFFYTFVKKNK

SEQ ID NO: 1023159 - protein, 126 aa, Homo sapiens
MRDGLTILIGISQDVVFYFFDVPGSSPGACVATCARTRWAPTSAAVPCASGSLLIAGHVKTSSECSSSPCSQECANVYGSYQCYCRRGYQLSDVDGVTCEDIDECALPTGGHICSYRCINIPGSFQ

SEQ ID NO: 1023160 - protein, 72 aa, Homo sapiens
FLLLAPSQDPETKKSRVKLPSGSRKVISLSQESCGSSVVAGDGRVDKPILKCWTGYHKYEAEAGSRKRQKQE

SEQ ID NO: 1023161 - protein, 188 aa, Homo sapiens
WGYGWSRTTSRNGFTAALVLPELPGIQTATLAEHRQGRFLWQEPRRVAGGASGHPPLSQGPRRPRLGAASCLKAPLLLCWAILRCFPSSATCFRSSKTSRCTWSTSRGSSRWRAAGSRGSRSTFCLSRVTSRFRSCTLSPSFLSASPEDTPAWTDPPADQLGQTLRLDQLQTLQSSLSRCGRAETQHE

SEQ ID NO: 1023162 - protein, 99 aa, Homo sapiens
HQLFTLLGVLGHQLQGFLQQQACFAQLLMLQGTLLFQLSQFFLQAPAAQFDLLGAGTAGRQAGIEFAMQAVFFLAAAEQLFALLFQAQLLLAQGLGYRA

SEQ ID NO: 1023163 - protein, 55 aa, Homo sapiens
MLLVLGYRFFKLLVVSWPASAPMGLEHSVLKSLDNRNGLDGTSLLKPGQADLSKP

SEQ ID NO: 1023164 - protein, 94 aa, Homo sapiens
QESMDVRQEGAGVALHPHSLQKLKIPKRRICGERGDKEEWFGPASGPTVCLGVVRKMTTDGRRAHSQGPAHHVFVALIEPNLADRDASEEEVKA

SEQ ID NO: 1023165 - protein, 139 aa, Homo sapiens
RVHIGRRWIKVQRKELTSQLTPHTHLATMDIAIHHPWIRRPFFPFHSPSRLFDQFFGEHLESDLFPTSTSLSPFYLRAPSFLWGTQRGVLTLGSHADAPGEGGVRSVLSWLCVTAFPPEEELKVKGVGDDVIEVAMETH

SEQ ID NO: 1023166 - protein, 115 aa, Homo sapiens
MRQKRPKLSRNSLGHSLPPIKAGALMMMAAAALGISRPPGAGPPVLRAQKEGERTFVSSSGLSQGPASPYHPPPLFPPSPQPPDSTPRQPEASFDHHHRDHIPSTPSLVVYGSSR

SEQ ID NO: 1023167 - protein, 113 aa, Homo sapiens
MRQKRPKLSRNSLGHSLPPIKAGALMMMAAAALGISRPPGAGPPVLRAQKEGERTFVSSSGLSQGPASPYHPPPLFPPSPQPPDSTPRQPEASFEPHPSVTPTGYHAPMERPK

SEQ ID NO: 1023168 - protein, 55 aa, Homo sapiens
GAENLVGAENLVGAENLVGAGKPSGGSEKGRTPGPLIPSPCSFFFRFYETEVLAI

SEQ ID NO: 1023169 - protein, 31 aa, Homo sapiens
MYQYRNENYCMCSLIWQKQEAVEAGCGRSRK

SEQ ID NO: 1023170 - protein, 36 aa, Homo sapiens
RHPSAMRTKWWHGDPLCGRGRVLVSGDSHGPVFPFM

SEQ ID NO: 1023171 - protein, 76 aa, Homo sapiens
SVGHHCEEAREKYGKDFKDIRQDFLPGKSLTIIIEYYYMWKTTDRYVQQKRLKAAEAESKLKQVYIPTYSKPNPNQ

SEQ ID NO: 1023172 - protein, 315 aa, Homo sapiens
MACLTSRPRQLCLPPVPACCHFCLPPSRRATWPASVPACATWPASVPPRHLACLRPAAPLRLPPSPDPPRHACGRLGACRSRPLPPAAQERDRLSRVRRTGSCSTWGRSNNILLLQASGQDDSALGYRNPVGITGMPGALQPEQIELPSADNQTCVSGKVSSEELLWFITRDSTNANELSSKGRENLVMPMDPETFWTAWDSPPENNRDLGPVYGFQWRHFGAEYQRYGITIIQDRQSTTANEVIDTIKTNPDDLKNHHVRLEIHRDLPLMALLPCHVLCQFLIVVEPVSLYCQLYQRSGRHGPSVMLSTSPGYA

SEQ ID NO: 1023173 - protein, 123 aa, Homo sapiens
MSCRRSALTLLPKKGDLCELKNWRPVALLCADYKIFAKGLSNRLKSHLDSTVHGDQTYCVPGRSIKDNLFLIRYMLDCSRGSNVNFGLVSLDQEKAFDRVDHEYLFNVMSVLEFGALRGYPAR

SEQ ID NO: 1023174 - protein, 110 aa, Homo sapiens
YLTPQTHPHTFPSASRRPSTKVSFHPLSPLSAIHKANAQWQAVKDCVKSVFRGCVSDNVKRTKAHQLEWTTVAITPQSRSVSRAPEGLQLQLEKKSLRFLLALSLRARWC

SEQ ID NO: 1023175 - protein, 84 aa, Homo sapiens
PTVRLLDSDSFRLLVEQDAQYTSAVAHGAIVADLGTAQAHQQRAARIVELKRNYGLNVNPHSHNGKASAPPMSVKPEGKAQCRN

SEQ ID NO: 1023176 - protein, 85 aa, Homo sapiens
FINEHFAEVIYSDLSYAPNSNIRSFNLNHKLTGRIRMDKDGGCGEPMFQFHKGSVDRWRPCERYLGRDECREEGRQGDVTPNERR

SEQ ID NO: 1023177 - protein, 102 aa, Homo sapiens
MHRLVKKEDIQTSPALSPSLECSSAIIAHCHLEAGVKQSSSISLQSSWDYLRGPPHPANLCGFSFVFRSGFPSGAVAQACNPSTLEGRGGRITRGRRPACTT

SEQ ID NO: 1023178 - protein, 48 aa, Homo sapiens
MKVDNLDVLMLCQPTRYSGKLVVVQVKLPQMRRVGQRAIVNSRDAVET

SEQ ID NO: 1023179 - protein, 53 aa, Homo sapiens
MVFIELAPGLEAGPAIQWISSQQERSYRDRTGRVTVHPFISCASAIIWLQIYN

SEQ ID NO: 1023180 - protein, 139 aa, Homo sapiens
MATVVGKRPQTRKLATSPRAAMGPPRLESDLVQEGWTRDFARLFSELQRPLWPPLREKPSAHTHRLHIPTTFAPCPGTLSRHCNHKMVFIELAPGLEAGPAMSVISSQQERSYRDRTGRVTVHPFISCASAIIWLQIYN

SEQ ID NO: 1023181 - protein, 295 aa, Homo sapiens
RVMRAHDRWILPCFPGRWLVVRAWRALPWRMEFGGGRGLLSPPMGQSGLREVDPPMGPATSDMNMNVNMNMNMNLNVQMTPQQQMLMSQKMRGPGDLMGPQGLSPEEMARVRAQNSSGVMGGPQKMLMPSQFPNQGQQGFSGGQGPYQAMSQDMGNTQDMFSPDQSSMPMSNVGTTRLSHMPLPPASNPPGTVHSAPNRGLGRRPSDLTISINQMGSPGMGHLKSPTLSQVHSPLVTSPSANLKSPQTPSQMVPLPSANPPGPLKSPLGPRLLPQCPFTHWLAQQAQVSFHGGAL

SEQ ID NO: 1023182 - protein, 219 aa, Homo sapiens
GDGDRTWGRLTDGPPIEAVERLTRHVLHLPTVFHHLPHLLAKESMSADPRVALWATGRTATMSGWLTWALPKRCVRECCYLATLYLISSVISLYLRCLSPRMVVRMELGHSWVLIVARHDLTVSLRHVTENIKALFPTEIHSGLLEVISPSPHFYPDFSRLRESFGDPKERVRWRNKQNLDYCFLMMYAQSKGIYNVQLEDDIVAKPNYLSTMKNFALQ

SEQ ID NO: 1023183 - protein, 80 aa, Homo sapiens
FIDCHICMCHSSTCESSTCESSACLSVVHVSVHMCVSVYMEGSVICMYESVICMSVSLSSTCMSWSSMSVVCVCISHPHV

SEQ ID NO: 1023184 - protein, 70 aa, Homo sapiens
LCEPQANEPLSPAQQPFGPCPIEIGLETSGRLIAEHLAHIMHSKTMYFFLLPFGTRKPGTGHFFKKQELA

SEQ ID NO: 1023185 - protein, 79 aa, Homo sapiens
DAVVITDPYYAHTPLMDYDGSQHGTIIKPYNAGECGHIERLVMAHINSIIPDTLDPLHTFLTDPEKTQSQLHSTLSSLN

SEQ ID NO: 1023186 - protein, 112 aa, Homo sapiens
VIRNRGLPVRSGITGRVVYRSRINNFQQFLRTPFQLQLGPPSERVRITTPLLAVISGSILSLHSVDCERIRGPRPTATEAKRDSRSHVGCVINQESGGGSRLLLVPIYVTYT

SEQ ID NO: 1023187 - protein, 117 aa, Homo sapiens
NLAPLFRETSFILAGLGKTLVLLLAYSINNFQQFLRTPFQLQLGPPSERVRITTPLLAVISGSILSLHSVDCERIRGPRPTATEAKRDSRSHVGCVINQESGGGSRLLLVPIYVTYT

SEQ ID NO: 1023188 - protein, 119 aa, Homo sapiens
ASCGIGQLGLSPGLKHHPNTICTMCLSQAMRSPRVVLCTSTSPTDPQPSSLAWTPCESACLFSRSHHTLNPLTTAQPSLLSTLVSFSSSEPSSQSDRLTAPAQASPFSTFQKPSSHFQP

SEQ ID NO: 1023189 - protein, 38 aa, Homo sapiens
CQAGLVVEIATYRELLEGEECRLNGEGIADKSHVSVVQ

SEQ ID NO: 1023190 - protein, 37 aa, Homo sapiens
ELGTTSSEFPDTTTRSFGPTLHDEPQHTIAGPPPKHP

SEQ ID NO: 1023191 - protein, 100 aa, Homo sapiens
MVKRCCLCRCCHHHCRQGKRKKDKTKRFPKRPKKQIVMTNPGSTRYSRSQSSRALSQEVMLAGACRLRLEGWSSNKTSDAIHSDPDRKAKSSQLQITSEF

SEQ ID NO: 1023192 - protein, 47 aa, Homo sapiens
GTADCTLAQQTYPGTADVPCAQQTVPWHSITYPGTADVPSYQIKTNP

SEQ ID NO: 1023193 - protein, 245 aa, Homo sapiens
SVGRAGTTRPTEPIAERDSAFRSTRQQGVDRAGIRYTGNRMLPCPAGRDLVGVFLSASPLLGIPGERWLVFPTGGPPWCTGYPCPVLAQCPLLGAKRGQEDPRALCAPPSENDGMTETFRCLCPREKRISSAFLPDRRVLTEDEMGPPEIGDAMSPAQGGPAVQVPCDRRVSPGCDGGSSIPGSWGSQWTARMLIVSSGLNCALVCGPCCKFHAGGDDIMVHPLPAGTNLGGSKSGRGWVPSMIL

SEQ ID NO: 1023194 - protein, 68 aa, Homo sapiens
SLGRDRVEIFIFKSRKIQVSWQGLKAWIGQTSDLSSKETSPGYIPACAYSADRPCEPTVPAQSVLPTT

SEQ ID NO: 1023195 - protein, 113 aa, Homo sapiens
MVSDHSEGTFERLRYSFGGDRPSQNSPSGIVPRPDNGCRLEIQQYRGGIPTATLHYLASMLLSLPPILYEYYRIAVPNWSKAPWGLSVLLRVTSIFTGTSIITGCIVETAYLG

SEQ ID NO: 1023196 - protein, 265 aa, Homo sapiens
MALSWVLTVLSLLPLLEAQIPLCANLVPVPITNATLDQITGKWFYIASAFRNEEYTSLRLHVQDNAYPYFLHLPSANQVQSDYVILSLRVGHQNLVPESMCSLIILLVYLACPSRRMQLGTSHPMHTAGHGQMIHCLLTLACSLQRTTDRRLDVLVSVPWHGMRRTGGCLSMLTSQETTQGATGRVLRSSRLLGQFPKSDVLYSRLETRISVSHWRKQHEKAEETGGGGNPSKDTALDSGHEHLGAILALQPDMCTSAFSPHLHQ

SEQ ID NO: 1023197 - protein, 220 aa, Homo sapiens
EHCLAPRASWSQYGAVLGSYSPEPPTSAGSPDPIVCQPSTGAHHQRHPGPDHWLSGFISHRPFETRSTIRSVQEIQANPSFTSPPNKTEDTIFLREYQEPDQDQCIYNSHPNLNVQRAQMVTISRYVGGQEHFAHLLILRDTKNYMLAFDVNDEKNWGLSVYADKPGDDPRSNWESSTKLSTAWAFPSQMSCTADRKQDKCEPLEKAAREGRGNRRRGES

SEQ ID NO: 1023198 - protein, 101 aa, Homo sapiens
PELLRMMMMGTRTHRAARLMMLGTRTHRAARLMMMGTRTLRAARLMMMGTRTHRAARLTMLGTRTHRAARLTMMGTRTHRAARLTMMGTRTLRAARIRSSC

SEQ ID NO: 1023199 - protein, 34 aa, Homo sapiens
MEGPGLPRGDCEGPMEDICSVLCHQGYRVSKFVS

SEQ ID NO: 1023200 - protein, 68 aa, Homo sapiens
VDQAEGTPLLQRHCRWLHESHWSLGQKVIEYKYTKTSRLAIIDVAPLVTLVPPDPGIAGFDVGPVCFL

SEQ ID NO: 1023201 - protein, 116 aa, Homo sapiens
YLERSVHRRVGGGNRLRWGCTPLVLVKSSVPEQHLQVAPPSWVGISSRDTAALVHVEVEAVALLAAADATLVGRGPVAAVAVLEHAGVPGQAQAIVADAGLPAVPHLPAARKLRLL

SEQ ID NO: 1023202 - protein, 119 aa, Homo sapiens
NALYFLAILSQRFILPQRSILSQGFILPQRFILSQRFILPLDSQVRPSSQRRKAENSKNQNASSPPKDHNSLPAREQNWTENEFDEWTEVGFRRWILTNLPELREHVLTNARKLTLKRG

SEQ ID NO: 1023203 - protein, 78 aa, Homo sapiens
RSRMNELGVWTCRIMTRLCGKSQEEVVAELQELVYQHPATGAWQTRDQYLSGNVKEKLSQAKIAAQQDPRYLANVSAL

SEQ ID NO: 1023204 - protein, 40 aa, Homo sapiens
YTAVSWLYASSPHAYEAGCARSPELGCLRVWDIQGLHLHP

SEQ ID NO: 1023205 - protein, 42 aa, Homo sapiens
SSSAPPDSLGVMTLAVYPGTFDPITLGHVDIVRRALTVFDRI

SEQ ID NO: 1023206 - protein, 126 aa, Homo sapiens
MQMCLQGMPCVWGCPSWKVTPFREAKILCFTLKTRREGCAEGMPFQAPRVMNLTAFKVSKKKLFSLILRRYFRPFPVWPGSLLGKDHRISLEFLLEWRQHWVGGNSIFKLVISCCVFGGGKVLFIP

SEQ ID NO: 1023207 - protein, 34 aa, Homo sapiens
HWLRKIIGGVDYKGVRDLLKVILEKILTIPNTVS

SEQ ID NO: 1023208 - protein, 109 aa, Homo sapiens
SSQSASAFFFFLLAPSYLLFCTFPAQPPPQPGSTATIPSLACCKYPQHCAPLSQLAENSPGESNSWTSLHLHTGCQELPEVLAQQPGWNHRAILNLGQALTAHLANPQV

SEQ ID NO: 1023209 - protein, 199 aa, Homo sapiens
MPGFQPAGQTSPCSSVWKAWTSRRASSTERARRQMISDLAKDTLAIDDKEAPVGNALICFQAVILRQAGHVSQGDVQGAQASALVRGLEPSQGGELRVHEAQHFTAQLAEVLCTVAERDDLGGAHKSVQRVEKEDHVLFVVRQLHLFEGAINHRCGLEVRGWLSDARVTGAMTESCVGKGYEARTIRVDPRSQRQVSTG

SEQ ID NO: 1023210 - protein, 96 aa, Homo sapiens
QIAADIPASGCFPCIGRKLGSNSIQAPGNNMVLLLAVTTSDALQEKVADGTCIYQGKTLGILLLRLAEQEVNELREFALETLQVTVAITSQTQCEL

SEQ ID NO: 1023211 - protein, 251 aa, Homo sapiens
RAVRLRRSGSCRRTERPRPRRAARPPRMPFSNSHNALKLRFPAEDEFPDLSAHNNHMAKVLTPELYSGAAAPRARRAASRLERQSIQTGVGATRATPYINDQWSCVAGDRRSPTKVFKGSLSTPHHRGPATAATKPSDEHKDLTLNPRTTLAGRATDLGPRTTLLELRGVRHRARRHHVSILHYPPALQADGEAHAHIRESSADGKPLSKPGTCEPERAWILTPLKKHDGARTQQQLHRRTTSSFDKPVSP

SEQ ID NO: 1023212 - protein, 288 aa, Homo sapiens
SGLFACVAPGAADGRSAPGPAEASTPGGGDRPSVYEHSTKAPGRLALCSRARVDRCSRETSDSPYKTSQNWPNGWVDVTYAYQRRDAVDSAKGNDRPHDEAVKRLANRTDSLPKDQCGRKGTKHRPSWLVTHANSNTAGALVLGRGRTEVRSLARARCFETLIAESPVGSKVMPRLQGVLTKVTRSTRTQPRDTGHIHVHVNDTLVRVSCCTSIFGYNRDTNPSARNLRSGSQTKRKRSTIRIDYTLCALTVTCIYLLVERKAKPPIRGNCILGEVTDQETGTQRRFR

SEQ ID NO: 1023213 - protein, 102 aa, Homo sapiens
MSIRKSLYPGTVQTGLRRTYIRPIRRVERSLISTACLLHAYETHMTSCERVGEPDDVVKLRQGPNRLVSQECSGVGLQDLSRGQVILYPLNLTLNIARNNGF

SEQ ID NO: 1023214 - protein, 113 aa, Homo sapiens
AGCSPASLRELPTDGAPPAPPRRYDAQERTVLEGTCKLVLILEPPTLVWVYFHAKVETSQHNCQLIRVNAEPHPRCYVSSFTDTERLIGDRRKGIIVASGCPNKREFRDVKKC

SEQ ID NO: 1023215 - protein, 59 aa, Homo sapiens
PEWRNEDKKQMYAKMARQGHSHVTNYVTRVIKTKEDDAGNKDQFQDEIIDVEKDGQEIG

SEQ ID NO: 1023216 - protein, 141 aa, Homo sapiens
CAWNSVLVRSELRRRVAESTGGPGQCMSLVTWCTNPEDPVDSGLGEAEVTLGEAVVEAGEVHPCKGACNHNIDYAFWVAAGTKGTEGQWRTCHVSKGLVSRLQRREQSCWGYGRSNDLFSPVMSILNHDISGQSVHLVKGA

SEQ ID NO: 1023217 - protein, 141 aa, Homo sapiens
VFIDATSVYRCHWCLSMPLVFIDATGVFDATGVYRCHWCLSMPLGVYRCHWCLSMPLVFIDATGVYRCHLVFIDATLPSQPGPRTGGSVRVWCLEKVVCSPGIVREADNLVKVSRPNKGTRQVGITKKESLKRVLRCIRYT

SEQ ID NO: 1023218 - protein, 78 aa, Homo sapiens
VFIDATSVYRCHWCLSMPLVFIDATGVFDATGVYRCHWCLSMPLGVYRCHWCLSMPLVFIDATGVYRCHLVFIDATTS

SEQ ID NO: 1023219 - protein, 267 aa, Homo sapiens
MKPNIILCTFPCSSSVEKQAAVMGPTKVDQKGRLPSDISQFPQGPKGPALFWDKKASNKWNPKADLFIFNTLYHVRCQGLMTSPDKVSNSDLELPYIRDGTNITKRSLGGKVNQVAPILNQERQSTMHNFKRSFSQGTLYTIQGGQQLIVGTQTSFSRSRRIAHLDTGISSHIFKHQKKGCGVTGTKVKTNFPSTGCTTKGQTHTCGSQSSYVLQDLCTKLVSIHQQNNCCALQTISRFTTLPGDLPTILLVLTAVEEGNIFQRCKA

SEQ ID NO: 1023220 - protein, 43 aa, Homo sapiens
SGGLPGNCEVWGEDEEEDSPLGVRGQLPLPCTVTERHAPPGPP

SEQ ID NO: 1023221 - protein, 56 aa, Homo sapiens
LGTPSATTLVTEAALRCQSWQCCLIPVPSAGGATSQELAQDMSERLNIATTLQMHL

SEQ ID NO: 1023222 - protein, 34 aa, Homo sapiens
MSAITLPLILSGIFRELHGSRDSILCQCRRHWWE

SEQ ID NO: 1023223 - protein, 52 aa, Homo sapiens
VLSSSTPIASSPPHHTPYRRSIRALRLRRFDSYCLSKEETPDSKAVKTLASH

SEQ ID NO: 1023224 - protein, 43 aa, Homo sapiens
CGDRVLLDCDIDAVMHKVVLVAVLIHGPVVHLEGVTVHVFTIE

SEQ ID NO: 1023225 - protein, 106 aa, Homo sapiens
HHVVKRCKHLQTGFLVRVFNWDKHSGCGGCWAIGTCPYFVRNSPHAVFHTLRAMSHPHGHWMRFPGAAVRPACGVEFAVFSVSVGVQCWHTVLVSSVDTRYWGLLF

SEQ ID NO: 1023226 - protein, 49 aa, Homo sapiens
CSGHYPLGSYDSFDAPSDYIITEKTDLASRRRTVRGYGFVAPRGPRTQD

SEQ ID NO: 1023227 - protein, 57 aa, Homo sapiens
LTHTHTPNTHTCLVLGTPHNPGSLISRVSGRACHQPEHRPCDDTVERIRLPAPAADT

SEQ ID NO: 1023228 - protein, 122 aa, Homo sapiens
LVPPSFSNAPLVPFPTRFSTVRLEHHRDSPKCPLPLQELSKHPQSEHSKQHSPGATFQPWGLCTAVLFTWPALPPEREKRPSLVVPSKLHPSLTLLPAVSLLCSPNMHSTLFPLSTVCLSNY

SEQ ID NO: 1023229 - protein, 85 aa, Homo sapiens
CGGPLLGLFARRLWLLAGWLVVSSATACHVLLLAAWLMRFCRSSDPLRFLQPMPARSMSHKACLERRLNAGISTIKLCVDLEIGQ

SEQ ID NO: 1023230 - protein, 68 aa, Homo sapiens
HERQYPLEFSQLKVLRREAEFTTTSLCEVQPFTTAPSGARRRKVLGGASLRPRTQLTVDPVTFNAPKS

SEQ ID NO: 1023231 - protein, 44 aa, Homo sapiens
ELPPPGTQALMRDPSSFKVWLTGTELIEAHSTEMCPRAVEYMFL

SEQ ID NO: 1023232 - protein, 35 aa, Homo sapiens
IRSQGLACNVYCSGRETIATKASITTRANLLLLTQ

SEQ ID NO: 1023233 - protein, 121 aa, Homo sapiens
RSRGSYAGAGAEGEEIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKERVPRS

SEQ ID NO: 1023234 - protein, 113 aa, Homo sapiens
LSIEIQELLLVILMLEHLGVASCDPDSGDLGVASCDPDSGDLGVASCDPDSGDLGVASCDPDSGDLGVASCDPDSGDLGVASCDPDSGDLGAASCDPDSGDLVAVSVSRSRNC

SEQ ID NO: 1023235 - protein, 138 aa, Homo sapiens
KAPALWDGGFFGWSGVTSTAFSGAAVMVVLCDSAPLQGTRSLGRVPPGFSGILGVTSQPSTCSWTSQADSGQASEGSGQNVENVGGLWRVPWEGQDRATDSHFPCDARRQKVSAWLGFCGVKMDFCHWDYYHYDGVDV

SEQ ID NO: 1023236 - protein, 279 aa, Homo sapiens
VLGDQWLSNGHPGIVMPLGARTVSHMIQGHVPAWPYPRDPMEMNRAVVAKKYNMRVEDYEPLPRHDGRWGMAIYREDSLTAHSMRGDPWKYLGPCRALKVRTEECDRCNWHAYDMYRTGTDVGIHPPTPGFLDIVHVYAAPRFPGFHDIHCWVGDVYPVYQPVGPKQYPYNNLYLERGGDPVQRTSSGWFTMRSEEASWAFGPLTGLPHSYEQFYSPCKLEEFPPLDYRERSRVAWWTRAAIDQQVRLPRHQPISTHNRANRRGAALGASERAPAAGGL

SEQ ID NO: 1023237 - protein, 194 aa, Homo sapiens
TSARPKDKRHVWFGESMTDGFQFEYGVPGLRIPADVAIQLTFLRLMSTEASPELRPYHCKNSGGLHGTSMTGNPQVRSLLLQGSNEIEIRAEGNSRFTYSSHCRWLHESHPEPGAKTVIEYKTIQDLPACPSSMWPSLDVGAPDQEFGFDVGPVCFHVNSLHPNLAPLPPNQLSPPTRIQTSNPNLNPSHIAKL

SEQ ID NO: 1023238 - protein, 142 aa, Homo sapiens
NCLYQQVMSTNPQRRAAGQGVLCCCEGENGGCWDLAGEQEGMRKESRRSQKGGFTGARAEAGGVGCSARELCVRPFSGSSRNSVTPGFVQFQSGKFRFRGCYPSKLFFPSRGMLAGSATFSCTEGRIVVYPGALPQLRTIVG

SEQ ID NO: 1023239 - protein, 53 aa, Homo sapiens
MSVPKATPTACDEGSELVLVEAALPTSTSHLSCKHHTAHPTPHTYTTYTNTTP

SEQ ID NO: 1023240 - protein, 158 aa, Homo sapiens
MEAEPGLFLLCVMEGCEQTKAREQRMETGPGLFLMCVMEVCEQSKGRGRGMEAQLHVTVSCVHDGRLRAEQEFHRFWVQTGMPLPGGEGKVVVVTDSLVALGGGCWILGGSEGTPAPALSFLRAARHFLGASWEDHGCGPTNAHLGMAQGATVQRGAE

SEQ ID NO: 1023241 - protein, 47 aa, Homo sapiens
LGTLFAFHWDSCPIVKRIPPSVHDTEGLPFMKHGCVFSAHRRMNDML

SEQ ID NO: 1023242 - protein, 120 aa, Homo sapiens
SSRSPVQYWMCWINGKSDCALTGAQLGCQDLCLTLLAEELSGCFPSSWESGRPFFFFLGRTLQAFSLSKEDVLQCWGDVPPVGCGWAASHIQRRRGQFVLGHRDLPHGVPKTNRSQFFQK

SEQ ID NO: 1023243 - protein, 43 aa, Homo sapiens
ERRALRKLQALLVEASCRQGRKEALTLPSCHGTIYCSLQLCCA

SEQ ID NO: 1023244 - protein, 90 aa, Homo sapiens
SSVPCRSRAPRRSGRCDTRNLQKLPPAGLLQLLLAPGRRGAEQAAHGAVYAQFLQYFQFPFGFHHLGDQRQVDAVGGAENRFDEQPLVAF

SEQ ID NO: 1023245 - protein, 107 aa, Homo sapiens
MTPFWRPHQLQNQFLALTSFFFGNAVFLQGPHECFLLLHGREAAMAKLGGGANELKANFLQSPPFRLHQQGLAGGDHPLLGSHHTAFQHDKVMWHFTIGDKATQRVD

SEQ ID NO: 1023246 - protein, 100 aa, Homo sapiens
NEEYEVSLEIIMQITDIIGTVVCEDLSSCYELRSVFCFSLEIPRYLLNRLYRMIKLGLGIDEDEPTADDTSAAVTEELPPLARTTDRPTHAWTTRTTYTL

SEQ ID NO: 1023247 - protein, 56 aa, Homo sapiens
QLVPTVLEEDEKKRCLGVHNSSETCGLPTLVQTYVLQCGPEVAVTYPITCKSGGLA

SEQ ID NO: 1023248 - protein, 108 aa, Homo sapiens
SRGSWVMGVRVVLCVECTGGTTHTESISSPRGTTSTLHTTVESTPSPTTTTSFTTSTMARGTTFIHCINYRQRSDHLSQLYSHISPETTTLTLQLTFLQYLPREPVQT

SEQ ID NO: 1023249 - protein, 222 aa, Homo sapiens
MIHNCHHLSSHYVGTMGTSTSMISSTVSTGIPTSQPTTITPSSVGISGSLPMMTDLTSVYTVSSMSARPTTVIPSSPTVQNTEISISVSMTSATTPSGGPTFTSTENTPTRALLTSFPMTHSFSSSMSESSAGTTHTESISSPRGTTSTLHTTVESTPSPTTTTSFTTSTMARGSTFIHCINYRQRSDHLSQLYSHIPLKTTTLTLQLTFLQYLPREPVQTL

SEQ ID NO: 1023250 - protein, 98 aa, Homo sapiens
MVRRGSVPARARTWTRLLIGDSRGKDSYETSQLDDQSAETHSHKQSRLYKRKANDESNEHSDVIDSQELSKVSREFHSHEFHSHEDMLVVDPTPQRER

SEQ ID NO: 1023251 - protein, 145 aa, Homo sapiens
SDGCGYPGGAVSLMPRGRTTGIVLDSGDGVTQQVSPFYEGYALSPCHRCVWISAGPTSHTTCMKDPGLTRGYSFVYYVLRREDCPVTSRTKLCLCSSGTLHNEMATAASSSSLDKSYELPDGHVITIGHERCRCPETLFQPSFIG

SEQ ID NO: 1023252 - protein, 177 aa, Homo sapiens
GPAYWAYGGVAVPLWLPVEWSVPPWPSVELSVPVAISECPCVCAHLCMSAVCVCLLVYHCVSVRECAHLCMSVSVRVPVTVSVSVCVCVPVLVYLCVHVCTCQCICVLHVSVCACLVACACMCAFVSAFLCIWMGICVCACVCVCASVGLPVRVSLRVHTDTRASPNRWTRLGTHYG

SEQ ID NO: 1023253 - protein, 53 aa, Homo sapiens
AALTCDDGKSRRVMKAHDSKMLTCRVFLSTCISFLKAWACSAVGWTHLSTFTH

SEQ ID NO: 1023254 - protein, 51 aa, Homo sapiens
PPYAWGHFQILGHRRSSKMDPQCTMGLSNIPFVMAFLLSGAAPLKIQAYFN

SEQ ID NO: 1023255 - protein, 116 aa, Homo sapiens
FYKKTYISFLRVKHSSYFLSDDKNQLLTELVTPVSLTLSLKTMTSHLRPFPAPGIHHSTLCFYQFNFFRFPMSVRSDCVCLSVPGLFLSLFFCVCETIVLYCPGCRPVLPSPLTAA

SEQ ID NO: 1023256 - protein, 51 aa, Homo sapiens
MEMALPHRQFGRCGPRRAGGTWPVKATAASAGRQACVHNAAIRRWFRSPGT

SEQ ID NO: 1023257 - protein, 186 aa, Homo sapiens
SRYRRSLCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECESRT

SEQ ID NO: 1023258 - protein, 105 aa, Homo sapiens
LLAEQIPPTPRQSCFLSPMAGVPVSRSCAHCNLCLPGSSDSPASTSRVGGITGTRHHTRLIFVFLVEMRFHHAGQAGLQLLTSSDPPASASQSAGITGVSYHTQP

SEQ ID NO: 1023259 - protein, 99 aa, Homo sapiens
RTLYLAVIAGEHSIGVEAKGVSHSGADRKENVGISKDKAGEKPARRKIKVFLSYANQLRVSRGLTHTREGEVDVQQVNIPVTINLIKVTERDNYRVLTE

SEQ ID NO: 1023260 - protein, 197 aa, Homo sapiens
MNDGPQLNDGPQLNDGPQLNDGPQLNDGPQLNDGPQLNDGPQLNDGPQLNDGPQLNDGPQLNDGPQLNDGPQLNDGPQAQRWSSAVLRESGELGERVEPARVVQVSGSGQAGNGEKWIAGVQGRGGGVAVRAFLLSGSSGSVINLEEPRTISFSESRSMTGTVAYNFDLALCRALPSSSEIDRVLCQLRVQVSAAVS

SEQ ID NO: 1023261 - protein, 196 aa, Homo sapiens
RWSSRARWSSAHDGPQLNDGPQLNDGPQLNDGPQLNDGPQLNDGPQLNDGPQLNDGPQLNDGPQLNDGPQLNDGPQAQRWSSAVLRESGELGERVEPARVVQVSGSGQAGNGEKWIAGVQGRGGGVAVRAFLLSGSSGSVINLEEPRTISFSESRSMTGTVAYNFDLALCRALPSSSEIHRVLCQLRVQVSAAVSL

SEQ ID NO: 1023262 - protein, 129 aa, Homo sapiens
RWSSSSRWSSAHDGPQLNDGPQLNDGPQLKSLSLCSLFFFGKSVSALLLRRECRGHNHGSRYPQPPQARDDPPASTSRVAGRRSYATIAGLFLVFFGTDGVSLCSPGCSRSSGFKLSAYLSLPKCWLFG

SEQ ID NO: 1023263 - protein, 96 aa, Homo sapiens
RWSSRARWSSAHDGPQLNDGPQLNDGPQLTWGAEVWRIVLNLGRQRLQEAKIAPLHSSLGDRVDSISKKKKNESGLVVNTWLVPAYRNKAEEWMIV

SEQ ID NO: 1023264 - protein, 94 aa, Homo sapiens
MNDGPQLNDGPQLNDGPQLNDGPQLNDGPQLNDGPQLNDGPQLNDGPQLNDGPQLNDGPQLNDGPQLNDGPQLNDELRTIVDLKDLVETPQEID

SEQ ID NO: 1023265 - protein, 46 aa, Homo sapiens
PSVLRSVSPTSPFWGLLTRRHRGANPPGVRVHSLHAAMFCLPTHVA

SEQ ID NO: 1023266 - protein, 42 aa, Homo sapiens
MTCQLLLQLRDHAFQLPFLALSCAAESPAAARSPPILRLQVL

SEQ ID NO: 1023267 - protein, 264 aa, Homo sapiens
AAFAPGGAPGADSARERGPQEQGECMTTCPHVVYIKEDNVGESFTQDATLLSRDTQQDNSGALASFEGTDAQIPSLQSLLETLKVFEEMMMKSKFWLAGEITHMIREATGACSDARPELRHSVMTGSCQSHLNAVESEQAETALRRFARLCQDESAGYGTELANHARRNLRARLQQLCGLKWQARRSKHLEFMNQLNSTTDDDISPSEDKDTDSTKEPLDDLFPNDEDDPGQGIQRQHSSAGAAAQQGGYEIPARLRTLHNLVD

SEQ ID NO: 1023268 - protein, 101 aa, Homo sapiens
SIRWGHKIYFINSFNRYLPSVCDVPGAGSSPGSEQNQTQTLPKWHRVVSWEASYQSKNHVTRGTAVTMVDVVLGVCKSGDPEGFPWEVMTERRDEGKVKSK

SEQ ID NO: 1023269 - protein, 35 aa, Homo sapiens
HRLQQSRLSGGASSHPGLTGSASTTTLTRAAVSRY

SEQ ID NO: 1023270 - protein, 35 aa, Homo sapiens
MTMLGKRPHMIWRSLTHTATTILHTEPLPCFIHKN

SEQ ID NO: 1023271 - protein, 40 aa, Homo sapiens
YTLQSFGEMADSFKADYFNMPVHMVPTELVEKEFCGHHMR

SEQ ID NO: 1023272 - protein, 92 aa, Homo sapiens
CGQRGGLRAGAGGWGRPKLIPSLADLTSRTFWPLVSLSVNWGRQYPPCGMSEGLASKWTTHGPSGQEDQRAGEEGQVGSLKGHSEAPGLPDL

SEQ ID NO: 1023273 - protein, 121 aa, Homo sapiens
MANFNVQTNYMRIKCRLRFNGSGKRHEILRFYQASHLPSLVTEIQGATRQLEMNNVVNRNKLLESEARHQISRGLHNFFNFTREQIETTECSNENYGLTSGLTFESSQKSLIKERGFTSHG

SEQ ID NO: 1023274 - protein, 40 aa, Homo sapiens
LYCYSTNRRKAYSERRIMGYSMQEMHEVVSNVQEYREFVE

SEQ ID NO: 1023275 - protein, 227 aa, Homo sapiens
SLALSTDLRTHSQDKLFSLSVFHHWQMVPGDPLDRCMSSGPRSAYSSRLLIWLREFTDHKPVVGRALIEDVSISKFFDDPMFAGTWQTGCCAQLPHVSAWTPGSSCSLQWAADSCEIYTLETSSIDVALSCCQTSVWEAAVASLEQSTILQPRATSERGAVGPSVSSFCGLCRAPLPTGNREELGLTERDGDETPRGPYSLGFTWNSIFYKLTLATGCRVSKNVLNK

SEQ ID NO: 1023276 - protein, 54 aa, Homo sapiens
SNILEDKEEVHYLFVPLCQTPTPEPAEVETRKVVLMQCNIESVEEGVNVALHQQ

SEQ ID NO: 1023277 - protein, 142 aa, Homo sapiens
RGIPLGRTLCSFNFLHLRISPHQQVGHAPAPPTPAPEPCRLLSPMPPARPPPPVLSAYRRSFCYCSISSGGCDCCASSITNAWFSSSSTGAGIILSHLSRISWVLPNAHAHGLIILMRLASIICHIHQCITESWTGSIPWTP

SEQ ID NO: 1023278 - protein, 79 aa, Homo sapiens
ISARYPVVRQEQIPADRARESDEDRDGVSVVTAHRIKGREFDVVAVCGLEEGNWPAGNHTGSLVRADRWSPDGLVAAPG

SEQ ID NO: 1023279 - protein, 286 aa, Homo sapiens
VDQLLRVRTEEREQIKTLNNKFGSFIDKVRFLEQNKVLDTKWTLLQEQGTKTAEARTWEPLFEQYINNLTEAAGQPSCGNGGRLDSELRNMQDLVEDFKNKYEDETQTQRYQLLRMSFVHCWQHTDCSMLPYTDYTGWEACAATGLTALDWMSTEPSCNDVSSELPAGLSPGMQHAMVLCTTLQMGPFYNGTNQTRHTLGNLGTRPCHFRHERAHTESAKDNGSGKKYGPNSRRAPGNQATTRKYHRGIILMGNPTGWTVTRGKAFGPSRRTTNAPGAQQSTVGGD

SEQ ID NO: 1023280 - protein, 165 aa, Homo sapiens
MIASTPILPQAAGPTSTPLLPQVPSIPPLVQPVANVPAVAADSVIHSQTQPALLPNQPHTHCPEVDSDTQPKAPGIDDIKTLEEKLRSLFSEHSSSGAQHASVSLETSLVIESTVTPGIPTTAVAPSKLLTSTTSTCLPPTNLPLGTVALPVTPVVTPGQVSTPV

SEQ ID NO: 1023281 - protein, 110 aa, Homo sapiens
TVVRYLPNERFKEYIRSTCTLNVFRDLQCERRQQSSPTMTGKTDQEMVASVWTIIPHRSSVIILASDGYYAMVGQVHGETHGYDTESHGEGLPTSLVLSATEVTGSTPGE

SEQ ID NO: 1023282 - protein, 37 aa, Homo sapiens
RQNHYKGVVWIERRSVQRAKVGPLSLCHSLVEGADLE

SEQ ID NO: 1023283 - protein, 264 aa, Homo sapiens
QFAQSGAGTLALGSPWRCFQCLPALAVAGAAAAHGARWPGPRPPRGLLLCLLLAASCAWSGVAGEEELQVIQPDKSVSVAAGESAILHCTVTSLIPVGPIQWFRGAGPARELIYNQKEGHFPRVTTVSESTKRENMDFSISISNITPADAGTYYCVKFRKGSPDTEFEVWQQALSCLCVPKPLPPWYRALRRGPEPQRHSELFSLRGPDWLSTTQKDITPESGSENCGIGRLQNFHEQRGTPVGRGAVSLPQSQQHSQGCVMSR

SEQ ID NO: 1023284 - protein, 76 aa, Homo sapiens
RDTTVRYVTDPDPQNPNGPDPTIADMDRPRSSKQGQILPPQTLTDPDPHTCTTANLLRHGETQILIPVLDSFLLRY

SEQ ID NO: 1023285 - protein, 94 aa, Homo sapiens
IPDHACTRSYLLRHEQIFILILMPDLTWRHDRPRSSYQGQSLPSQTLKDPDAYICAKSYFPRHGQSQILILMPDPTSSDMKRPRSLYQGQVLPP

SEQ ID NO: 1023286 - protein, 39 aa, Homo sapiens
TASTRSHYGHHNDRYSSRSTSKRFCWRRKRFSAEKGYGS

SEQ ID NO: 1023287 - protein, 42 aa, Homo sapiens
EGDVDCSAALTLCLQLVQAPSAYFKDPFPISAASCYCTFIVM

SEQ ID NO: 1023288 - protein, 130 aa, Homo sapiens
MVPGGKHLEGVEAECRPWRIFLQPLEYTVKLGDTNVHHRSKTALVVPVRDVVIHRYFTSPGIIENDIALALLDFPVNYSTHIQPVCLPEQAFMVQAGTNCWVTGWGKVNETDSQTKRIVKLSSALGPGNQ

SEQ ID NO: 1023289 - protein, 101 aa, Homo sapiens
MLWTRQDTWAPHGAAASSSEGRARSRGTRPEHPMPCSRSPGHLPTSHTGAPGSAWPARALVNHLAEQFPWSPFGSRAVSQDGPRLSLSRGTSCLGPMGTEL

SEQ ID NO: 1023290 - protein, 39 aa, Homo sapiens
ALTPNRESVMAIYDDNPCQLQELIELVEQDAQYTSAVAH

SEQ ID NO: 1023291 - protein, 57 aa, Homo sapiens
LCSDPHNVEHFLEYLLQPQVHLERNTGRERNTGRERNTGRERNTGRERNTGRSAAPG

SEQ ID NO: 1023292 - protein, 59 aa, Homo sapiens
ARKRSVRVRERILWISRGRAEHRAERNTGRERNTGRERNTGRERNTGRERNTGRSAAPG

SEQ ID NO: 1023293 - protein, 118 aa, Homo sapiens
PRCGLVGSDLHDQAEHPPCVYVNQQSRKAEEGASYRKVGRSWCCLCSHLGSLRWLSHDLAWPPASISSVPYGAVLGIPQNNVCERNTGRERNTGRERNTGRERNTGRERNTGRSAAPG

SEQ ID NO: 1023294 - protein, 40 aa, Homo sapiens
MSATLLLLELHEGIEDTKVELVQEGQLVPALTYVAQSNGL

SEQ ID NO: 1023295 - protein, 51 aa, Homo sapiens
GVGYVVRHLLSYGDHNSAALVCKSPLRSSLVYGKFRLTENRAQHQLMQTKV

SEQ ID NO: 1023296 - protein, 108 aa, Homo sapiens
VLLSPVVCPRPLLSYCPAVWPHGQKRYEQISGHAPSLFLLPPFGPHHLFLLNHPVCLNQVSFLCDLYQRTLLHPPPPPHPTSAWAVFSGPAGETLCVKEPTPRPEQAM

SEQ ID NO: 1023297 - protein, 295 aa, Homo sapiens
MRELVPLPAGPCGPIGAQFWEVIRDEPGIAPPGSHGDRDLPLARLHVYHAAPGNVPRALLVALAPGPMDSVRSGPFGPIFRPAPFVFGPSGAGNWAKGPPGGAGLVASVLAVVRQASESCDCLPGFPLPPSLGGGTGSGMGTLLISQIREEYPNRILNTFSALPSPKVSDTVVEPYNATLSVHQLVENTDETYCIDNEALYDICFRTLKLTTPTYGDLNHLVSATMSGVTNLPALPGPAERLRWAVNMVPFPRLHFFMPGFAPLTSRGSQQYALTVPELTQQMFDSKDMMAAAAH

SEQ ID NO: 1023298 - protein, 76 aa, Homo sapiens
YGPGRTAEQASCGERRMGVERTSMGHHYLLTGQMDKWKNRHMDKQTARRNGAVTQWVPFFSQHGNCHMTPINNGEG

SEQ ID NO: 1023299 - protein, 46 aa, Homo sapiens
VWNQRVSNSVSAPLALPQVPFLLLSFIPGSTLRLQVFLEFRDLSKP

SEQ ID NO: 1023300 - protein, 130 aa, Homo sapiens
GARLAARALPPPRALVPQPSLGPATPPSPFSLQNFPSCCPQHWDTKPSLSTLLIWLTLTRSETCVMLSWHAPLVFVDFSDGKELSMQSHINFYLPSPSSCLLLRMGTILTYSLFCPSAQSRCVEGWKYTE

SEQ ID NO: 1023301 - protein, 272 aa, Homo sapiens
PHTKYTPQWLTPANESERETGPPLPLKGPPGLGKGGGVGWVSKEKKRRGEQVSGRGWKVIAGPHPPLPSVPYCLCWQTWGRGPFVPINNQKQQAGAAANNGQAFGHKILSLYISLTLLTHQGGIFAEGKVQDLSRVAPVVSKQAAGPGVPEAHDAIQAAGIYHGSACLPQQLHDARLVLTLMPKSLQYQVIDGQGPIQVANSCQGHHTAEAQGLHRVGLTLLPFSQAGLGGTVSGLKTPTTLPVVALTSLAWQSTEPVRIKLPSWLATQVSG

SEQ ID NO: 1023302 - protein, 48 aa, Homo sapiens
CAALWEALNPQPHPELQPSRDSSPVLYEGKDCYVVLTSDRTPWIFMVS

SEQ ID NO: 1023303 - protein, 48 aa, Homo sapiens
CWSVLQLLRGVELHPALLLSQSAAELRARFAIAGVIVALPVGDAGQEM

SEQ ID NO: 1023304 - protein, 118 aa, Homo sapiens
VHVVTGFKCDKTHKTHHLNHFQCVVGGVTFTLLQALQVGGVTHIHTVAGVQVGGVTFGLLQAYRSVVYTHAVAGVQVGGVTHIHAVAGVQVGAVTHMLLQEYRSVVLHAVAGVQVGGV

SEQ ID NO: 1023305 - protein, 40 aa, Homo sapiens
ALRPTVENPPGESHGGGDPTHGGRHQVVEVPVGGFQQLEG

SEQ ID NO: 1023306 - protein, 614 aa, Homo sapiens
MGGSSPVTSKAIVDADGRIYIRNWQGGILSGGFEKNPKPIFTEGKNQLEIQNLQEDWDHFEPLLSSLLRRMPELETLEIMKLVNCPETFTPDMRCIMGESPAVQGYFVLAGMNSAGLSFGGGAGKYLAEWMVHGYPSENVWELDLKRFGALQSSRTFLRHRAIEVMPLMYDLKVPRWDFQTGRQLRTSPLYDRLDAQGARWMEKHGFERPKYFVPPDKDLLALEQSKTFYKPDWFDIVESEVKCCKEAVCVIDMSSFTKFEITSTGDQALEVLQYLFSSDLDVPVGHIVHTGMLNEGGGYENDCSIARLNKRSFFMISPTDQQVHCWAWLKKHMPKDSNLLLEDVTWKYTALNLIGPRAVDVLSELSYAPMTPDHFPSLFCKEMSVGYAKGIRVMSMTHTGEPGFMLYIPIEGMDFIGRDALLQQKQNGVYKRLTMFILDDHDSDLDLWPWWGEPIYRNGQYVGKTTSSAYSYSLERHVCLGFVHNFSEDTGEEQVVTADFINRGEYEIDIAGYRFQAKAKLYPVASLFTQKRRKDDMELSDFLALPPPPPNIHSGLFFPSHPSLSCSWWQEVCLTGQKQAPHHLVLEWASPWSFSSFRLCSSSGAFASHLLSP

SEQ ID NO: 1023307 - protein, 123 aa, Homo sapiens
PHCRLPCAVNFQGVGCPRLLHLLGVERVAMARHMGFGSSAEVTSALLVAAPRLSQTWYGSHSFIYLTKGRMLGNCASRLPVGCGCAVYVVRGGGCHWWGPNLRAFWSPFFPFARLHPRIETGL

SEQ ID NO: 1023308 - protein, 65 aa, Homo sapiens
GSIPVSLMVQEKNAQRSLIIKGRYTGLQEALYISSHLSVTSEKIFSFIQLSGYSCRQLALLQCAS

SEQ ID NO: 1023309 - protein, 171 aa, Homo sapiens
TTLTLPNLHSRGNEKTLMEESAEQAQRRDETRVGRRRHSWRSRQSSQTKEFIFSELLSNLYSRRNLQTLVEESAEQAQRVRRDGSFSELLSNLHSRGTRRHSWRRRQSRQTKEFIFSELLPNLYSRGNEKTLVEASAEQADQGVHLLRAAVQPALAWNEKTLWSVAEHATV

SEQ ID NO: 1023310 - protein, 114 aa, Homo sapiens
IELVPDSNSALPPALGFSLIYLCRFAVTGTYNTIAAFLDGSLTDFPTNFRYAYRFPLVWWVFLPYRYFACPGFCPPGFGFSLRVPTVLIICSTGICTCYPSTTSFDLALGPDLP

SEQ ID NO: 1023311 - protein, 68 aa, Homo sapiens
YQCDLRITHWPSLNMETSLQISVEFQRDLITLLLGFAISSFTSGKIPSRPPAAEVPSLTENMRNFSLF

SEQ ID NO: 1023312 - protein, 108 aa, Homo sapiens
VLRLRSTYHLATAPILPYLTVHMGEAATLPPACLGASSATEGQAPELELRALSQTAKATEVDHTGDSGLTALTGTCILCHCCALSPQSGCSVPLSRNVGVLQEELGEM

SEQ ID NO: 1023313 - protein, 143 aa, Homo sapiens
MRRDGLSAARRERPEVNGSRDGSGPMKSSMQQDPGDLATIAVLTFGGDAQGMNAAVRAVVLSWISSPVPDVFFVHEGYQGLVDGGDHIKEATMGERPMMLQLGGTVIGSARCKGLREREVTDSELPTTLVKRGITNSLLSIWG

SEQ ID NO: 1023314 - protein, 122 aa, Homo sapiens
MCLSPVLGLAEGLEGTAASSSQHSVALYQAPHLLLVLALVTSQGPSRCRGFLFGQAPCQGDLVASSFSFAIGMSPCSSLLFFFFEMDFHFCCPGLELQCLNSRSHLQPSASRVSSYRPALGS

SEQ ID NO: 1023315 - protein, 76 aa, Homo sapiens
MCTALQQSRSAEFSLFLCTLLGLANFPWARLAVTAPSCASLVSVLDQWWMSVGWREPLRALVLDAHAPDCEVPTGA

SEQ ID NO: 1023316 - protein, 192 aa, Homo sapiens
PPFRGRRVSDRVGSVWAGGKREALIVSVCDCETAVSFLTLDLEAALVMSWSSCDCSGYMYGYLWKQVATRRNGERALWLAMEPPPKLCGLLGRLHPAFGVCVRHFGYESPEMQADAESDAAEMERKTDVALSDARDVELCELVNPENVEDRGPTPSVWVVSPRDDYREEESSISSQISKKEKLLSQPEQGPF

SEQ ID NO: 1023317 - protein, 65 aa, Homo sapiens
PDVSVPFSTHNHHSLTMLISHEQPMQTCLTNTPVDLQQPERRETFSELSTMITPREPHRPRDHNN

SEQ ID NO: 1023318 - protein, 138 aa, Homo sapiens
RASERAEHIAAGSQSGQTLGGGVWQERRGASRRSAFPATVPRELELLGLGDPGRPPRCRRSRCLAAAAAAWCFLQVESRHLDALAGGAGPQTIGRFPRTSDQWLRHRTPSYDTGQAICEPLSKTHDALQKTGNPKKPL

SEQ ID NO: 1023319 - protein, 106 aa, Homo sapiens
MCIICKCFTLLYLPESPGPGRSVSLHSMAVYFVNMIRPTVSHQWPFEFTSEQSTTARPEGLLEGQSNAECVPSSQICHHRWIHVSSVDKVPCVASNSASSMPLHLL

SEQ ID NO: 1023320 - protein, 72 aa, Homo sapiens
CRRPRGSPLQSTGSAHALTAVCNHISSVRAVAVWGIGTPGGPQDPQPGLTAHVVSAGRRLGVLGSGVTMMLK

SEQ ID NO: 1023321 - protein, 44 aa, Homo sapiens
LDHRDALEVTALHSLAGRGSGRLMTRPPLAQPHHSVSMAAMVGG

SEQ ID NO: 1023322 - protein, 125 aa, Homo sapiens
MVVSVVLSAGRYEYYVLRLIWRRWFSLADYNVDYRRTSRRYLLILLRLKERYGISNHLHETGKRLALELPLGRAYAGTFMHPELRCMLKLAARIYCCRPEIHGRSHFINLKVRIRKIPCETQQNN
